(12) United States Patent
Finnessy et al.

(10) Patent No.: US 10,568,328 B2
(45) Date of Patent: Feb. 25, 2020

(54) METHODS AND COMPOSITIONS FOR WEED CONTROL

(71) Applicant: Monsanto Technology LLC, St. Louis, MO (US)

(72) Inventors: John J. Finnessy, Des Peres, MO (US); Santiago X. Navarro, St. Louis, MO (US); Robert Douglas Sammons, Wentzville, MO (US); Nengbing Tao, O'Fallon, MO (US)

(73) Assignee: Monsanto Technology LLC, St. Louis, MO (US)

( * ) Notice: Subject to any disclaimer, the term of this patent is extended or adjusted under 35 U.S.C. 154(b) by 493 days.

(21) Appl. No.: 14/206,707

(22) Filed: Mar. 12, 2014

(65) Prior Publication Data

US 2014/0274712 A1 Sep. 18, 2014

Related U.S. Application Data

(60) Provisional application No. 61/787,620, filed on Mar. 15, 2013.

(51) Int. Cl.
   *C12N 15/82* (2006.01)
   *A01N 43/90* (2006.01)

(52) U.S. Cl.
   CPC .................................. *A01N 43/90* (2013.01)

(58) Field of Classification Search
   CPC ........ A01N 43/90; A01N 57/20; A01N 25/30; C07K 14/415; C12N 15/8274
   See application file for complete search history.

(56) References Cited

U.S. PATENT DOCUMENTS

| | | | |
|---|---|---|---|
| 3,687,808 A | 8/1972 | Merigan et al. |
| 3,791,932 A | 2/1974 | Schuurs et al. |
| 3,839,153 A | 10/1974 | Schuurs et al. |
| 3,850,578 A | 11/1974 | McConnell |
| 3,850,752 A | 11/1974 | Schuurs et al. |
| 3,853,987 A | 12/1974 | Dreyer |
| 3,867,517 A | 2/1975 | Ling |
| 3,879,262 A | 4/1975 | Schuurs et al. |
| 3,901,654 A | 8/1975 | Gross |
| 3,935,074 A | 1/1976 | Rubenstein et al. |
| 3,984,533 A | 10/1976 | Uzgiris |
| 3,996,345 A | 12/1976 | Ullman et al. |
| 4,034,074 A | 7/1977 | Miles |
| 4,098,876 A | 7/1978 | Piasio et al. |
| 4,469,863 A | 9/1984 | Ts'o et al. |
| 4,476,301 A | 10/1984 | Imbach et al. |
| 4,535,060 A | 8/1985 | Comai |
| 4,581,847 A | 4/1986 | Hibberd et al. |
| 4,666,828 A | 5/1987 | Gusella |
| 4,683,202 A | 7/1987 | Mullis |
| 4,761,373 A | 8/1988 | Anderson et al. |
| 4,769,061 A | 9/1988 | Comai |
| 4,801,531 A | 1/1989 | Frossard |
| 4,810,648 A | 3/1989 | Stalker |
| 4,879,219 A | 11/1989 | Wands et al. |
| 4,940,835 A | 7/1990 | Shah et al. |
| 4,971,908 A | 11/1990 | Kishore et al. |
| 5,004,863 A | 4/1991 | Umbeck |
| 5,011,771 A | 4/1991 | Bellet et al. |
| 5,013,659 A | 5/1991 | Bedbrook et al. |
| 5,015,580 A | 5/1991 | Christou et al. |
| 5,023,243 A | 6/1991 | Tullis |
| 5,034,506 A | 7/1991 | Summerton et al. |
| 5,094,945 A | 3/1992 | Comai |
| 5,141,870 A | 8/1992 | Bedbrook et al. |
| 5,145,783 A | 9/1992 | Kishore et al. |
| 5,159,135 A | 10/1992 | Umbeck |
| 5,166,315 A | 11/1992 | Summerton et al. |
| 5,177,196 A | 1/1993 | Meyer, Jr. et al. |
| 5,185,444 A | 2/1993 | Summerton et al. |
| 5,188,642 A | 2/1993 | Shah et al. |
| 5,188,897 A | 2/1993 | Suhadolnik et al. |
| 5,192,659 A | 3/1993 | Simons |
| 5,214,134 A | 5/1993 | Weis et al. |
| 5,216,141 A | 6/1993 | Benner |
| 5,235,033 A | 8/1993 | Summerton et al. |
| 5,264,423 A | 11/1993 | Cohen et al. |
| 5,264,562 A | 11/1993 | Matteucci |
| 5,264,564 A | 11/1993 | Matteucci |
| 5,272,057 A | 12/1993 | Smulson et al. |
| 5,276,019 A | 1/1994 | Cohen et al. |

(Continued)

FOREIGN PATENT DOCUMENTS

| | | |
|---|---|---|
| AU | 2008/258254 B2 | 7/2014 |
| AU | 2008258254 B2 | 7/2014 |

(Continued)

OTHER PUBLICATIONS

Della-Cioppa, Guy, and Ganesh M. Kishore. "Import of a precursor protein into chloroplasts is inhibited by the herbicide glyphosate." The EMBO journal 7.5 (1988): 1299.*

W. Huang, Q. Ling, J. Bedard, K. Lilley, P. Jarvis, In vivo analyses of the roles of essential Omp85-related proteins in the chloroplast outer envelope membrane, Plant Physiol. 157 (2011) 147-159.*

Zhong, Rong, et al. "A forward genetic screen to explore chloroplast protein import in vivo identifies Moco sulfurase, pivotal for ABA and IAA biosynthesis and purine turnover." The Plant Journal 63.1 (2010): 44-59.*

(Continued)

*Primary Examiner* — Weihua Fan

(74) *Attorney, Agent, or Firm* — Amanda Carmany-Rampey; Arnold & Porter Kaye Scholer LLP

(57) ABSTRACT

Provided are novel compositions for use to herbicide activity. Specifically, the present application describes methods and compositions that modulate the expression of a plastid protein import system of a plant. Also provided are combinations of compositions and methods that enhance weed control.

36 Claims, 1 Drawing Sheet

Specification includes a Sequence Listing.

(56) References Cited

U.S. PATENT DOCUMENTS

| | | | |
|---|---|---|---|
| 5,281,521 A | 1/1994 | Trojanowski et al. |
| 5,286,634 A | 2/1994 | Stadler et al. |
| 5,286,717 A | 2/1994 | Cohen et al. |
| 5,304,732 A | 4/1994 | Anderson et al. |
| 5,310,667 A | 5/1994 | Eichholtz et al. |
| 5,312,910 A | 5/1994 | Kishore et al. |
| 5,321,131 A | 6/1994 | Agrawal et al. |
| 5,331,107 A | 7/1994 | Anderson et al. |
| 5,339,107 A | 8/1994 | Henry et al. |
| 5,346,107 A | 9/1994 | Bouix et al. |
| 5,378,824 A | 1/1995 | Bedbrook et al. |
| 5,384,253 A | 1/1995 | Krzyzek et al. |
| 5,390,667 A | 2/1995 | Kumakura et al. |
| 5,392,910 A | 2/1995 | Bell et al. |
| 5,393,175 A | 2/1995 | Courville |
| 5,399,676 A | 3/1995 | Froehler |
| 5,405,938 A | 4/1995 | Summerton et al. |
| 5,405,939 A | 4/1995 | Suhadolnik et al. |
| 5,416,011 A | 5/1995 | Hinchee et al. |
| 5,453,496 A | 9/1995 | Caruthers et al. |
| 5,455,233 A | 10/1995 | Spielvogel et al. |
| 5,459,127 A | 10/1995 | Felgner et al. |
| 5,460,667 A | 10/1995 | Moriyuki et al. |
| 5,462,910 A | 10/1995 | Ito et al. |
| 5,463,174 A | 10/1995 | Moloney et al. |
| 5,463,175 A | 10/1995 | Barry et al. |
| 5,466,677 A | 11/1995 | Baxter et al. |
| 5,470,967 A | 11/1995 | Huie et al. |
| 5,476,925 A | 12/1995 | Letsinger et al. |
| 5,489,520 A | 2/1996 | Adams et al. |
| 5,489,677 A | 2/1996 | Sanghvi et al. |
| 5,491,288 A | 2/1996 | Chaubet et al. |
| 5,510,471 A | 4/1996 | Lebrun et al. |
| 5,518,908 A | 5/1996 | Corbin et al. |
| 5,519,126 A | 5/1996 | Hecht |
| 5,536,821 A | 7/1996 | Agrawal et al. |
| 5,538,880 A | 7/1996 | Lundquist et al. |
| 5,541,306 A | 7/1996 | Agrawal et al. |
| 5,541,307 A | 7/1996 | Cook et al. |
| 5,550,111 A | 8/1996 | Suhadolnik et al. |
| 5,550,318 A | 8/1996 | Adams et al. |
| 5,550,398 A | 8/1996 | Kocian et al. |
| 5,550,468 A | 8/1996 | Häberlein et al. |
| 5,558,071 A | 9/1996 | Ward et al. |
| 5,561,225 A | 10/1996 | Maddry et al. |
| 5,561,236 A | 10/1996 | Leemans et al. |
| 5,563,253 A | 10/1996 | Agrawal et al. |
| 5,569,834 A | 10/1996 | Hinchee et al. |
| 5,571,799 A | 11/1996 | Tkachuk et al. |
| 5,587,361 A | 12/1996 | Cook et al. |
| 5,591,616 A | 1/1997 | Hiei et al. |
| 5,593,874 A | 1/1997 | Brown et al. |
| 5,596,086 A | 1/1997 | Matteucci et al. |
| 5,597,717 A | 1/1997 | Guerineau et al. |
| 5,602,240 A | 2/1997 | De Mesmaeker et al. |
| 5,605,011 A | 2/1997 | Bedbrook et al. |
| 5,608,046 A | 3/1997 | Cook et al. |
| 5,610,289 A | 3/1997 | Cook et al. |
| 5,618,704 A | 4/1997 | Sanghvi et al. |
| 5,623,070 A | 4/1997 | Cook et al. |
| 5,625,050 A | 4/1997 | Beaton et al. |
| 5,627,061 A | 5/1997 | Barry et al. |
| 5,633,360 A | 5/1997 | Bischofberger et al. |
| 5,633,435 A | 5/1997 | Barry et al. |
| 5,633,448 A | 5/1997 | Lebrun et al. |
| 5,639,024 A | 6/1997 | Mueller et al. |
| 5,646,024 A | 7/1997 | Leemans et al. |
| 5,648,477 A | 7/1997 | Leemans et al. |
| 5,663,312 A | 9/1997 | Chaturvedula |
| 5,677,437 A | 10/1997 | Teng et al. |
| 5,677,439 A | 10/1997 | Weis et al. |
| 5,719,046 A | 2/1998 | Guerineau et al. |
| 5,721,138 A | 2/1998 | Lawn |
| 5,731,180 A | 3/1998 | Dietrich |
| 5,739,180 A | 4/1998 | Taylor-Smith |
| 5,746,180 A | 5/1998 | Jefferson et al. |
| 5,767,361 A | 6/1998 | Dietrich |
| 5,767,373 A | 6/1998 | Ward et al. |
| 5,780,708 A | 7/1998 | Lundquist et al. |
| 5,804,425 A | 9/1998 | Barry et al. |
| 5,824,877 A | 10/1998 | Hinchee et al. |
| 5,837,848 A | 11/1998 | Ely et al. |
| 5,859,347 A | 1/1999 | Brown et al. |
| 5,866,775 A | 2/1999 | Eichholtz et al. |
| 5,874,265 A | 2/1999 | Adams et al. |
| 5,879,903 A | 3/1999 | Strauch et al. |
| 5,914,451 A | 6/1999 | Martinell et al. |
| 5,919,675 A | 7/1999 | Adams et al. |
| 5,928,937 A | 7/1999 | Kakefuda et al. |
| 5,939,602 A | 8/1999 | Volrath et al. |
| 5,969,213 A | 10/1999 | Adams et al. |
| 5,981,840 A | 11/1999 | Zhao et al. |
| 5,985,793 A * | 11/1999 | Sandbrink ............ A01N 25/00 424/405 |
| RE36,449 E | 12/1999 | Lebrun et al. |
| 6,040,497 A | 3/2000 | Spencer et al. |
| 6,056,938 A | 5/2000 | Unger et al. |
| 6,069,115 A | 5/2000 | Pallett et al. |
| 6,084,089 A | 7/2000 | Mine et al. |
| 6,084,155 A | 7/2000 | Volrath et al. |
| 6,118,047 A | 9/2000 | Anderson et al. |
| 6,121,513 A | 9/2000 | Zhang et al. |
| 6,130,366 A | 10/2000 | Herrera-Estrella et al. |
| 6,140,078 A | 10/2000 | Sanders et al. |
| 6,153,812 A | 11/2000 | Fry et al. |
| 6,160,208 A | 12/2000 | Lundquist et al. |
| 6,177,616 B1 | 1/2001 | Bartsch et al. |
| 6,194,636 B1 | 2/2001 | McElroy et al. |
| 6,225,105 B1 | 5/2001 | Sathasivan et al. |
| 6,225,114 B1 | 5/2001 | Eichholtz et al. |
| 6,232,526 B1 | 5/2001 | McElroy et al. |
| 6,245,968 B1 | 6/2001 | Boudec et al. |
| 6,248,876 B1 | 6/2001 | Barry et al. |
| 6,252,138 B1 | 6/2001 | Karimi et al. |
| RE37,287 E | 7/2001 | Lebrun et al. |
| 6,268,549 B1 | 7/2001 | Sailland et al. |
| 6,271,359 B1 | 8/2001 | Norris et al. |
| 6,282,837 B1 | 9/2001 | Ward et al. |
| 6,288,306 B1 | 9/2001 | Ward et al. |
| 6,288,312 B1 | 9/2001 | Christou et al. |
| 6,294,714 B1 | 9/2001 | Matsunaga et al. |
| 6,326,193 B1 | 12/2001 | Liu et al. |
| 6,329,571 B1 | 12/2001 | Hiei |
| 6,348,185 B1 | 2/2002 | Piwnica-Worms |
| 6,365,807 B1 | 4/2002 | Christou et al. |
| 6,384,301 B1 | 5/2002 | Martinell et al. |
| 6,385,902 B1 | 5/2002 | Schipper et al. |
| 6,399,861 B1 | 6/2002 | Anderson et al. |
| 6,403,865 B1 | 6/2002 | Koziel et al. |
| 6,414,222 B1 | 7/2002 | Gengenbach et al. |
| 6,421,956 B1 | 7/2002 | Boukens et al. |
| 6,426,446 B1 | 7/2002 | McElroy et al. |
| 6,433,252 B1 | 8/2002 | Kriz et al. |
| 6,437,217 B1 | 8/2002 | McElroy et al. |
| 6,453,609 B1 | 9/2002 | Soll et al. |
| 6,479,291 B2 | 11/2002 | Kumagai et al. |
| 6,506,559 B1 | 1/2003 | Fire et al. |
| 6,642,435 B1 | 11/2003 | Rafalski et al. |
| 6,644,341 B1 | 11/2003 | Chemo et al. |
| 6,645,914 B1 | 11/2003 | Woznica et al. |
| 6,768,044 B1 | 7/2004 | Boudec et al. |
| 6,992,237 B1 | 1/2006 | Habben et al. |
| 7,022,896 B1 | 4/2006 | Weeks et al. |
| 7,026,528 B2 | 4/2006 | Cheng et al. |
| RE39,247 E | 8/2006 | Barry et al. |
| 7,105,724 B2 | 9/2006 | Weeks et al. |
| 7,119,256 B2 | 10/2006 | Shimizu et al. |
| 7,138,564 B2 | 11/2006 | Tian et al. |
| 7,297,541 B2 | 11/2007 | Moshiri et al. |
| 7,304,209 B2 | 12/2007 | Zink et al. |
| 7,312,379 B2 | 12/2007 | Andrews et al. |
| 7,323,310 B2 | 1/2008 | Peters et al. |
| 7,371,927 B2 | 5/2008 | Yao et al. |
| 7,392,379 B2 | 6/2008 | Le Pennec et al. |

(56) References Cited

U.S. PATENT DOCUMENTS

| | | |
|---|---|---|
| 7,405,347 B2 | 7/2008 | Hammer et al. |
| 7,406,981 B2 | 8/2008 | Hemo et al. |
| 7,462,379 B2 | 12/2008 | Fukuda et al. |
| 7,485,777 B2 | 2/2009 | Nakajima et al. |
| 7,525,013 B2 | 4/2009 | Hildebrand et al. |
| 7,550,578 B2 | 6/2009 | Budworth et al. |
| 7,622,301 B2 | 11/2009 | Ren et al. |
| 7,657,299 B2 | 2/2010 | Huizenga et al. |
| 7,671,254 B2 | 3/2010 | Tranel et al. |
| 7,714,188 B2 | 5/2010 | Castle et al. |
| 7,738,626 B2 | 6/2010 | Weese et al. |
| 7,807,791 B2 | 10/2010 | Sekar et al. |
| 7,838,263 B2 | 11/2010 | Dam et al. |
| 7,838,733 B2 | 11/2010 | Wright et al. |
| 7,842,856 B2 | 11/2010 | Tranel et al. |
| 7,884,262 B2 | 2/2011 | Clemente et al. |
| 7,910,805 B2 | 3/2011 | Duck et al. |
| 7,935,869 B2 | 5/2011 | Pallett et al. |
| 7,943,819 B2 | 5/2011 | Baum et al. |
| 7,973,218 B2 | 7/2011 | McCutchen et al. |
| 8,090,164 B2 | 1/2012 | Bullitt et al. |
| 8,143,480 B2 | 3/2012 | Axtell et al. |
| 8,226,938 B1 | 7/2012 | Meikle et al. |
| 8,548,778 B1 | 10/2013 | Hart et al. |
| 8,554,490 B2 | 10/2013 | Tang et al. |
| 9,121,022 B2 | 9/2015 | Sammons et al. |
| 9,422,557 B2 | 8/2016 | Ader |
| 9,445,603 B2 | 9/2016 | Baum et al. |
| 2001/0006797 A1 | 7/2001 | Kumagai et al. |
| 2001/0042257 A1 | 11/2001 | Connor-Ward et al. |
| 2002/0069430 A1 | 6/2002 | Kaiska et al. |
| 2002/0114784 A1 | 8/2002 | Li et al. |
| 2003/0150017 A1 | 8/2003 | Mesa et al. |
| 2003/0154508 A1 | 8/2003 | Stevens et al. |
| 2003/0167537 A1 | 9/2003 | Jiang |
| 2003/0221211 A1 | 11/2003 | Rottmann et al. |
| 2004/0029275 A1 | 2/2004 | Brown et al. |
| 2004/0053289 A1 | 3/2004 | Allen et al. |
| 2004/0055041 A1 | 3/2004 | Labate et al. |
| 2004/0072692 A1 | 4/2004 | Hoffman et al. |
| 2004/0082475 A1 | 4/2004 | Hoffman et al. |
| 2004/0123347 A1 | 6/2004 | Hinchey et al. |
| 2004/0126845 A1 | 7/2004 | Eenennaam et al. |
| 2004/0133944 A1 | 7/2004 | Hake et al. |
| 2004/0147475 A1 | 7/2004 | Li et al. |
| 2004/0177399 A1 | 9/2004 | Hammer et al. |
| 2004/0216189 A1 | 10/2004 | Houmard et al. |
| 2004/0244075 A1 | 12/2004 | Cal et al. |
| 2004/0250310 A1 | 12/2004 | Shukla et al. |
| 2005/0005319 A1 | 1/2005 | della-Cioppa et al. |
| 2005/0215435 A1 | 9/2005 | Menges et al. |
| 2005/0223425 A1 | 10/2005 | Clinton et al. |
| 2005/0246784 A1 | 11/2005 | Plesch et al. |
| 2005/0250647 A1 | 11/2005 | Hills et al. |
| 2006/0009358 A1 | 1/2006 | Kibler et al. |
| 2006/0021087 A1 | 1/2006 | Baum et al. |
| 2006/0040826 A1* | 2/2006 | Eaton ............... A01N 57/20 504/206 |
| 2006/0111241 A1 | 5/2006 | Gerwick, III et al. |
| 2006/0130172 A1 | 6/2006 | Whaley et al. |
| 2006/0135758 A1 | 6/2006 | Wu |
| 2006/0200878 A1 | 9/2006 | Lutfiyya et al. |
| 2006/0223708 A1 | 10/2006 | Hoffman et al. |
| 2006/0223709 A1 | 10/2006 | Helmke et al. |
| 2006/0247197 A1 | 11/2006 | Van De Craen et al. |
| 2006/0272049 A1 | 11/2006 | Waterhouse et al. |
| 2006/0276339 A1 | 12/2006 | Windsor et al. |
| 2007/0011775 A1 | 1/2007 | Allen et al. |
| 2007/0021360 A1 | 1/2007 | Nyce et al. |
| 2007/0050863 A1 | 3/2007 | Tranel et al. |
| 2007/0124836 A1 | 5/2007 | Baum et al. |
| 2007/0199095 A1 | 8/2007 | Allen et al. |
| 2007/0250947 A1 | 10/2007 | Boukharov et al. |
| 2007/0259785 A1 | 11/2007 | Heck et al. |
| 2007/0269815 A1 | 11/2007 | Rivory et al. |
| 2007/0281900 A1 | 12/2007 | Cui et al. |
| 2007/0300329 A1 | 12/2007 | Allen et al. |
| 2008/0022423 A1 | 1/2008 | Roberts et al. |
| 2008/0050342 A1 | 2/2008 | Fire et al. |
| 2008/0092256 A1 | 4/2008 | Kohn |
| 2008/0113351 A1 | 5/2008 | Naito et al. |
| 2008/0155716 A1 | 6/2008 | Sonnewald et al. |
| 2008/0214443 A1 | 9/2008 | Baum et al. |
| 2009/0011934 A1 | 1/2009 | Zawierucha et al. |
| 2009/0018016 A1 | 1/2009 | Duck et al. |
| 2009/0036311 A1 | 2/2009 | Witschel et al. |
| 2009/0054240 A1 | 2/2009 | Witschel et al. |
| 2009/0075921 A1 | 3/2009 | Ikegawa et al. |
| 2009/0098614 A1 | 4/2009 | Zamore et al. |
| 2009/0118214 A1 | 5/2009 | Paldi et al. |
| 2009/0137395 A1 | 5/2009 | Chicoine et al. |
| 2009/0165153 A1 | 6/2009 | Wang et al. |
| 2009/0165166 A1 | 6/2009 | Feng et al. |
| 2009/0205079 A1 | 8/2009 | Kumar et al. |
| 2009/0215628 A1 | 8/2009 | Witschel et al. |
| 2009/0285784 A1 | 11/2009 | Raemaekers et al. |
| 2009/0293148 A1 | 11/2009 | Ren et al. |
| 2009/0298787 A1 | 12/2009 | Raemaekers et al. |
| 2009/0306189 A1 | 12/2009 | Raemaekers et al. |
| 2009/0307803 A1 | 12/2009 | Baum et al. |
| 2010/0005551 A1 | 1/2010 | Roberts et al. |
| 2010/0048670 A1 | 2/2010 | Biard et al. |
| 2010/0068172 A1 | 3/2010 | Van De Craen |
| 2010/0071088 A1 | 3/2010 | Sela et al. |
| 2010/0099561 A1 | 4/2010 | Selby et al. |
| 2010/0100988 A1 | 4/2010 | Tranel et al. |
| 2010/0152443 A1 | 6/2010 | Hirai et al. |
| 2010/0154083 A1 | 6/2010 | Ross et al. |
| 2010/0192237 A1 | 7/2010 | Ren et al. |
| 2010/0247578 A1 | 9/2010 | Salama |
| 2010/0248373 A1 | 9/2010 | Baba et al. |
| 2011/0015084 A1 | 1/2011 | Christian et al. |
| 2011/0015284 A1 | 1/2011 | Dees et al. |
| 2011/0028412 A1 | 2/2011 | Cappello et al. |
| 2011/0035836 A1 | 2/2011 | Eudes et al. |
| 2011/0041400 A1 | 2/2011 | Trias Vila et al. |
| 2011/0053226 A1 | 3/2011 | Rohayem |
| 2011/0098180 A1 | 4/2011 | Michel et al. |
| 2011/0105327 A1 | 5/2011 | Nelson |
| 2011/0105329 A1 | 5/2011 | Song et al. |
| 2011/0112570 A1 | 5/2011 | Mannava et al. |
| 2011/0126310 A1 | 5/2011 | Feng et al. |
| 2011/0126311 A1 | 5/2011 | Velcheva et al. |
| 2011/0152339 A1 | 6/2011 | Brown et al. |
| 2011/0152346 A1 | 6/2011 | Karleson et al. |
| 2011/0152353 A1 | 6/2011 | Koizumi |
| 2011/0160082 A1 | 6/2011 | Woo et al. |
| 2011/0166022 A1 | 7/2011 | Israels et al. |
| 2011/0166023 A1 | 7/2011 | Nettleton-Hammond et al. |
| 2011/0171176 A1 | 7/2011 | Baas et al. |
| 2011/0171287 A1 | 7/2011 | Saarma et al. |
| 2011/0177949 A1 | 7/2011 | Krapp et al. |
| 2011/0185444 A1 | 7/2011 | Li et al. |
| 2011/0185445 A1 | 7/2011 | Bogner et al. |
| 2011/0191897 A1 | 8/2011 | Poree et al. |
| 2011/0201501 A1 | 8/2011 | Song et al. |
| 2011/0203013 A1 | 8/2011 | Peterson et al. |
| 2011/0296555 A1 | 12/2011 | Ivashuta et al. |
| 2011/0296556 A1* | 12/2011 | Sammons ............... A01N 63/02 800/298 |
| 2012/0036594 A1 | 2/2012 | Cardoza et al. |
| 2012/0107355 A1 | 5/2012 | Harris et al. |
| 2012/0108497 A1 | 5/2012 | Paldi et al. |
| 2012/0137387 A1 | 5/2012 | Baum et al. |
| 2012/0150048 A1 | 6/2012 | Kang et al. |
| 2012/0156784 A1 | 6/2012 | Adams, Jr. et al. |
| 2012/0157512 A1 | 6/2012 | Ben-Chanoch et al. |
| 2012/0164205 A1 | 6/2012 | Baum et al. |
| 2012/0174262 A1 | 7/2012 | Azhakanandam et al. |
| 2012/0185967 A1 | 7/2012 | Sela et al. |
| 2012/0198586 A1 | 8/2012 | Narva et al. |
| 2012/0230565 A1 | 9/2012 | Steinberg et al. |
| 2012/0258646 A1 | 10/2012 | Sela et al. |
| 2013/0003213 A1 | 1/2013 | Kabelac et al. |

(56) References Cited

U.S. PATENT DOCUMENTS

| | | |
|---|---|---|
| 2013/0041004 A1 | 2/2013 | Drager et al. |
| 2013/0047297 A1 | 2/2013 | Sammons et al. |
| 2013/0047298 A1 | 2/2013 | Tang |
| 2013/0060133 A1 | 3/2013 | Kassab et al. |
| 2013/0067618 A1 | 3/2013 | Ader et al. |
| 2013/0084243 A1 | 4/2013 | Goetsch et al. |
| 2013/0096073 A1 | 4/2013 | Sidelman |
| 2013/0097726 A1 | 4/2013 | Ader et al. |
| 2013/0212739 A1 | 8/2013 | Giritch et al. |
| 2013/0226003 A1 | 8/2013 | Edic et al. |
| 2013/0247247 A1 | 9/2013 | Ader et al. |
| 2013/0254940 A1 | 9/2013 | Ader et al. |
| 2013/0254941 A1 | 9/2013 | Ader et al. |
| 2013/0288895 A1 | 10/2013 | Ader et al. |
| 2013/0318657 A1 | 11/2013 | Avniel et al. |
| 2013/0318658 A1 | 11/2013 | Ader et al. |
| 2013/0324842 A1 | 12/2013 | Mittal et al. |
| 2013/0326731 A1 | 12/2013 | Ader et al. |
| 2014/0018241 A1 | 1/2014 | Sammons et al. |
| 2014/0057789 A1 | 2/2014 | Sammons et al. |
| 2014/0109258 A1 | 4/2014 | Van De Craen et al. |
| 2014/0230090 A1 | 8/2014 | Avniel et al. |
| 2014/0274712 A1 | 9/2014 | Finnessy et al. |
| 2014/0275208 A1 | 9/2014 | Hu et al. |
| 2014/0296503 A1 | 10/2014 | Avniel et al. |
| 2015/0096079 A1 | 4/2015 | Avniel et al. |
| 2015/0143580 A1 | 5/2015 | Beattie et al. |
| 2015/0159156 A1 | 6/2015 | Inberg et al. |
| 2015/0203867 A1 | 7/2015 | Beattie et al. |
| 2015/0240258 A1 | 8/2015 | Beattie et al. |
| 2016/0015035 A1 | 1/2016 | Tao |
| 2016/0029644 A1 | 2/2016 | Tao |

FOREIGN PATENT DOCUMENTS

| | | |
|---|---|---|
| CN | 101279950 A | 10/2008 |
| CN | 101279951 A | 10/2008 |
| CN | 101892247 A | 11/2010 |
| CN | 101914540 A | 12/2010 |
| CN | 102154364 A | 8/2011 |
| CN | 102481311 A | 5/2012 |
| CN | 102822350 A | 12/2012 |
| CN | 102906263 A | 1/2013 |
| DE | 288618 A5 | 4/1991 |
| DE | 10000600 A1 | 7/2001 |
| DE | 10116399 A1 | 10/2002 |
| DE | 10256353 A1 | 6/2003 |
| DE | 10256354 A1 | 6/2003 |
| DE | 10256367 A1 | 6/2003 |
| DE | 10204951 A1 | 8/2003 |
| DE | 10234875 A1 | 2/2004 |
| DE | 10234876 A1 | 2/2004 |
| DE | 102004054666 A1 | 5/2006 |
| DE | 102005014638 A1 | 10/2006 |
| DE | 102005014906 A1 | 10/2006 |
| DE | 102007012168 A1 | 9/2008 |
| DE | 102010042866 A1 | 5/2011 |
| EP | 0 804 600 A1 | 11/1997 |
| EP | 1 155 615 A1 | 11/2001 |
| EP | 1 157 991 A2 | 11/2001 |
| EP | 1 238 586 A1 | 9/2002 |
| EP | 1 416 049 A1 | 5/2004 |
| EP | 1 496 123 A1 | 1/2005 |
| EP | 1 889 902 A1 | 2/2008 |
| EP | 1 964 919 A1 | 9/2008 |
| EP | 2 147 919 A1 | 1/2010 |
| EP | 2 160 098 B1 | 11/2010 |
| EP | 2 530 159 A1 | 3/2011 |
| EP | 2 305 813 A2 | 4/2011 |
| EP | 2 545 182 A1 | 1/2013 |
| JP | 2001253874 A | 9/2001 |
| JP | 2002080454 A | 3/2002 |
| JP | 2002138075 A | 5/2002 |
| JP | 2002145707 A | 5/2002 |
| JP | 2002220389 A | 8/2002 |
| JP | 2003064059 A | 3/2003 |
| JP | 2003096059 A | 4/2003 |
| JP | 2004051628 A | 2/2004 |
| JP | 2004107228 A | 4/2004 |
| JP | 2005008583 A | 1/2005 |
| JP | 2005239675 A | 9/2005 |
| JP | 2005314407 A | 11/2005 |
| JP | 2006232824 A | 9/2006 |
| JP | 2006282552 A | 10/2006 |
| JP | 2007153847 A | 6/2007 |
| JP | 2007161701 A | 6/2007 |
| JP | 2007182404 A | 7/2007 |
| JP | 2008074840 A | 4/2008 |
| JP | 2008074841 A | 4/2008 |
| JP | 2008133207 A | 6/2008 |
| JP | 2008133218 A | 6/2008 |
| JP | 2008169121 A | 7/2008 |
| JP | 2009-508481 A | 3/2009 |
| JP | 2009067739 A | 4/2009 |
| JP | 2009114128 A | 5/2009 |
| JP | 2009126792 A | 6/2009 |
| JP | 2009137851 A | 6/2009 |
| WO | WO 89/11789 A1 | 12/1989 |
| WO | WO 95/34659 A1 | 12/1995 |
| WO | WO 95/34668 A2 | 12/1995 |
| WO | WO 96/005721 A1 | 2/1996 |
| WO | WO 96/033270 A1 | 10/1996 |
| WO | WO 96/038567 A2 | 12/1996 |
| WO | WO 96/040964 A2 | 12/1996 |
| WO | WO 97/49816 A1 | 12/1997 |
| WO | WO 99/024585 A1 | 5/1999 |
| WO | WO 99/26467 A1 | 6/1999 |
| WO | WO 99/27116 A2 | 6/1999 |
| WO | WO 99/32619 A1 | 7/1999 |
| WO | WO 99/61631 A1 | 12/1999 |
| WO | WO 99/67367 A1 | 12/1999 |
| WO | WO 00/32757 A2 | 6/2000 |
| WO | WO 00/044914 A1 | 8/2000 |
| WO | WO 2001/007601 A2 | 2/2001 |
| WO | WO 2001/085970 A2 | 11/2001 |
| WO | WO 02/14472 A2 | 2/2002 |
| WO | WO 02/066660 A2 | 8/2002 |
| WO | WO 03/000679 A2 | 1/2003 |
| WO | WO 03/006422 A1 | 1/2003 |
| WO | WO 03/012052 A2 | 2/2003 |
| WO | WO 03/013247 A1 | 2/2003 |
| WO | WO 03/016308 A1 | 2/2003 |
| WO | WO 2003/014357 A2 | 2/2003 |
| WO | WO 03/020704 A1 | 3/2003 |
| WO | WO 03/022051 A1 | 3/2003 |
| WO | WO 03/022831 A1 | 3/2003 |
| WO | WO 03/022843 A1 | 3/2003 |
| WO | WO 03/029243 A2 | 4/2003 |
| WO | WO 03/037085 A1 | 5/2003 |
| WO | WO 03/037878 A1 | 5/2003 |
| WO | WO 03/045878 A2 | 6/2003 |
| WO | WO 03/050087 A2 | 6/2003 |
| WO | WO 03/051823 A1 | 6/2003 |
| WO | WO 03/051824 A1 | 6/2003 |
| WO | WO 03/051846 A2 | 6/2003 |
| WO | WO 03/064625 A2 | 8/2003 |
| WO | WO 03/076409 A1 | 9/2003 |
| WO | WO 03/077648 A2 | 9/2003 |
| WO | WO 03/087067 A1 | 10/2003 |
| WO | WO 03/090539 A1 | 11/2003 |
| WO | WO 03/091217 A1 | 11/2003 |
| WO | WO 03/093269 A1 | 11/2003 |
| WO | WO 03/104206 A2 | 12/2003 |
| WO | WO 2004/002947 A1 | 1/2004 |
| WO | WO 2004/002981 A2 | 1/2004 |
| WO | WO 2004/005485 A2 | 1/2004 |
| WO | WO 2004/009761 A2 | 1/2004 |
| WO | WO 2004/011429 A1 | 2/2004 |
| WO | WO 2004/022771 A2 | 3/2004 |
| WO | WO 2004/029060 A1 | 4/2004 |
| WO | WO 2004/035545 A2 | 4/2004 |
| WO | WO 2004/035563 A1 | 4/2004 |
| WO | WO 2004/035564 A1 | 4/2004 |
| WO | WO 2004/037787 A1 | 5/2004 |

(56) References Cited

FOREIGN PATENT DOCUMENTS

| | | |
|---|---|---|
| WO | WO 2004/049806 A1 | 6/2004 |
| WO | WO 2004/062351 A2 | 7/2004 |
| WO | WO 2004/067518 A1 | 8/2004 |
| WO | WO 2004/067527 A1 | 8/2004 |
| WO | WO 2004/074443 A2 | 9/2004 |
| WO | WO 2004/077950 A1 | 9/2004 |
| WO | WO 2005/000824 A1 | 1/2005 |
| WO | WO 2005/003362 A2 | 1/2005 |
| WO | WO 2005/007627 A1 | 1/2005 |
| WO | WO 2005/007860 A1 | 1/2005 |
| WO | WO 2005/040152 A1 | 5/2005 |
| WO | WO 2005/047233 A1 | 5/2005 |
| WO | WO 2005/047281 A1 | 5/2005 |
| WO | WO 2005/061443 A2 | 7/2005 |
| WO | WO 2005/061464 A1 | 7/2005 |
| WO | WO 2005/068434 A1 | 7/2005 |
| WO | WO 2005/070889 A1 | 8/2005 |
| WO | WO 2005/089551 A1 | 9/2005 |
| WO | WO 2005/095335 A1 | 10/2005 |
| WO | WO 2005/107437 A2 | 11/2005 |
| WO | WO 2005/110068 A2 | 11/2005 |
| WO | WO 2006/006569 A1 | 1/2006 |
| WO | WO 2006/024820 A1 | 3/2006 |
| WO | WO 2006/029828 A1 | 3/2006 |
| WO | WO 2006/029829 A1 | 3/2006 |
| WO | WO 2006/037945 A1 | 4/2006 |
| WO | WO 2006/050803 A1 | 5/2006 |
| WO | WO 2006/074400 A2 | 7/2006 |
| WO | WO 2006/090792 A1 | 8/2006 |
| WO | WO 2006/123088 A2 | 11/2006 |
| WO | WO 2006/125687 A1 | 11/2006 |
| WO | WO 2006/125688 A1 | 11/2006 |
| WO | WO 2006/132270 | 12/2006 |
| WO | WO 2006/132270 A1 | 12/2006 |
| WO | WO 2006/138638 A1 | 12/2006 |
| WO | WO 2007/003294 A1 | 1/2007 |
| WO | WO 2007/007316 A1 | 1/2007 |
| WO | WO 2007/024783 | 3/2007 |
| WO | WO 2007/026834 A1 | 3/2007 |
| WO | WO 2007/035650 A2 | 3/2007 |
| WO | WO 2007/038788 A2 | 4/2007 |
| WO | WO 2007/039454 A1 | 4/2007 |
| WO | WO 2007/050715 A2 | 5/2007 |
| WO | WO 2007/070389 A2 | 6/2007 |
| WO | WO 2007/071900 A1 | 6/2007 |
| WO | WO 2007/074405 | 7/2007 |
| WO | WO 2007/074405 A2 | 7/2007 |
| WO | WO 2007/077201 A1 | 7/2007 |
| WO | WO 2007/077247 A1 | 7/2007 |
| WO | WO 2007/080126 A2 | 7/2007 |
| WO | WO 2007/080127 A2 | 7/2007 |
| WO | WO 2007/083193 A2 | 7/2007 |
| WO | WO 2007/096576 A1 | 8/2007 |
| WO | WO 2007/051462 A2 | 10/2007 |
| WO | WO 2007/051462 A3 | 10/2007 |
| WO | WO 2007/119434 A1 | 10/2007 |
| WO | WO 2007/134984 A1 | 11/2007 |
| WO | WO 2008/007100 A2 | 1/2008 |
| WO | WO 2008/009908 A1 | 1/2008 |
| WO | WO 2008/029084 A1 | 3/2008 |
| WO | WO 2008/042231 A2 | 4/2008 |
| WO | WO 2008/059948 A1 | 5/2008 |
| WO | WO 2008/063203 A2 | 5/2008 |
| WO | WO 2008/071918 A1 | 6/2008 |
| WO | WO 2008/074991 A1 | 6/2008 |
| WO | WO 2008/084073 A1 | 7/2008 |
| WO | WO 2008/100426 A2 | 8/2008 |
| WO | WO 2008/102908 A1 | 8/2008 |
| WO | WO 2008/148223 A1 | 12/2008 |
| WO | WO 2008/152072 A2 | 12/2008 |
| WO | WO 2008/152073 A2 | 12/2008 |
| WO | WO 2009/000757 A1 | 12/2008 |
| WO | WO 2009/005297 A2 | 1/2009 |
| WO | WO 2009/029690 A1 | 3/2009 |
| WO | WO 2009/035150 A2 | 3/2009 |
| WO | WO 2009/037329 A2 | 3/2009 |
| WO | WO 2009/046384 A1 | 4/2009 |
| WO | WO 2009/063180 A1 | 5/2009 |
| WO | WO 2009/068170 A2 | 6/2009 |
| WO | WO 2009/068171 A2 | 6/2009 |
| WO | WO 2009/086041 A1 | 7/2009 |
| WO | WO 2009/090401 A2 | 7/2009 |
| WO | WO 2009/090402 A2 | 7/2009 |
| WO | WO 2009/115788 A1 | 9/2009 |
| WO | WO 2009/116558 A1 | 9/2009 |
| WO | WO 2009/125401 A2 | 10/2009 |
| WO | WO 2009/144079 | 12/2009 |
| WO | WO 2009/144079 A1 | 12/2009 |
| WO | WO 2009/152995 A1 | 12/2009 |
| WO | WO 2009/158258 A1 | 12/2009 |
| WO | WO 2010/012649 A1 | 2/2010 |
| WO | WO 2010/026989 A1 | 3/2010 |
| WO | WO 2010/034153 A1 | 4/2010 |
| WO | WO 2010/049270 A1 | 5/2010 |
| WO | WO 2010/049369 A1 | 5/2010 |
| WO | WO 2010/049405 A1 | 5/2010 |
| WO | WO 2010/049414 A1 | 5/2010 |
| WO | WO 2010/056519 A1 | 5/2010 |
| WO | WO 2010/063422 A1 | 6/2010 |
| WO | WO 2010/069802 A1 | 6/2010 |
| WO | WO 2010/078906 A2 | 7/2010 |
| WO | WO 2010/078912 A1 | 7/2010 |
| WO | WO 2010/093788 A2 | 8/2010 |
| WO | WO 2010/104217 A1 | 9/2010 |
| WO | WO 2010/108611 A1 | 9/2010 |
| WO | WO 2010/112826 A2 | 10/2010 |
| WO | WO 2010/116122 A2 | 10/2010 |
| WO | WO 2010/119906 A1 | 10/2010 |
| WO | WO 2010/130970 A1 | 11/2010 |
| WO | WO 2011/001434 A1 | 1/2011 |
| WO | WO 2011/003776 A2 | 1/2011 |
| WO | WO 2011/035874 A1 | 3/2011 |
| WO | WO 2011/045796 A1 | 4/2011 |
| WO | WO 2011/065451 A1 | 6/2011 |
| WO | WO 2011/067745 A2 | 6/2011 |
| WO | WO 2011/075188 A1 | 6/2011 |
| WO | WO 2011/080674 A2 | 7/2011 |
| WO | WO 2011/112570 A1 | 9/2011 |
| WO | WO 2011/132127 A1 | 10/2011 |
| WO | WO 2012/001626 A1 | 1/2012 |
| WO | WO 2012/056401 A1 | 5/2012 |
| WO | WO 2012/092580 A2 | 7/2012 |
| WO | WO 2012/164100 A2 | 12/2012 |
| WO | WO 2013/010691 A1 | 1/2013 |
| WO | WO 2013/025670 A1 | 2/2013 |
| WO | WO 2013/039990 A1 | 3/2013 |
| WO | WO 2013/040005 A1 | 3/2013 |
| WO | WO 2013/040021 A1 | 3/2013 |
| WO | WO 2013/040033 A1 | 3/2013 |
| WO | WO 2013/040049 A1 | 3/2013 |
| WO | WO 2013/040057 A1 | 3/2013 |
| WO | WO 2013/040116 A9 | 3/2013 |
| WO | WO 2013/040117 A9 | 3/2013 |
| WO | WO 2013/153553 A2 | 10/2013 |
| WO | WO 2013/175480 A1 | 11/2013 |
| WO | WO 2014/022739 A2 | 2/2014 |
| WO | WO 2014/106837 A2 | 7/2014 |
| WO | WO 2014/106838 A2 | 7/2014 |
| WO | WO 2014/151255 A1 | 9/2014 |
| WO | WO 2014/164761 A1 | 10/2014 |
| WO | WO 2014/164797 A1 | 10/2014 |
| WO | WO 2014/164797 A2 | 10/2014 |
| WO | WO 2015/010026 A2 | 1/2015 |

OTHER PUBLICATIONS

Riggins, Chance W., et al. "Characterization of de novo transcriptome for waterhemp (*Amaranthus tuberculatus*) using GS-FLX 454 pyrosequencing and its application for studies of herbicide target-site genes." Pest management science 66.10 (2010): 1042-1052.*

Small, Ian. "RNAi for revealing and engineering plant gene functions." Current Opinion in Biotechnology 18.2 (2007): 148-153.*

(56) References Cited

OTHER PUBLICATIONS

Zhong, Rong, et al. "A forward genetic screen to explore chloroplast protein import in vivo identifies Moco sulfurase, pivotal for ABA and IAA biosynthesis and purine turnover." The Plant Journal 63.1 (2010): 44-59. (Year: 2010).*
Riggins, Chance W., et al. "Characterization of de novo transcriptome for waterhemp (*Amaranthus tuberculatus*) using GS-FLX 454 pyrosequencing and its application for studies of herbicide target-site genes." Pest management science 66.10 (2010): 1042-1052. (Year: 2010).*
W. Huang, Q. Ling, J. Bedard, K. Lilley, P. Jarvis, in vivo analyses of the roles of essential Onnp85-related proteins in the chloroplast outer envelope membrane, Plant Physiol. 157 (2011) 147-159 (Year: 2011).*
Della-Cioppa, Guy, and Ganesh M. Kishore. "Import of a precursor protein into chloroplasts is inhibited by the herbicide glyphosate." The EMBO journal 7.5 (1988): 1299. (Year: 1988).*
Communication pursuant to Article 94(3) EPC dated Mar. 18, 2016, in European Patent Application No. 12 832 160.1.
Communication pursuant to Article 94(3) EPC dated Mar. 24, 2016, in European Patent Application No. 12 831 684.1.
Communication pursuant to Article 94(3) EPC dated Mar. 4, 2016, in European Patent Application No. 12 830 932.5.
Communication pursuant to Article 94(3) EPC dated Mar. 9, 2016, in European Patent Application No. 12 831 166.9.
Database Accession No. HD315444, "Sequence 192160 from Patent EP2213738," (2010).
Fukunaga et al., "dsRNA with 5' overhangs contributes to endogenous and antiviral RNA silencing pathways in plants," *The EMBO Journal*, 28(5):545-555 (2009).
Knudsen, "Promoter2.0: for the recognition of Poll promoter sequences," *Bioniformatics*, 15(5):356-361 (1999).
Migge et al., "Greenhouse-grown conditionally lethal tobacco plants obtained by expression of plastidic glutamine synthetase antisense RNA may contribute to biological safety," *Plant Science* 153:107-112 (2000).
Office Action dated Apr. 13, 2016, in Chinese Patent Application No. 201280053985.3.
Patent Examination Report No. 1 dated Feb. 8, 2016, in Australian Patent Application No. 2014262189.
Promoter Prediction for SEQ ID No. 1702 from 13/612929/MK/, Promoter 2.0 Prediction Results, pp. 1-4 (2016).
Second Office Action dated Feb. 25, 2016, in Chinese Patent Application No. 201280054179.8.
Second Office Action dated Mar. 4, 2016, in Chinese Patent Application No. 201280054820.8.
Shintani et al., "Antisense Expression and Overexpression of Biotin Carboxylase in Tobacco Leaves," *Plant Physiol.*, 114:881-886 (1997).
Written Opinion dated Apr. 7, 2016, in Singapore Patent Application No. 201206152-9.
Agricultural Chemical Usage 2006 Vegetables Summary, Agricultural Statistics Board, NASS, USDA, pp. 1-372 (2007).
Al-Kaff et al., "Plants rendered herbicide-susceptible by cauliflower mosaic virus-elicited suppression of a 35S promoter-regulated transgene," Nature Biotechnology, 18:995-999 (2000).
Andersen et al., "Delivery of siRNA from lyophilized polymeric surfaces,"Biomaterials, 29:506-512 (2008).
Anonymous, "A handbook for high-level expression and purification of 6xHis-tagged proteins," The QiaExpressionist, (2003).
Artymovich, "Using RNA interference to increase crop yield and decrease pest damage," MMG 445 Basic Biotech., 5(1):7-12 (2009).
Balibrea et al., "Extracellular Invertase is an Essential Component of Cytokinin-Mediated Delay of Senescence," The Plant Cell, 16(5):1276-1287 (2004).
Bart et al., "A novel system for gene silencing using siRNAs in rice leaf and stem-derived protoplasts," Plant Methods, 2(13):1-9 (2006).
Basu et al., "Weed genomics: new tools to understand weed biology," TRENDS in Plant Science, 9(8):391-398 (2004).
Busch et al., "RNAi for discovery of novel crop protection products," Pflanzenschutz-Nachrichten Bayer, 58(1):34-50 (2005).

Chabannes et al., "In situ analysis of lignins in transgenic tobacco reveals a differential impact of individual transformations on the spatial patterns of lignin deposition at the cellular and subcellular levels," The Plant Journal, 28(3):271-282 (2001).
Chen et al., "Transfection and Expression of Plasmid DNA in Plant Cells by an Arginine-Rich Intracellular Delivery Peptide without Protoplast Preparation," FEBS Letters 581, pp. 1891-1897 (2007).
Colliver et al., "Differential modification of flavonoid and isoflavonoid biosynthesis with an antisense chalcone synthase construct in transgenic Lotus corniculatus," Plant Molecular Biology, 35:509-522 (1997).
Communication pursuant to Article 94(3) EPC dated Jun. 26, 2015, in European Patent Application No. 11 753 916.3.
Communication pursuant to Article 94(3) EPC dated Oct. 23, 2015, in European Patent Application No. 12 831 945.6.
Concise Descriptions of Relevance filed by a third party dated Nov. 29, 2012, in U.S. Appl. No. 13/042,856.
Dalakouras et al., "Induction of Silencing in Plants by High-Pressure Spraying of in vitro-Synthesized Small RNAs," Frontiers in Plant Science, 7(1327):1-5 (2016).
Dawson et al., "cDNA cloning of the complete genome of tobacco mosaic virus and production of infectious transcripts," Proc. Natl. Acad. Sci. USA, 83:1832-1836 (1986).
Extended European Search Report dated Oct. 8, 2013, in European Patent Application No. 11753916.3.
Extended European Search Report dated Sep. 29, 2016, in European Patent Application No. 14778840.0.
Feuillet et al., "Crop genome sequencing: lessons and rationales," Trends Plant Sci., 16:77-88 (2011).
Final Office Action dated Apr. 7, 2016, in U.S. Appl. No. 13/619,980.
Final Office Action dated Dec. 17, 2015, in U.S. Appl. No. 14/335,135.
Final Office Action dated Feb. 17, 2016, in U.S. Appl. No. 13/612,929.
Final Office Action dated Feb. 4, 2016, in U.S. Appl. No. 13/612,936.
Final Office Action dated Jun. 30, 2016, in U.S. Appl. No. 13/901,326.
Final Office Action dated Mar. 2, 2016, in U.S. Appl. No. 13/612,995.
Final Office Action dated Mar. 21, 2016, in U.S. Appl. No. 13/612,925.
Final Office Action dated May 26, 2016, in U.S. Appl. No. 14/532,596.
Final Office Action dated Sep. 9, 2016, in U.S. Appl. No. 13/612,954.
Final Office Action dated Nov. 19, 2015, in U.S. Appl. No. 13/612,941.
Final Office Action dated Nov. 10, 2016, in U.S. Appl. No. 13/583,302.
Final Office Action dated Sep. 9, 2016, in U.S. Appl. No. 14/608,951.
Final Office Action dated Sep. 9, 2016, in U.S. Appl. No. 14/603,347.
Final Office Action dated Oct. 20, 2016, in U.S. Appl. No. 14/480,199.
Final Office Action dated Oct. 22, 2015, in U.S. Appl. No. 14/608,951.
First Examination Report dated Apr. 23, 2013, in New Zealand Patent Application No. 601784.
First Examination Report dated Jul. 28, 2014, in New Zealand Patent Application No. 627060.
First Office Action dated Aug. 31, 2015, in Chinese Patent Application No. 201280053985.3.
First Office Action dated Jul. 7, 2015, in Chinese Patent Application No. 201280054820.8.
First Office Action dated Mar. 12, 2015, in Chinese Patent Application No. 201280053984.9.
First Office Action dated Mar. 2, 2015, in Chinese Patent Application No. 201280054819.5.
First Office Action dated May 27, 2015, in Chinese Patent Application No. 201280054179.8.
First Office Action dated Sep. 9, 2015, in Chinese Patent Application No. 201280055409.2.
Fraley et al., "Liposome-mediated delivery of tobacco mosaic virus RNA into tobacco protoplasts: A sensitive assay for monitoring liposome-protoplast interactions," Proc Natl Acad Sci U S A., 79(6):1859-1863 (1982).
Fukunaga et al., "dsRNA with 5' overhangs v contributes to endogenous and antiviral RNA silencing pathways in plants," The EMBO Journal, 28(5):545-555 (2009).
Further Examination Report dated May 16, 2014, in New Zealand Patent Application No. 601784.
Gan et al., "Inhibition of Leaf Senescence by Autoregulated Production of Cytokinin," Science, 270:1986-1988 (1995).
Gao et al., "Nonviral Methods for siRNA Delivery," Molecular Pharmaceutics, 6(3):651-658 (2008).

(56) References Cited

OTHER PUBLICATIONS

GenBank Accession No. AY545657.1 (2004).
GenBank Accession No. CB377464, "CmaE1_37 J02_T3 Cowpea weevil larvae Lambda Zap Express Library Callosobruchus maculatus cDNA, mRNA sequence," (2007).
GenBank Accession No. DY640489, "PU2_plate27_F03 PU2 Prunus persica cDNA similar to expressed mRNA inferred from Prunus persica hypothetical domain/motif cont aining IPR011005:Dihydropteroate synthase-like, MRNA sequence" (2006).
GenBank Accession No. EU024568, "Amaranthus hypochondriacus acetolactate synthase (ALS) gene" (2007).
GenBank Accession No. EW765249, "ST020010B10C12 Normalized and subtracted western corn rootworm female head cDNA library Diabrotica virgifera virgifera cDNA clone STO20010B10C12 5-, mRNA sequence," (2007).
GenBank Accession No. EW771198, "ST020010B10C12 Normalized and subtracted western corn rootworm female head cDNA library Diabrotica virgifera virgifera cDNA clone STO20010B10C12 5-, mRNA sequence," (2007).
GenBank Accession No. FE348695, "CBIB7954.fwd CBIB_Daphnia_pulex_ChosenOneLibrary_2 Daphnia pulex cDNA clone CBIB7954 5', mRNA sequence" (2011).
GenBank Accession No. FJ972198, "Solanum lycopersicum cultivar Ailsa Craig dihydropterin pyrophosphokinase-dihydropteroate synthase (HPPK-DHPS) gene, complete cds" (2010).
GenBank Accession No. GI:186478573 (2014).
GenBank Accession No. GU120406, "Chiysomela tremulae ribosomal protein L7 (RpL7) mRNA, complete cds" (2009).
GenBank Accession No. HD315444, "Sequence 192160 from Patent EP2213738" (2010).
GenBank Accession No. Q4GXM3_BIPLU, "Ribosomal protein L7e" (2006).
GenBank Accession No. U87257.1, "Daucus carota 4-hydroxyphenylpyruvate dioxygenase mRNA, complete cds" (1997).
GenBank Accession No. XM_ 014456745.1, Predicted: Myotis lucifugus ribonucleoprotein, PTB-binding 2 (RAVER2), transcript variant X3, mRNA,: (2015).
GenBank Accession No. Y08611.1, "P.sativum mRNA for dihydropterin pyrophosphokinase/dihydropteroate synthase" (2006).
GenEmbl Accession No. FJ861243 (2010).
Gossamer Threads, Compendium of Herbicide Adjuvants: Organo-Silicone Surfactant, p. 1-4 (1998).
Gudkov, "Minireview: The L7/L12 ribosomal domain of the ribosome: structural and functional studies," FEBS Letters, 407:253-256 (1997).
Hajirezaei et al., "Impact of elevated cytosolic and apoplastic invertase activity on carbon metabolism during potato tuber development," Journal of Experimental Botany, 51:439-445 (2000).
Heffer et al., "Rapid isolation of gene homologs across taxa: Efficient identification and isolation of gene orthologs from non-model organism genomes, a technical report," EvoDevo Journal, 2(7):1-5 (2011).
Holtra et al., "Assessment of the Physiological Condition of Salvinia Natans L. Exposed to Copper(II) Ions," Environ. Protect. Eng., 41:147-158 (2015).
International Preliminary Report on Patentability dated Sep. 11, 2012, in International Application No. PCT/US2011/027528.
International Preliminary Report on Patentability dated Sep. 11, 2014, in International Application No. PCT/IL2013/050447.
International Rice Genome Sequencing Project, The map-based sequence of the rice genome, Nature, 436(11):793-800 (2005).
International Search Report and the Written Opinion dated Feb. 25, 2013, in International Application No. PCT/US2012/054883.
International Search Report and the Written Opinion dated Feb. 27, 2013, in International Application No. PCT/US2012/054814.
International Search Report and the Written Opinion dated Feb. 27, 2013, in International Application No. PCT/US2012/054842.
International Search Report and the Written Opinion dated Feb. 27, 2013, in International Application No. PCT/US2012/054862.
International Search Report and the Written Opinion dated Feb. 27, 2013, in International Application No. PCT/US2012/054894.
International Search Report and the Written Opinion dated Feb. 27, 2013, in International Application No. PCT/US2012/054974.
International Search Report and the Written Opinion dated Feb. 27, 2013, in International Application No. PCT/US2012/054980.
International Search Report and the Written Opinion dated Jul. 22 2014, in International Application No. PCT/IL2013/051083.
International Search Report and the Written Opinion dated Jul. 22 2014, in International Application No. PCT/IL2013/051085.
International Search Report and the Written Opinion dated Jul. 24 2014, in International Application No. PCT/US2014/026036.
International Search Report and the Written Opinion dated May 10, 2011, in International Application No. PCT/US2011/027528.
International Search Report and the Written Opinion dated Oct. 1, 2013, in International Application No. PCT/IL2013/050447.
International Search Report and Written Opinion dated Aug. 25, 2014, in International Application No. PCT/US2014/023503.
International Search Report and Written Opinion dated Aug. 27, 2014, in International Application No. PCT/US2014/023409.
International Search Report and Written Opinion dated Feb. 23, 2015, in International Application No. PCT/US2014/063832.
International Search Report dated Mar. 12, 2013, in International Application No. PCT/US2012/054789.
Jin et al., "Posttranslational Elevation of Cell Wall Invertase Activity by Silencing its Inhibitor in Tomato Delays Leaf Senescence and Increases Seed Weight and Fruit Hexose Level," The Plant Cell, 21:2072-2089 (2009).
Kaloumenos et al., "Identification of a Johnsongrass (*Sorghum halepense*) Biotype Resistant to ACCase-Inhibiting Herbicides in Northern Greece," Weed Technol, 23:470-476 (2009).
Kambiranda et al., "Relationship Between Acid Invertase Activity and Sugar Content in Grape Species," Journal of Food Biochemistry, 35:1646-1652 (2011).
Kim et al., "Optimization of Conditions for Transient Agrobacterium-Mediated Gene Expression Assays in *Arabidopsis*," Plant Cell Reports, 28:1159-1167 (2009).
Kirkwood, "Herbicides and Plants," Botanical Journal of Scotland, 46(3):447-462 (1993).
Liu et al., "Identification and Application of a Rice Senescence-Associated Promoter," Plant Physiology, 153:1239-1249 (2010).
Liu, "Influence of Sugars on the Foliar Uptake of Bentazone and Glyphosate," New Zealand Plant Protection, 55:159-162 (2002).
Luque et al., "Water Permeability of Isolated Cuticular Membranes: A Structural Analysis," Archives of Biochemistry and Biophysics, 317(2):417-422 (1995).
Mora et al., "How Many Species Are There on Earth and in the Ocean?," PLOS Biol., 9(8):e100127, p. 1-8 (2011).
Mount et al., "Gene and Metabolite Regulatory Network Analysis of Early Developing Fruit Tissues Highlights New Candidate Genes for the Control of Tomato Fruit Composition and Development," Plant Physiology, 149:1505-1528 (2009).
Non-Final Office Action dated Aug. 19, 2016, in U.S. Appl. No. 13/612,925.
Non-Final Office Action dated Aug. 19, 2016, in U.S. Appl. No. 13/612,929.
Non-Final Office Action dated Apr. 29, 2016, in U.S. Appl. No. 13/583,302.
Non-Final Office Action dated Aug. 10, 2016, in U.S. Appl. No. 13/612,995.
Non-Final Office Action dated Nov. 9, 2016, in U.S. Appl. No. 14/901,003.
Non-Final Office Action dated Aug. 3, 2016, in U.S. Appl. No. 14/015,715.
Non-Final Office Action dated Aug. 5, 2016, in U.S. Appl. No. 14/015,785.
Non-Final Office Action dated Aug. 8, 2016, in U.S. Appl. No. 13/612,936.
Non-Final Office Action dated Dec. 17, 2015, in U.S. Appl. No. 14/532,596.
Non-Final Office Action dated Feb. 10, 2016, in U.S. Appl. No. 13/901,326.

(56) References Cited

OTHER PUBLICATIONS

Non-Final Office Action dated Feb. 23, 2016, in U.S. Appl. No. 14/608,951.
Non-Final Office Action dated Sep. 6, 2016, in U.S. Appl. No. 14/335,135.
Non-Final Office Action dated Mar. 1, 2016, in U.S. Appl. No. 13/612,954.
Non-Final Office Action dated Oct. 3, 2016, in U.S. Appl. No. 14/403,491.
Non-Final Office Action dated Sep. 1, 2015, in U.S. Appl. No. 13/612,954.
Non-Final Office Action dated Sep. 11, 2015, in U.S. Appl. No. 13/612,925.
Non-Final Office Action dated Sep. 4, 2015, in U.S. Appl. No. 13/612,995.
Nookaraju et al., "Molecular approaches for enhancing sweetness in fruits and vegetables," Scientia Horticulture, 127:1-15 (2010).
Notice of Allowance dated Apr. 11, 2016, in U.S. Appl. No. 13/612,985.
Notice of Allowance dated Apr. 19, 2016, in U.S. Appl. No. 13/612,941.
Notice of Allowance dated Apr. 20, 2016, in U.S. Appl. No. 13/612,948.
Notice of Allowance dated Feb. 23, 2015, in U.S. Appl. No. 13/042,856.
Notice of Allowance dated Jun. 2, 2015, in U.S. Appl. No. 13/042,856.
Office Action dated Aug. 28, 2013, in Chinese Patent Application No. 201180012795.2.
Office Action dated Jul. 18, 2016, in Indonesian Patent Application No. W00201203610.
Office Action dated Sep. 5, 2016, in Ukrainian Patent Application No. a 2014 03846.
Office Action dated Feb. 24, 2014, in Eurasian Patent Application No. 201201264.
Office Action dated Jun. 20, 2016, in Chinese Patent Application No. 201280054819.5.
Office Action dated Jun. 24, 2016, in Chinese Patent Application No. 201280053984.9.
Office Action dated Nov. 3, 2014, in Chinese Patent Application No. 201180012795.2.
Patent Examination Report No. 1 dated Jun. 17, 2016, in Australian Patent Application No. 2012308659.
Patent Examination Report No. 1 dated Jun. 17, 2016, in Australian Patent Application No. 2012308660.
Patent Examination Report No. 1 dated Nov. 11, 2013, in Australian Patent Application No. 2011224570.
Promoter Prediction for SEQ ID No. 4 from 13/612995/MK/, Promoter 2.0 Prediction Results, pp. 1-3 (2016).
Promoter Prediction for SEQ ID No. 7 from 13/612936/MK/, Promoter 2.0 Prediction Results, pp. 1-2 (2016).
Promoter Prediction for SEQ ID No. 8 from 13/612,925/MK/, Promoter 2.0 Prediction Results, pp. 1-6 (2016).
Restriction Requirement dated Jul. 15, 2016, in U.S. Appl. No. 14/143,748.
Restriction Requirement dated Jul. 18, 2016, in U.S. Appl. No. 14/143,836.
Restriction Requirement dated Oct. 13, 2016, in U.S. Appl. No. 14/206,707.
Restriction Requirement dated Oct. 28, 2015, in U.S. Appl. No. 14/603,347.
Restriction Requirement dated Sep. 2, 2015, in U.S. Appl. No. 14/532,596.
Roberts, "Fast-track applications: The potential for direct delivery of proteins and nucleic acids to plant cells for the discovery of gene function," Plant Methods, 1(12):1-3 (2005).
Robson et al., "Leaf senescence is delayed in maize expressing the Agrobacterium IPT gene under the control of a novel maize senescence-enhanced promoter," Plant Biotechnology Journal, 2:101-112 (2004).
Roitsch et al., "Extracellular invertase: key metabolic enzyme and PR protein," Journal of Experimental Botany, 54(382):513-524 (2003).
Roitsch et al., "Function and regulation of plant invertases: sweet sensations," Trades in Plant Science, 9(12):606-613 (2004).
Ruan et al., "Suppression of Sucrose Synthase Gene Expression Represses Cotton Fiber Cell Initiation, Elongation, and Seed Development," The Plant Cell, 15:952-964 (2003).
Schönherr, "Water Permeability of Isolated Cuticular Membranes: The Effect of pH and Cations on Diffusion, Hydrodynamic Permeability and Size of Polar Pores in the Cutin Matrix," Planta, 128:113-126 (1976).
Scott et al., Botanical Insecticides for Controlling Agricultural Pests: Piperamides and the Colorado Potato Beetle *Leptinotarsa decemlineata* Say (Coleoptera: Chiysomelidae), Archives of Insect Biochemistry and Physiology, 54:212-225 (2003).
Second Chinese Office Action dated Jun. 10, 2014, in Chinese Patent Application No. 201180012795.2.
Showalter, "Structure and Function of Plant Cell Wall Proteins," The Plant Cell, 5:9-23 (1993).
Song et al., "Herbicide," New Heterocyclic Pesticide, Chemical Industry Press, 354-356 (2011).
Tang et al., "Efficient delivery of small interfering RNA to plant cells by a nanosecond pulsed laser-induced stress wave for post-transcriptional gene silencing," Plant Science, 171:375-381 (2006).
Temple et al., "Can glutamine synthetase activity levels be modulated in transgenic plants by the use of recombinant DNA technology?" Transgenic Plants and Plant Biochemistry, 22(4):915-920 (1994).
Tenllado et al., "Double-Stranded RNA-Mediated Interference with Plant Virus Infection," Journal of Virology, 75(24):12288-12297 (2001).
Thomas et al., "Size constraints for targeting post-transcriptional gene silencing and for RNA-directed methylation in Nicotiana benthamiana using a potato virus X vector," The Plant Journal, 25(4):417-425 (2001).
Tomlinson et al., "Evidence that the hexose-to-sucrose ratio does not control the switch to storage product accumulation in oilseeds: analysis of tobacco seed development and effects of overexpressing apoplastic invertase," Journal of Experimental Botany.
Unniraman et al., "Conserved Economics of Transcription Termination in Eubacteria," Nucleic Acids Research, 30(3):675-684 (2002).
Voinnet et al., "Systemic Spread of Sequence-Specific Transgene RNA Degradation in Plants Is Initiated by Localized Introduction of Ectopic Promoterless DNA," Cell, 95:177-187 (1998).
Widholm et al., "Glyphosate selection of gene amplification in suspension cultures of 3 plant species," Phyisologia Plantarum, 112:540-545 (2001).
Wiesman et al., "Novel cationic vesicle platform derived from vernonia oil for efficient delivery of DNA through plant cuticle membranes," Journal of Biotechnology, 130:85-94 (2007).
Wild Carrot, Noxious Weed Control Board (NWCB) of Washington State (2010).
Zhang et al., "Chapter 10: New Characteristics of Pesticide Research & Development," New Progress of the world agriculture chemicals, p. 209 (2010).
Alarcón-Reverte et al., "Resistance to ACCase-inhibiting herbicides in the weed *Lolium multiflorum,*" Comm. Appl. Biol. Sci., 73(4):899-902 (2008).
Amarzguioui et al., "An algorithm for selection of functional siRNA sequences," Biochemical and Biophysical Research Communications, 316:1050-1058 (2004).
Ambrus et al., "The Diverse Roles of RNA Helicases in RNAi," *Cell Cycle*, 8(21):3500-3505 (2009).
An et al., "Transient RNAi Induction against Endogenous Genes in *Arabidopsis* Protoplasts Using in Vitro-Prepared Double-Stranded RNA," Biosci Biotechnol Biochem, 69(2):415-418 (2005).
Andersson et al., "A novel selection system for potato transformation using a mutated AHAS gene," Plant Cell Reports, 22(4):261-267 (2003).
Anonymous, "A handbook for high-level expression and purification of 6xHis-tagged proteins," *The QUIexpressionist*, (2003).

(56) References Cited

OTHER PUBLICATIONS

Anonymous, "Agronomy Facts 37: Adjuvants for enhancing herbicide performance," n.p., 1-8, (Jan. 26, 2000), Web, (Jan. 21, 2014).
Anonymous, "Devgen, The mini-Monsanto," KBC Securities (2006).
Anonymous, "Do Monsanto have the next big thing?," *Austalian Herbicide Resistance Initiative (AHRI)*, (Apr. 23, 2013) Web. (Jan. 19, 2015).
Aoki et al., "In Vivo Transfer Efficiency of Antisense Oligonucleotides into the Myocardium Using HVJ-Liposome Method," *Biochem Biophys Res Commun*, 231:540-545 (1997).
Arpaia et al., "Production of transgenic eggplant (*Solanum melongena* L.) resistant to Colorado Potato Beetle (*Leptinotarsa decemlineata* Say)," (1997) *Theor. Appl. Genet.*, 95:329-334 (1997).
Artmymovich, "Using RNA interference to increase crop yield and decrease pest damage," *MMG 445 Basic Biotech.*, 5(1):7-12 (2009).
Australian Patent Examination report No. 1 dated Nov. 11, 2013, in Australian Application No. 2011224570.
Axtell et al., "A Two-Hit Trigger for siRNA Biogenesis in Plants," *Cell*, 127:565-577 (2006).
Baerson et al., "Glyphosate-Resistant Goosegrass. Identification of a Mutation in the Target Enzyme 5-Enolpyruvylshikimate-3-Phosphate Synthase," *Plant Physiol.*, 129(3):1265-1275 (2002).
Bannerjee et al., "Efficient production of transgenic potato (*S. tuberosum* L. ssp. *andigena*) plants via *Agrobacterium tumefaciens*-mediated transformation," *Plant Sci.*, 170:732 738 (2006).
Baulcombe, "RNA silencing and heritable epigenetic effects in tomato and *Arabidopsis*," Abstract 13$^{th}$ Annual Fall Symposium, Plant Genomes to Phenomes, Donald Danforth Plant Science Center, 28-30 (2011).
Bayer et al., "Programmable ligand-controlled riboregulators of eukaryotic gene expression," *Nature Biotechnol.*, 23(3):337-343 (2005).
Beal, et al., "Second Structural Motif for Recognition of DNA by Oligonucleotide-Directed Triple-Helix Formation," *Science*, 251:1360-1363 (1992).
Becker et al., "Fertile transgenic wheat from microprojectile bombardment of scutellar tissue," *The Plant Journal*, 5(2):299-307 (1994).
Bhargava et al., "Long double-stranded RNA-mediated RNA interference as a tool to achieve site-specific silencing of hypothalamic neuropeptides," *Brain Research Protocols*, 13:115-125 (2004).
Boletta et al., "High Efficient Non-Viral Gene Delivery to the Rat Kidney by Novel Polycationic Vectors," *J. Am Soc. Nephrol.*, 7:1728 (1996).
Bolognesi et al., "Characterizing the Mechanism of Action of Double-Stranded Rna Activity against Western Corn Rootworm (*Diabrotica virgifera virgifera* LeConte)," PLoS ONE 7(10):e47534 (2012).
Bolter et al., "A chloroplastic inner envelope membrane protease is essential for plant development," *FEBS Letters*, 580:789-794 (2006).
Breaker et al., "A DNA enzyme with Mg2$^{+}$-dependent RNA phosphoesterase activity," *Chemistry and Biology*, 2:655-660 (1995).
Brodersen et al., "The diversity of RNA silencing pathways in plants," *Trends in Genetics*, 22(5):268-280 (2006).
Busi et al., "Gene flow increases the initial frequency of herbicide resistance alleles in unselectedpopulations," *Agriculture, Ecosystems and Environments*, Elsevier, Amsterdam, NL, 142(3):403-409 (2011).
Butler et al., "Priming and re-drying improve the survival of mature seeds of *Digitalis purpurea* during storage," *Annals of Botany*, 103:1261-1270 (2009).
Bytebier et al., "T-DNA organization in tumor cultures and transgenic plants of the monocotyledon *Asparagus officinalis*," *Proc. Natl. Acad. Sci. U.S.A.*, 84:5345-5349 (1987).
Chabbouh et al., "Cucumber mosaic virus in artichoke," *FAO Plant Protection Bulletin*, 38:52-53 (1990).
Chakravarty et al., "Genetic Transformation in Potato: Approaches and Strategies," *Amer J Potato Res*, 84:301 311 (2007).

Chee et al., "Transformation of Soybean (*Glycine max*) by Infecting Germinating Seeds with *Agrobacterium tumefaciens*," *Plant Physiol.*, 91:1212-1218 (1989).
Chen et al., "In Vivo Analysis of the Role of atTic20 in Protein Import into Chloroplasts," *The Plant Cell*, 14:641-654 (2002).
Cheng et al., "Production of fertile transgenic peanut (*Arachis hypogaea* L.) plants using *Agrobacterium tumefaciens*," *Plant Cell Reports*, 15:653-657 (1996).
Chi et al., "The Function of RH22, a DEAD RNA Helicase, in the Biogenesis of the 50S Ribosomal Subunits of *Arabidopsis* Chloroplasts," *Plant Physiology*, 158:693-707 (2012).
Chinese Office Action dated Aug. 28, 2013 in Chinese Application No. 201180012795.2.
Clough et al., "Floral dip: a simplified method for Agrobacterium-mediated transformation of *Arabidopsis thaliana*," *The Plant Journal*, 16(6):735-743 (1998).
CN101914540 Patent Diclosure, "Introduction of RNA into plant by interference," (2010).
Colbourne et al., "The Ecoresponsive Genome of Daphnia pulex," *Science*, 331(6017):555-561 (2011).
Colombian Office Action dated Aug. 2, 2013 in Application No. 12 152898.
Colombian Office Action dated Feb. 21, 2014 in Application No. 12 152898.
Cooney et al., "Site-Specific Oligonucleotide Binding Represses Transcription of the Human c-myc Gene in Vitro," *Science*, 241:456-459 (1988).
Cost Action FA0806 progress report "Plant virus control employing RNA-based vaccines: A novel non-transgenic strategy" (2010).
Coticchia et al., "Calmodulin modulates Akt activity in human breast cancer cell lines," *Breast Cancer Res. Treat*, 115:545-560 (2009).
Dalmay et al., "An RNA-Depenedent RNA Polymerase Gene in *Arabidopsis* Is Required for Posttranscriptional Gene Silencing Mediated by a Transgene but Not by a Virus," *Cell*, 101:543-553 (2000).
Database EMBL CBIB Daphnia—XP-002732239 (2011).
Davidson et al., "Engineering regulatory RNAs," *TRENDS in Biotechnology*, 23(3):109-112 (2005).
De Block, et al. "Engineering herbicide resistance in plants by expression of a detoxifying enzyme," *EMBO J.* 6(9):2513-2519 (1987).
De Framond, "MINI-Ti: A New Vector Strategy for Plant Genetic Engineering," *Nature Biotechnology*, 1:262-269 (1983).
Della-Cioppa et al., "Import of a precursor protein into chloroplasts is inhibited by the herbicide glyphosate," *The EMBO Journal*, 7(5):1299-1305 (1988).
Diallo et al., "Long Endogenous dsRNAs Can Induce Complete Gene Silencing in Mammalian Cells and Primary Cultures," *Oligonucleotides*, 13:381-392 (2003).
Dietemann et al.,"*Varroa destructor*: research avenues towards sustainable control," *Journal of Apicultural Research*, 51(1):125-132 (2012).
Du et al., "A systematic analysis of the silencing effects of an active siRNA at all single-nucleotide mismatched target sites," *Nucleic Acids Research*, 33(5):1671-1677 (2005).
Dunoyer et al., "Small RNA Duplexes Function as Mobile Silencing Signals Between Plant Cells," *Science*, 328:912-916 (2010).
Ellington et al., "In vitro selection of RNA molecules that bind specific ligands," *Nature*, 346:818-822 (1990).
Eurasian Office Action dated Feb. 24, 2014, in Application No. 201201264.
European Cooperation in the field of Scientific and Technical Research—Memorandum of Understanding for COST Action FA0806 (2008).
European Supplemental Search Report dated Oct. 8, 2013 in Application No. 11753916.3.
Extended European Search Report dated Jan. 21, 2015, in European Patent Application No. 12 832 415.9.
Extended European Search Report dated Jan. 29, 2015, in European Patent Application No. 12 831 567.8.
Extended European Search Report dated Feb. 2, 2015, in European Patent Application No. 12 830 932.5.

(56) References Cited

OTHER PUBLICATIONS

Extended European Search Report dated Feb. 3, 2015, in European Patent Application No. 12 831 945.6.
Extended European Search Report dated Feb. 27, 2015, in European Patent Application No. 12 832 160.1.
Extended European Search Report dated Mar. 3, 2015, in European Patent Application No. 12 831 166.9.
Extended European Search Report dated Mar. 17, 2015, in European Patent Application No. 12 831 684.1.
Farooq et al., "Rice seed priming," *IPRN*, 30(2):45-48 (2005).
Fire et al., "Potent and specific genetic interference by double-stranded RNA in *Caenorhabditis elegans*," *Nature*, 391:806-811 (1998).
Fukuhara et al., "Enigmatic Double-Stranded RNA in Japonica Rice," *Plant Molecular Biology*, 21:1121-1130 (1993).
Fukuhara et al., "The Unusual Structure of a Novel RNA Replicon in Rice," *The Journal of Biological Chemistry*, 270(30):18147-18149 (1995).
Fukuhara et al., "The wide distribution of endornaviruses, large double-stranded RNA replicons with plasmid-like properties," *Archives of Virology*, 151:995-1002 (2006).
Further Examination Report issued in New Zealand Patent Application No. 601784 dated May 16, 2014.
Gaines et al., "Gene amplification confers glyphosate resistance in *Amaranthus Palmeri*," *Proc. Natl. Acad. Sci. USA*, 107(3):1029-1034 (2010).
Gan et al., "Bacterially expressed dsRNA protects maize against SCMV infection," *Plant Cell Rep*, 11:1261-1268 (2010).
Gao et al., "Down-regulation of acetolactate synthase compromises 01-1-mediated resistance to powdery mildew in tomato," *BMC Plant Biology*, 14 (2014).
Garbian et al., "Bidirectional Transfer of RNAi between Honey Bee and *Varroa destructor: Varroa* Gene Silencing Reduces *Varroa* Population," 8(12):1-9:e1003035 (2012).
Ge et al., "Rapid vacuolar sequestration: the horseweed glyphosate resistance mechanism," *Pest Management Sci.*, 66:345-348 (2010).
GenBank Accession No. DY640489, PU2_plate27J03 PU2 Prunus persica cDNA similar to expressed mRNA inferred from Prunus persica hypothetical domain/motif containing IPR011005:Dihydropteroate synthase-like, MRNA sequence (2006) [Retrieved on Feb. 4, 2013]. Retrieved from the internet <URL: http://www.ncbi.nlm.nih.gov/nucest/DY640489>.
GenBank Accession No. EU24568—"Amaranthus hypochondriacus acetolactate synthase (ALS) gene," (2007).
GenBank Accession No. FJ972198, Solanum lycopersicum cultivar Ailsa Craig dihydropterin pyrophosphokinase-dihydropteroate synthase (HPPK-DHPS) gene, complete cds (2010) [Retrieved on Nov. 26, 2012]. Retrieved from the internet ,URL: http://www.ncbi.nlm.nih.gov/nuccore/FJ972198>.
GenBank accession No. AY545657.1, published 2004.
GenBank accession No. GI:186478573, published Jan. 22, 2014.
GenEmbl FJ861243, published Feb. 3, 2010.
Gong et al., "Silencing of Rieske iron-sulfur protein using chemically synthesised siRNA as a potential biopesticide against Plutella xylostella," *Pest Manag Sci*, 67:514-520 (2011).
Gressel et al., "A strategy to provide long-term control of weedy rice while mitigating herbicide resistance transgene flow, and its potential use for other crops with related weeds," *Pest Manag Sci*, 65(7):723-731 (2009).
Gutensohn et al., "Functional analysis of the two *Arabidopsis* homologues of Toc34, a component of the chloroplast protein import apparatus," *The Plant Journal*, 23(6):771-783 (2000).
Haigh, "The Priming of Seeds: Investigation into a method of priming large quantities of seeds using salt solutions," Thesis submitted to Macquarie University (1983).
Hamilton et al., "Guidelines for the Identification and Characterization of Plant Viruses," *J. gen. Virol.*, 54:223-241 (1981).
Hamilton et al., "Two classes of short interfering RNA in RNA silencing," *EMBO J.*, 21(17):4671-4679 (2002).
Han et al., "Molecular Basis for the Recognition of Primary microRNAs by the Drosha-DGCR8 Complex," *Cell*, 125(5):887-901 (2006).
Hannon, "RNA interference," *Nature*,481:244-251 (2002).
Hardegree, "Drying and storage effects on germination of primed grass seeds," *Journal of Range Management*, 47(3):196-199 (1994).
Harrison et al., "Does Lowering Glutamine Synthetase Activity in Nodules Modigy Nitrogen Metabolism and Growth of *Lotus japonicus?*," *Plant Physiology*, 133:253-262 (2003).
Herman et al., "A three-component dicamba O-demethylase from *Pseudomonas maltophilia*, strain DI-6: gene isolation, characterization, and heterologous expression," *J. Biol. Chem.*, 280: 24759-24767 (2005).
Hewezi et al., "Local infiltration of high- and low-molecular-weight RNA from silenced sunflower (*Helianthus annuus* L.) plants triggers post-transcriptional gene silencing in non-silenced plants," *Plant Biotechnology Journal*, 3:81-89 (2005).
Hidayat et al., "Enhanced Metabolism of Fluazifop Acid in a Biotype of *Digitaria sanguinalis* Resistant to the Herbicide Fluazifop-P-Butyl," *Pesticide Biochem. Physiol.*, 57:137-146 (1997).
Himber et al., "Transitivity-dependant and -independent cell-to-cell movement of RNA silencing," *The EMBO Journal*, 22(17):4523-4533 (2003).
Hirschberg et al., "Molecular Basis of Herbicide Resistance in *Amaranthus hybridus*," *Science*, 222:1346-1349 (1983).
Hoekema et al., "A binary plant vector strategy based on separation of vir- and T-region of the *Agrobacterium tumefaciens* Ti-plasmid," *Nature*, 303:179-180 (1983).
Hofgen et al., "Repression of Acetolactate Synthase Activity through Antisense Inhibition: Molecular and Biochemical Analysis of Transgenic Potato (*Solanum tuberosum* L. cv Desiree) Plants," *Plant Physiol.*, 107(2):469-477 (1995).
Hsieh et al., "A library of siRNA duplexes targeting the phosphoinositide 3-kinase pathway: determinants of gene silencing for use in cell-based screens," *Nucleic Acids Res.*, 32(3):893-901 (2004).
Huesken et al., "Design of a genome-wide siRNA library using an artificial neural network," . Herewith.
Hunter et al., "RNA Interference Strategy to suppress Psyllids & Leafhoppers," *International Plant and Animal Genome XIX*, 15-19 (2011).
Ichihara et al., "Thermodynamic instability of siRNA duplex is a prerequisite for dependable prediction of siRNA activities," Nucleic Acids Res., 35(18):e123 (2007).
International Preliminary Report on Patentability dated Sep. 11, 2014, in International Application No. PCT/IL13/50447.
International Search Report and the Written Opinion dated May 10, 2011.
International Search Report and the Written Opinion dated Feb. 25, 2013, in International Application No. PCT/US 12/54883.
International Search Report and the Written Opinion dated Feb. 27, 2013, in International Application No. PCT/US 12/54814.
International Search Report and the Written Opinion dated Feb. 27, 2013, in International Application No. PCT/US 12/54842.
International Search Report and the Written Opinion dated Feb. 27, 2013, in International Application No. PCT/US 12/54862.
International Search Report and the Written Opinion dated Feb. 27, 2013, in International Application No. PCT/US 12/54894.
International Search Report and the Written Opinion dated Feb. 27, 2013, in International Application No. PCT/US 12/54974.
International Search Report and the Written Opinion dated Feb. 27, 2013, in International Application No. PCT/US 12/54980.
International Search Report dated Mar. 12, 2013, in International Application No. PCT/US 12/54789.
Invitation to Pay Additional Fees dated May 6, 2014, in International Application No. PCT/IL2013/051083.
Invitation to Pay Additional Fees dated May 6, 2014, in International Application No. PCT/IL2013/051085.
Invitation to Pay Additional Fees dated Nov. 25, 2014, in International Application No. PCT/US2014/047204.
Isaacs et al., "Engineered riboregulators enable post-transcriptional control of gene expression," *Nature Biotechnology*, 22(7):841-847 (2004).

(56) References Cited

OTHER PUBLICATIONS

Ji et al., "Regulation of small RNA stability: methylation and beyond," *Cell Research*, 22:624-636 (2012).
Jones-Rhoades et al., "MicroRNAs and Their Regulatory Roles in Plants," *Annu. Rev. Plant Biol.*, 57:19-53 (2006).
Josse et al., "A DELLA in Disguise: SPATULA Restrains the Growth of the Developing *Arabidopsis* Seedling," *Plant Cell*, 23:1337-1351 (2011).
Kam et al., "Nanotube Molecular Transporters: Internalization of Carbon Nanotube-Protein Conjugates into Mammalian Cells," *J. Am. Chem. Soc.*, 126(22):6850-6851 (2004).
Katoh et al., "Specific residues at every third position of siRNA shape its efficient RNAi activity," *Nucleic Acids Res.*, 35(4): e27 (2007).
Kertbundit et al., "In vivo random β-glucuronidase gene fusions in *Arabidopsis thaliana*," *Proc. Natl. Acad. Sci. USA.*, 88:5212-5216 (1991).
Khachigian, "DNAzymes: Cutting a path to a new class of therapeutics," *Curr Opin Mol Ther* 4(2):119-121 (2002).
Khodakovskaya et al., "Carbon Nanotubes Are Able to Penetrate Plant Seed Coat and Dramatically Affect Seed Germination and Plant Growth," *ACS Nano*, 3(10):3221-3227 (2009).
Kirkwood, "Use and Mode of Action of Adjuvants for Herbicides: A Review of some Current Work," *Pestic Sci.*, 38:93-102 (1993).
Klahre et al., "High molecular weight RNAs and small interfering RNAs induce systemic posttranscriptional gene silencing in plants," *Proc. Natl. Acad. Sci. USA*, PNAS, 99(18):11981-11986 (2002).
Kronenwett et al., "Oligodeoxyribonucleotide Uptake in Primary Human Hematopoietic Cells Is Enhanced by Cationic Lipids and Depends on the Hematopoietic Cell Subset," *Blood*, 91(3):852-862 (1998).
Kusaba et al., "Low glutelin content1: A Dominant Mutation That Suppresses the Glutelin Multigene Family via RNA Silencing ni Rice," *The Plant Cell*, 15(6):1455-1467 (2003).
Kusaba, "RNA interference in crop plants," *Curr Opin Biotechnol*, 15(2):139-143 (2004).
Lavigne et al., "Enhanced antisense inhibition of human immunodeficiency virus type 1 in cell cultures by DLS delivery system," *Biochem Biophys Res Commun*, 237:566-571 (1997).
Lee et al., "Aptamer Database," *Nucleic Acids Research*, 32:D95-D100 (2004).
Lermontova et al., "Reduced activity of plastid protoporphyrinogen oxidase causes attenuated photodynamic damage during high-light compared to low-light exposure," *The Plant Journal*, 48(4):499-510 (2006).
Lesnik et al., "Prediction of rho-independent transcriptional terminators in *Escherichia coli*," *Nucleic Acids Research*, 29(17):3583-3594 (2001).
Li et al., "Establishment of a highly efficient transformation system for pepper (*Capsicum annuum* L.)," *Plant Cell Reports*, 21: 785-788 (2003).
Li et al., "The FAST technique: a simplified Agrobacterium-based transformation method for transient gene expression analysis in seedlings of *Arabidopsis* and other plant species," *Plant Methods*, 5(6):1-15 (2009).
Liu et al., "Carbon Nanotubes as Molecular Transporters for Walled Plant Cells," *Nano Letters*, 9(3):1007-1010 (2009).
Liu et al., "Comparative study on the interaction of DNA with three different kinds of surfactants and the formation of multilayer films," *Bioelectrochemistry*, 70:301-307 (2007).
Liu et al., "DNAzyme-mediated recovery of small recombinant RNAs from a 5S rRNA-derived chimera expressed in *Escherichia coli*," *BMC Biotechnology*, 10:85 (2010).
Llave et al., "Endogenous and Silencing-Associated Small RNAs in Plants," *The Plant Cell*, 14:1605-1619 (2002).
Lu et al., "RNA silencing in plants by the expression of siRNA duplexes," *Nucleic Acids Res.*, 32(21):e171 (2004).
Lu et al., "OligoWalk: an online siRNA design tool utilizing hybridization thermodynamics," *Nucleic Acids Research*, 36:W104-W108 (2008).

Luft, "Making sense out of antisense oligodeoxynucleotide delivery: getting there is half the fun," *J Mol Med*, 76:75-76 (1998).
Maas et al., "Mechanism and optimized conditions for PEG mediated DNA transfection into plant protoplasts," *Plant Cell Reports*, 8:148-149 (1989).
Maher III et al., "Inhibition of DNA binding proteins by oligonucleotide-directed triple helix formation," *Science*, 245(4919):725-730 (1989).
Makkouk et al., "Virus Diseases of Peas, Beans, and Faba Bean in the Mediterranean region," *Adv Virus Res*, 84:367-402 (2012).
Mandal et al., "Adenine riboswitches and gene activation by disruption of a transcription terminator," *Nature Struct. Mol. Biol.*, 11(1):29-35 (2004).
Mandal et al., "Gene Regulation by Riboswitches," *Nature Reviews | Molecular Cell Biology*, 5:451-463 (2004).
Manoharan, "Oligonucleotide Conjugates as Potential Antisense Drugs with Improved Uptake, Biodistribution, Targeted Delivery, and Mechanism of Action," *Antisense & Nucleic Acid Drug Development*, 12:103-128 (2002).
Masoud et al., "Constitutive expression of an inducible β-1,3-glucanase in alfalfa reduces disease severity caused by the oomycete pathogen *Phytophthora megasperma* f. sp *medicaginis*, but does not reduce disease severity of chitincontaining fungi," *Transgenic Research*, 5:313-323 (1996).
Matveeva et al., "Prediction of antisense oligonucleotide efficacy by in vitro methods," *Nature Biotechnology*, 16:1374-1375 (1998).
Meinke, et al., "Identifying essential genes in *Arabidopsis thaliana*," *Trends Plant Sci.*, 13(9):483-491 (2008).
Meins et al., "RNA Silencing Systems and Their Relevance to Plant Development," *Annu. Rev. Cell Dev. Biol.*, 21:297-318 (2005).
Melnyk et al., "Intercellular and systemic movement of RNA silencing signals," *The EMBO Journal*, 30:3553-3563 (2011).
Misawa et al., "Functional expression of the *Erwinia uredovora* carotenoid biosynthesis gene crtI in transgenic plants showing an increase of β-carotene biosynthesis activity and resistance to the bleaching herbicide norflurazon," *The Plant Journal*, 4(5):833-840 (1993).
Misawa et al., "Expression of an *Erwinia* phytoene desaturase gene not only confers multiple resistance to herbicides interfering with carotenoid biosynthesis but also alters xanthophyll metabolism in transgenic plants," *The Plant Journal*, 6(4):481-489 (1994).
Miura et al., "The Balance between Protein Synthesis and Degradation in Chloroplasts Determines Leaf Variegation in *Arabidopsis* yellow variegated Mutants," *The Plant Cell*, 19:1313-1328 (2007).
Molnar et al., "Plant Virus-Derived Small Interfering RNAs Originate redominantly from Highly Structured Single-Stranded Viral RNAs," *Journal of Virology*, 79(12):7812-7818 (2005).
Molnar et al., "Small Silencing RNAs in Plants Are Mobile and Direct Epigenetic Modification in Recipient Cells," *Science*, 328:872-875 (2010).
Moriyama et al., "Double-stranded RNA in rice: a novel RNA replicon in plants," *Molecular & General Genetics*, 248(3):364-369 (1995).
Moriyama et al., "Stringently and developmentally regulated levels of a cytoplasmic double-stranded RNA and its high-efficiency transmission via egg and pollen in rice," *Plant Molecular Biology*, 31:713-719 (1996).
Morrissey et al., "Potent and persistent in vivo anti-HBV activity of chemically modified siRNAs," *Nat Biotechnol.* 23(8):1002-1007 (2005).
Moser et al., "Sequence-Specific Cleavage of Double Helical DNA by Triple Helix Formation," *Science*, 238:645-646 (1987).
Nowak et al., "A new and efficient method for inhibition of RNA viruses by DNA interference," *The FEBS Journal*, 276:4372-4380 (2009).
Office Action dated Feb. 17, 2014, in Mexican Patent Application No. MX/a/2012/010479.
Office Action dated Jan. 6, 2015, in Japanese Patent Application No. 2012-557165.
Office Action dated Nov. 19, 2014, in Eurasian Patent Application No. 201201264/28.
Ongvarrasopone et al., "A Simple and Cost Effective Method to Generate dsRNA for RNAi Studies in Invertebrates," *Science Asia*, 33:35-39 (2007).

(56) References Cited

OTHER PUBLICATIONS

Ouellet et al., "Members of the Acetohydroxyacid Synthase Muligene Family of Brassica Napus Have Divergent Patterns of Expression," *The Plant Journal*, Blackwell Scientific Publications, Oxford, GB, 2(3):321-330 (1992).

Paddison et al., "Stable suppression of gene expression by RNAi in mammalian cells," *Proc. Natl Acad. Sci. USA*, 99(3):1443-1448 (2002).

Palauqui et al., "Activation of systemic acquired silencing by localised introduction of DNA," *Current Biology*, 9:59-66 (1999).

Parera et al., "Dehydration Rate after Solid Matrix Priming Alters Seed Performance of Shrunken-2 Corn," *J. Amer. Soc. Hort. Sci.*, 119(3):629-635 (1994).

Paungfoo-Lonhienne et al., "DNA is Taken up by Root Hairs and Pollen, and Stimulates Root and Pollen Tube Growth," *Plant Physiology*, 153:799-805 (2010).

Paungfoo-Lonhienne et al., "DNA uptake by Arabidopsis induces changes in the expression of Cle peptides which control root morphology," *Plant Signaling & Behavior*, 5(9):1112-1114 (2010).

Pei et al., "On the art of identifying effective and specific siRNAs," *Nature Methods*, 3(9):670-676 (2006).

Peretz et al., "A Universal Expression/Silencing Vector in Plants," *Plant Physiology*, 145:1251-1263 (2007).

Pornprom et al., "Glutamine synthetase mutation conferring target-site-based resistance to glufosinate in soybean cell selections," *Pest Manag Sci*, 2009; 65(2):216-222 (2009).

Preston et al., "Multiple effects of a naturally occurring proline to threonine substitution within acetolactate synthase in two herbicide-resistant populations of *Lactuca serriola,*" *Pesticide Biochem. Physiol.*, 84(3):227-235 (2006).

Qiwei,"Advance in DNA interference," *Progress in Veterinary Medicine*, 30(1):71-75 (2009).

Rajur et al., "Covalent Protein-Oligonucleotide Conjugates for Efficient Delivery of Antisense Molecules," *Bioconjug Chem.*, 8:935-940 (1997).

Reddy et al "Organosilicone Adjuvants Increased the Efficacy of Glyphosate for Control of Weeds in Citrus (*Citrus* spp.)" *HortScience* 27(9):1003-1005 (1992).

Reddy et al., "Aminomethylphosphonic Acid Accumulation in Plant Species Treated with Glyphosate," *J. Agric. Food Chem.*, 56(6):2125-2130 (2008).

Reither et al., "Specificity of DNA triple helix formation analyzed by a FRET assay," *BMC Biochemistry*, 3:27 (2002).

Rey et al., "Diversity of Dicotyledenous-Infecting Geminiviruses and Their Associated DNA Molecules in Southern Africa, Including the South-West Indian Ocean Islands," *Viruses*, 4:1753-1791 (2012).

Reynolds et al., "Rational siRNA design for RNA interference," *Nature Biotechnology*, 22:326-330 (2004).

Ryabov et al., "Cell-to-Cell, but Not Long-Distance, Spread of RNA Silencing That Is Induced in Individual Epidermal Cells," *Journal of Virology*, 78(6):3149-3154 (2004).

Ryan, "Human endogenous retroviruses in health and disease: a symbiotic perspective," *Journal of the Royal Society of Medicine*, 97:560-565 (2004).

Santoro et al., "A general purpose RNA-cleaving DNA enzyme," *Proc. Natl. Acad. Sci. USA*, 94:4262-4266 (1997).

Sathasivan et al., "Nucleotide sequence of a mutant acetolactate synthase gene from an imidazolinone-resistant *Arabidopsis thaliana* var. Columbia," *Nucleic Acids Research*, 18(8):2188-2193 (1990).

Schwab et al., "RNA silencing amplification in plants: Size matters," *PNAS*, 107(34):14945-14946 (2010).

Schwember et al., "Drying Rates following Priming Affect Temperature Sensitivity of Germination and Longevity of Lettuce Seeds," *HortScience*, 40(3):778-781 (2005).

Second Chinese Office Action issued in Chinese Patent Application No. 201180012795.2, dated Jun. 10, 2014.

Seidman et al., "The potential for gene repair via triple helix formation," *J Clin Invest.*, 112(4):487-494 (2003).

Selvarani et al., "Evaluation of seed priming methods to improve seed vigour of onion (*Allium cepa* cv. Aggregatum) and carrot (*Daucus carota*)," *Journal of Agricultural Technology*, 7(3):857-867 (2011).

Sharma et al., "A simple and efficient Agrobacterium-mediated procedure for transformation of tomato," *J. Biosci.*, 34(3):423 433 (2009).

Sijen et al., "On the Role of RNA Amplification in dsRNA-Triggered Gene Silencing," *Cell*, 107:465-476 (2001).

Silwet L-77 Spray Adjuvant for agricultural applications, product description from Momentive Performance Materials, Inc. (2003).

Singh et al., "Absorption and translocation of glyphosate with conventional and organosilicone adjuvants," *Weed Biology and Management*, 8:104-111 (2008).

Steeves et al., "Transgenic soybeans expressing siRNAs specific to a major sperm protein gene suppress *Heterodera glycines* reproduction," *Funct. Plant Biol.*, 33:991-999 (2006).

Stock et al., "Possible Mechanisms for Surfactant-Induced Foliar Uptake of Agrochemicals," *Pestic. Sci.*, 38:165-177 (1993).

Strat et al., "Specific and nontoxic silencing in mammalian cells with expressed long dsRNAs," *Nucleic Acids Research*, 34(13):3803-3810 (2006).

Sudarsan et al., "Metabolite-binding RNA domains are present in the genes of eukaryotes," *RNA*, 9:644-647 (2003).

Sun et al., "Antisense oligodeoxynucleotide inhibition as a potent strategy in plant biology: identification of SUSIBA2 as a transcriptional activator in plant sugar signalling," *The Plant Journal*, 44:128-138 (2005).

Sun et al., "A Highly efficient Transformation Protocol for Micro-Tom, a Model Cultivar for Tomato Functional Genomics," *Plant Cell Physiol.*, 47(3):426-431 (2006).

Sun et al., "Sweet delivery—sugar translocators as ports of entry for antisense oligodeoxynucleotides in plant cells," *The Plant Journal*, 52:1192-1198 (2007).

Takasaki et al., "An Effective Method for Selecting siRNA Target Sequences in Mammalian Cells," *Cell Cycle*, 3:790-795 (2004).

Temple et al., "Can glutamine synthetase activity levels be modulated in transgenic plants by the use of recombinant DNA technology?" *Transgenic Plants and Plant Biochemistry*, 22:915-920 (1994).

Temple et al., "Down-regulation of specific members of the glutamine synthetase gene family in Alfalfa by antisense RNA technology," *Plant Molecular Biology*, 37:535-547 (1998).

Templeton et al., "Improved DNA: liposome complexes for increased systemic delivery and gene expression," *Nature Biotechnology*, 15:647-652 (1997).

Tenllado et al., "Crude extracts of bacterially expressed dsRNA can be used to protect plants against virus infection," *BMC Biotechnology*, 3(3):1-11 (2003).

Tenllado et al., "RNA interference as a new biotechnological tool for the control of virus diseases in plants," *Virus Research*, 102:85-96 (2004).

Tepfer, "Risk assessment of virus resistant transgenic plants," *Annual Review of Phytopathology*, 40:467-491 (2002).

The Seed Biology Place, Website Gerhard Leubner Lab Royal Holloway, University of London, <http://www.seedbiology.de/seedtechnology.asp.

Third Party Submission filed on Nov. 29, 2012 in U.S. Appl. No. 13/042,856.

Thompson, et al., "CLUSTAL W: improving the sensitivity of progressive multiple sequence alignment through sequence weighting, position-specific gap penalties and weight matrix choice," *Nucl. Acids Res.*, 22(22):4673-4680 (1994).

Timmons et al., "Specific interference by ingested dsRNA," *Nature*, 395:854 (1998).

Tomari et al., "Perspective: machines for RNAi," *Genes & Dev.*, 19:517-529 (2005).

Töpfer et al., "Uptake and Transient Expression of Chimeric Genes in Seed-Derived Embryos," *Plant Cell*, 1:133-139 (1989).

Toriyama et al., "Transgenic Rice Plants After Direct Gene Transfer Into Protoplasts," *Bio/Technology*, 6:1072-1074 (1988).

Tran et al., "Control of specific gene expression in mammalian cells by co-expression of long complementary RNAs," *FEBS Lett.*;573(1-3):127-134 (2004).

(56) References Cited

OTHER PUBLICATIONS

Turina et al., "Tospoviruses in the Mediterranean Area," *Advances in Virus Research*, 84:403-437 (2012).
Tuschl, "RNA Interference and Small Interfering RNAs," *ChemBiochem*. 2(4):239-245 (2001).
Tuschl, "Expanding small RNA interference," *Nature Biotechnol*., 20: 446-448 (2002).
Ui-Tei et al., "Guidelines for the selection of highly effective siRNA sequences for mammalian and chick RNA interference," *Nucleic Acids Res*., 32(3): 936-948 (2004).
Unnamalai et al., "Cationic oligopeptide-mediated delivery of dsRNA for post-transcriptional gene silencing in plant cells," *FEBS Letters*, 566:307-310 (2004).
Unniraman et al., "Alternate Paradigm for Intrinsic Transcription Termination in Eubacteria," *The Journal of Biological Chemistry*, 276(45)(9):41850-41855 (2001).
Urayama et al., "Knock-down of OsDCL2 in Rice Negatively Affects Maintenance of the Endogenous dsRNA Virus, *Oryza sativa* Endornavirus," *Plant and Cell Physiology*, 51(1):58-67 (2010).
Van de Wetering et al., "Specific inhibition of gene expression using a stably integrated, inducible small-interfering-RNA vector," *EMBO Rep*., 4(6):609-615 (2003).
Vasil et al., "Herbicide Resistant Fertile Transgenic Wheat Plants Obtained by Microprojectile Bombardment of Regenerable Embryogenic Callus," *Bio/Technology*,10:667-674 (1992).
Vaucheret, "Post-transcriptional small RNA pathways in plants: mechanisms and regulations," *Genes Dev*., 20:759-771 (2006).
Vencill et al., "Resistance of Weeds to Herbicides," *Herbicides and Environment*, 29:585-594 (2011).
Verma et al., "Modified oligonucleotides: synthesis and strategy for users," *Annu. Rev. Biochem*., 67:99-134 (1998).
Vert et al., "An accurate and interpretable model for siRNA efficacy prediction," *BMC Bioinformatics*, 7:520 (2006).
Vionnet et al., "Systemic Spread of Sequence-Specific Transgene RNA Degradation in Plants Is Initiated by Localized Introduction of Ectopic Promoterless DNA," *Cell*, 95:177-187 (1998).
Wakelin et al., "A target-site mutation is present in a glyphosate-resistant *Lolium rigidum* population," *Weed Res. (Oxford)*, 46(5):432-440 (2006).
Walton et al., "Prediction of antisense oligonucleotide binding affinity to a structured RNA target," *Biotechnol Bioeng* 65(1):1-9 (1999).
Wan et al., "Generation of Large Nos. Of Independently Transformed Fertile Barley Plants," *Plant Physiol*., 104:37-48 (1994).
Wardell, "Floral Induction of Vegetative Plants Supplied a Purified Fraction of Deoxyribonucleic Acid from Stems of Flowering Plants," *Plant Physiol*, 60:885-891 (1977).
Wardell,"Floral Activity in Solutions of Deoxyribonucleic Acid Extracted from Tobacco Stems," *Plant Physiol*, 57:855-861 (1976).
Waterhouse et al., "Virus resistance and gene silencing in plants can be induced by simultaneous expression of sense and antisense RNA," *Proc Natl Acad Sci USA*, 95 13959-13964 (1998).
Welch et al., "Expression of ribozymes in gene transfer systems to modulate target RNA levels," *Curr Opin Biotechnol*. 9(5):486-496 (1998).
Wilson, et al., "Transcription termination at intrinsic terminators: The role of the RNA hairpin," *Proc. Natl. Acad. Sci. USA*, 92:8793-8797 (1995).
Winkler et al., "Thiamine derivatives bind messenger RNAs directly to regulate bacterial gene expression," *Nature*, 419:952-956 (2002).
Written Opinion dated May 8, 2014, in International Application No. PCT/IL2013/050447.
Written Opinion dated Sep. 1, 2014, in Singapore Patent Application No. 201206152-9.
Xu et al., Characterization and Functional Analysis of the Calmodulin-Binding Domain of Rac1 GTPase, *Plos One*, 7(8)1-12:e42975 (2012).
Yin et al., "Production of double-stranded RNA for interference with TMV infection utilizing a bacterial prokaryotic expression system," *Appl. Microbiol. Biotechnol*., 84(2):323-333 (2009).

YouTube video by General Electric Company "Silwet Surfactants," screen shot taken on Jan. 11, 2012 of video of www.youtube.com/watch?v=WBw7nXMqHk8 (uploaded Jul. 13, 2009).
Zagnitko, "Lolium regidum clone LS1 acetyl-CoA carboxylase mRNA, partial cds; nuclear gene for plastid product," GenBank: AF359516.1, 2 pages (2001).
Zagnitko, et al., "An isoleucine/leucine residue in the carboxyltransferase domain of acetyl-CoA carboxylase is critical for interaction with aryloxyphenoxypropionate and cyclohexanedione inhibitors," *PNAS*, 98(12):6617-6622 (2001).
Zhang et al., "A novel rice gene, NRR responds to macronutrient deficiency and regulates root growth," *Mol Plant*, 5(1):63-72 (2012).
Zhang et al., "*Agrobacterium*-mediated transformation of *Arabidopsis thaliana* using the floral dip method," *Nature Protocols*, 1(2):1-6 (2006).
Zhang et al., "Cationic lipids and polymers mediated vectors for delivery of siRNA," *Journal of Controlled Release*, 123:1-10 (2007).
Zhang et al., "DEG: a database of essential genes," *Nucleic Acids Res*., 32:D271-D272 (2004).
Zhang et al., "Transgenic rice plants produced by electroporation-mediated plasmid uptake into protoplasts," *The Plant Cell Rep*., 7:379-384 (1988).
Zhao et al.,"*Phyllotreta striolata* (Coleoptera: Chrysomelidae):Arginine kinase cloning and RNAi-based pest control," *European Journal of Entomology*, 105(5):815-822 (2008).
Zhu et al., "Ingested RNA interference for managing the populations of the Colorado potato beetle, *Leptinotarsa decemlineata*," *Pest Manag Sci*, 67:175-182 (2010).
Agrios, *Plant Pathology* (Second Edition), 2:466-470 (1978).
Bai et al., "Naturally Occurring Broad-Spectrum Powdery Mildew Resistance in a Central American Tomato Accession Is Caused by Loss of Mlo Function," *MPMI*, 21(1):30-39 (2008).
Bourgeois et al., "Field and producer survey of ACCase resistant wild oat in Manitoba," *Canadian Journal of Plant Science*, 709-715 (1997).
Brugière et al., "Glutamine Synthetase in the Phloem Plays a Major Role in Controlling Proline Production," *The Plant Cell*, 11:1995-2011 (1999).
Campbell et al., "Gene-knockdown in the honey bee mite *Varroa destructor* by a non-invasive approach: studies on a glutathione S-transferase," *Parasites & Vectors*, 3(1):73, pp. 1-10 (2010).
Chang et al., "Cellular Internalization of Fluorescent Proteins via Arginine-rich Intracellular Delivery Peptide in Plant Cells," *Plant Cell Physiol*., 46(3):482-488 (2005).
Chupp et al., "Chapter 8: White Rust," *Vegetable Diseases and Their Control*, The Ronald Press Company, New York, pp. 267-269 (1960).
Communication pursuant to Article 94(3) EPC dated Jun. 26, 2015, as received in European Patent Application No. 11 753 916.3.
Communication pursuant to Article 94(3) EPC dated Oct. 23, 2015, as received in European Patent Application No. 12 831 945.6.
Desai et al., "Reduction in deformed wing virus infection in larval and adult honey bees (*Apis mellifera* L.) by double-stranded RNA ingestion," *Insect Molecular Biology*, 21(4):446-455 (2012).
Emery et al., "Radial Patterning of *Arabidopsis* Shoots by Class III HD-ZIP and KANADI Genes," *Current Biology*, 13:1768-1774 (2003).
Extended European Search Report dated Jun. 29, 2015, in European Patent Application No. 12 831 494.5.
Final Office Action dated Nov. 10, 2015, in U.S. Appl. No. 13/612,985.
Final Office Action dated Nov. 7, 2013, in U.S. Appl. No. 13/042,856.
Final Office Action dated Nov. 30, 2015, in U.S. Appl. No. 13/612,948.
First Office Action daed Mar. 12, 2015, in Chinese Patent Application No. 201280053984.9.
International Preliminary Report on Patentability (Chapter II) dated Jul. 24, 2015, in International Application No. PCT/US2014/047204.
International Search Report and the Written Opinion dated May 10, 2011, in International Application No. PCT/US11/027528.
International Search Report and Written Opinion dated Jul. 8, 2015, in International Application No. PCT/US2015/011408.
International Search Report and Written Opinion dated Mar. 26, 2015, in International Application No. PCT/US2014/069353.

(56) References Cited

OTHER PUBLICATIONS

International Search Report and Written Opinion dated Nov. 24, 2015, in International Application No. PCT/US2015/037522.
Invitation to Pay Additional Fees dated Sep. 8, 2015, in International Application No. PCT/US2015/037015.
Invitation to Pay Additional Fees dated Sep. 9, 2015, in International Application No. PCT/US2015/037522.
Jofre-Garfias et al., "*Agrobacterium*-mediated transformation of Amaranthus *hypochondriacus*: light- and tissue-specific expression of a pea chlorophyll a/b-binding protein promoter," *Plant Cell Reports*, 16:847-852 (1997).
Khan et al., "Matriconditioning of Vegetable Seeds to Improve Stand Establishment in Early Field Plantings," *J. Amer. Soc. Hort. Sci.*, 117(1):41-47 (1992).
Kim et al., "Synthetic dsRNA Dicer substrates enhance RNAi potency and efficacy," *Nature Biotechnology*, 23(2):222-226 (2005).
Lein et al., "Target- based discovery of novel herbicides," *Current Opinion in Plant Biology*, 7:219-225 (2004).
Leopold et al., "Chapter 4: Moisture as a Regulator of Physiological Reaction in Seeds," *Seed Moisture, CSSA Special Publication No. 14*, pp. 51-69 (1989).
MacKenzie et al., "Transgenic *Nicotiana debneyii* expressing viral coat protein are resistant to potato virus S infection," *Journal of General Virology*, 71:2167-2170 (1990).
Maori et al., "IAPV, a bee-affecting virus associated with Colony Collapse Disorder can be silenced by dsRNA ingestion," *Insect Molecular Biology*, 18(1):55-60 (2009).
Molina et al., "Inhibition of protoporphyrinogen oxidase expression in *Arabidopsis* causes a lesion-mimic phenotype that induces systemic acquired resistance," *The Plant Journal*, 17(6):667-678 (1999).
Non-Final Office Action dated Apr. 11, 2013, in U.S. Appl. No. 13/042,856.
Non-Final Office Action dated Aug. 12, 2015, in U.S. Appl. No. 13/612,936.
Non-Final Office Action dated Aug. 13, 2015, in U.S. Appl. No. 13/612,929.
Non-Final Office Action dated Jul. 23, 2015, in U.S. Appl. No. 14/335,135.
Non-Final Office Action dated Jul. 30, 2014, in U.S. Appl. No. 13/042,856.
Non-Final Office Action dated Jun. 5, 2015, in U.S. Appl. No. 13/612,948.
Non-Final Office Action dated Jun. 8, 2015, in U.S. Appl. No. 13/612,941.
Non-Final Office Action dated Mar. 30, 2015, in U.S. Appl. No. 13/583,302.
Non-Final Office Action dated May 15, 2015, in U.S. Appl. No. 14/608,951.
Non-Final Office Action dated May 22, 2015, in U.S. Appl. No. 13/612,985.
Nord-Larsen et al., "Cloning, characterization and expression analysis of tonoplast intrinsic proteins and glutamine synthetase in ryegrass (*Lolium perenne* L.)," *Plant Cell Reports*, 28(10):1549-1562 (2009).
Notice of Allowance dated Oct. 5, 2015, in U.S. Appl. No. 13/583,302.
Office Action dated Jul. 23, 2015, in Ukrainian Patent Application No. 201211548.
Office Action dated Oct. 5, 2015, in Eurasian Patent Application No. 201201264/28.
Office Action dated Sep. 9, 2015, in Chinese Patent Application No. 201280055409.2.
Orbovie et al., "Foliar-Applied Surfactants and Urea Temporarily Reduce Carbon Assimilation of Grapefruit Leaves," *J. Amer. Soc. Hort. Sci.*, 126(4):486-490 (2001).
Pratt et al., "*Amaranthus rudis* and *A. tuberculatus*, One Species or Two?," *Journal of the Torrey Botanical Society*, 128(3):282-296 (2001).
Restriction Requirement dated Apr. 21, 2015, in U.S. Appl. No. 13/612,954.
Restriction Requirement dated Feb. 12, 2015, in U.S. Appl. No. 13/612,985.
Restriction Requirement dated Mar. 12, 2015, in U.S. Appl. No. 13/612,948.
Restriction Requirement dated Mar. 4, 2015, in U.S. Appl. No. 13/612,941.
Restriction Requirement dated May 4, 2015, in U.S. Appl. No. 13/612,929.
Restriction Requirement dated May 5, 2015, in U.S. Appl. No. 13/612,936.
Restriction Requirement dated May 7, 2015, in U.S. Appl. No. 13/612,925.
Restriction Requirement dated May 7, 2015, in U.S. Appl. No. 13/612,995.
Restriction Requirement dated Oct. 2, 2012, in U.S. Appl. No. 13/042,856.
Restriction Requirement dated Oct. 21, 2014, in U.S. Appl. No. 13/583,302.
Riggins et al., "Characterization of de novo transcriptome for waterhemp (*Amaranthus tuberculatus*) using GS-FLX 454 pyrosequencing and its application for studies of herbicide target-site genes," *Pest Manag. Sci.*, 66:1042-1052 (2010).
Rose et al., "Functional polarity is introduced by Dicer processing of short substrate RNAs," *Nucleic Acids Research*, 33(13):4140-4156 (2005).
Rothnie et al., Pararetroviruses and Retroviruses: A Comparative Review of Viral Structure and Gene Expression Strategies, *Advances in Virus Research*, 44:1-67 (1994).
Schweizer et al., "Double-stranded RNA interferes with gene function at the single-cell level in cereals," *The Plant Journal*, 24(6):895-903 (2000).
Senthil-Kumar et al., "A systematic study to determine the extent of gene silencing in *Nicotiana benthamiana* and other Solanaceae species when heterologous gene sequences are used for virus-induced gene silencing," *New Phytologist*, 176:782-791 (2007).
Snead et al., "Molecular basis for improved gene silencing by Dicer substrate interfering RNA compared with other siRNA variants," *Nucleic Acids Research*, 41(12):6209-6221 (2013).
Stevens et al., "New Formulation Technology—SILWET® Organosilicone Surfactants Have Physical and Physiological Properties Which Enhance the Performance of Sprays," *Proceedings of the 9th Australian Weeds Conference*, pp. 327-331 (1990).
Street, "Why is DNA (and not RNA) a stable storage form for genetic information?," *Biochemistry Revisited*, pp. 1-4 (2008).
Sutton et al., "Activity of mesotrione on resistant weeds in maize," *Pest Manag. Sci.*, 58:981-984 (2002).
Tank Mixing Chemicals Applied to Peanut Crops: Are the Chemicals Compatible?, College of Agriculture & Life Sciences, NC State University, AGW-653, pp. 1-11 (2004).
Taylor, "Seed Storage, Germination and Quality," *The Physiology of Vegetable Crops*, pp. 1-36 (1997).
Tranel et al., "Resistance of weeds to ALS-inhibiting herbicides: what have we learned?," *Weed Science*, 50:700-712 (2002).
Tsugawa et al., "Efficient transformation of rice protoplasts mediated by a synthetic polycationic amino polymer," *Theor Appl Genet*, 97:1019-1026 (1998).
Vermeulen et al. "The contributions of dsRNA structure to Dicer specificity and efficiency," *RNA*, 11(5):674-682 (2005).
Wang et al., "Foliar uptake of pesticides-Present status and future challenge," ScienceDirect, 87:1-8 (2007).
Communication pursuant to Article 94(3) EPC dated Jan. 14, 2016, in European Patent Application No. 12 832 415.9.
Concise Descriptions of Relevance filed by a third party on Nov. 29, 2012, in U.S. Appl. No. 13/042,856.
Extended European Search Report dated Jan. 20, 2016, in European Patent Application No. 13 794 339.5.
First Office Action dated Feb. 2, 2016, in Chinese Patent Application No. 201380039346.6.
International Search Report and Written Opinion dated Nov. 27, 2015, in International Application No. PCT/US2015/037015.
International Search Report and Written Opinion dated May 26, 2016, in International Application No. PCT/US2016/014344.

(56) References Cited

OTHER PUBLICATIONS

Ivanova et al. "Members of the Toc159 Import Receptor Family Represent Distinct Pathways for Protein Targeting to Plastids," *Molecular Biology of the Cell*, 15:3379-391 (2004).
Non-Final Office Action dated Feb. 23, 2016, in U.S. Appl. No. 14/603,347.
Partial Supplementary European Search Report dated Mar. 2, 2015, in European Patent Application No. 12 831 494.5.
Richardson et al. "Targeting and Assembly of Components of the TOC protein Import Complex at the Chloroplast Outer Envelope Membrane," *Frontiers in Plant Science* 5(269) 1-14 (2014).
Salanenka et al.,"Seedcoat Permeability: Uptake and Post-germination Transport of Applied Model Tracer Compounds," *HortScience*, 46(4):622-626 (2011).
Tomlinson et al., "Evidence that the hexose-to-sucrose ratio does not control the switch to storage product accumulation in oilseeds: analysis of tobacco seed development and effects of overexpressing apoplastic invertase," *Journal of Experimental Botany*, 55(406):2291-2303 (2004).
Ascencio-Ibanez et al., "DNA abrasion onto plants is an effective method for geminivirus infection and virus-induced gene silencing," *Journal of Virological Methods*, 142:198-203 (2007).
Bachman et al., "Characterization of the spectrum of insecticidal activity of a double-stranded RNA with targeted activity against Western Corn Rootworm (*Diabrotica virgifera virgifera* LeConte)," *Transgenic Res.*, pp. 1-16 (2013).
Bauer et al., "The Major Protein Import Receptor of Plastids is Essential for Chloroplast Biogenesis," *Nature*, 403:203-207 (2000).
Bedell et al., "Sorghum Genome Sequencing by Methylation Filtration," *PLOS Biology*, 3(1):E13/104-115 (2005).
Burgos et al., "Review: Confirmation of Resistance to Herbicides and Evaluation of Resistance Levels," *Weed Science*, 61 (1):4-20 (2013).
Chen et al., "Exploring MicroRNA-Like Small RNAs in the Filamentous Fungus *Fusarium oxysporum*," *PLOS One*, 9(8):e104956:1-10 (2014).
Di Stilio et al., "Virus-Induced Gene Silencing as a Tool for Comparative Functional Studies in Thalictrum," *PLoS One*, 5(8):e12064 (2010).
Eamens et al., "RNA Silencing in Plants: Yesterday, Today, and Tomorrow," *Plant Physiology*, 147(2):456-468 (2008).
Fassler, BLAST Glossary, National Center for Biotechnology Information (2011).
Fernandez et al., "Uptake of Hydrophilic Solutes Through Plant Leaves: Current State of Knowledge and Perspectives of Foliar Fertilization," *Critical Reviews in Plant Sciences*, 28:36-38 (2009).
Friedberg, "Automated protein function prediction—the genomic challenge," *Briefings in Bioinformatics*, 7(3):225-242 (2006).
Funke et al., "Molecular basis for herbicide resistance in Roundup Ready crops," *PNAS*, 103:13010-13015 (2006).
Gaskin et al., "Novel organosillicone adjuvants to reduce agrochemical spray volumes on row crops," New Zealand Plant Protection, 53:350-354 (2000).
GenBank Accession No. EF143582 (2007).
Hagio, "Chapter 25: Direct Gene Transfer into Plant Mature Seeds via Electroporation After Vacuum Treatment," Electroporation and Sonoporation in Developmental Biology, p. 285-293 (2009).
Hess, "Surfactants and Additives," 1999 Proceedings of the California Weed Science Society, 51:156-172 (1999).
Hörmann et al., "Tic32, an Essential Component in Chloroplast Biogenesis," *The Journal of Biological Chemistry*, 279:34756-34762 (2004).
Inaba et al., "*Arabidopsis* Tic110 is Essential for the Assembly and Function of the Protein Import Machinery of Plastids," *The Plant Cell*, 17:1482-1496 (2005).
Jacque et al., "Modulation of HIV-1 replication by RNA interference," *Nature*, 418, 435-438 (2002).
Jang et al., "Resistance to herbicides caused by single amino acid mutations in acetyl-CoA carboxylase in resistant populations of grassy weeds," *New Phytologist*, 197(4):1110-1116 (2013).

Jarvis et al., "An *Arabidopsis* Mutant Defective in the Plastid General Protein Import Apparatus," *Science*, 282:100-102 (1998).
Kikkert et al., "Stable Transformation of Plant Cells by Particle Bombardment/Biolistics," *Methods in Molecular Biology*, 286:61-78 (2005).
Kovacheva et al., "In vivo Studies on the Roles of Tic110, Tic40 and Hsp93 During Chloroplast Protein Import" *The Plant Journal*, 41:412-428 (2005.
Kovacheva et al., "Further in vivo Studies on the Role of the Molecular Chaperone Hspt 93, in plastid Protein Import" *The Plant Journal*, 50:364-379 (2007).
Li et al., "A Simplified Seed Transformation Method for Obtaining Transgenic *Brassica napus* Plants," *Agricultural Sciences in China*, 8(6):658-663 (2009).
Liu et al, "The Helicase and RNaseIIIa Domains of *Arabidopsis* Dicer-Like1 Modulate Catalytic Parameters during MicroRNA Biogenesis," *Plant Physiology*, 159:748-758 (2012).
McGinnis, "RNAi for functional genomics in plants," *Brief Funct Genomics*, 9(2):111-7 (2010).
Office Action dated Aug. 1, 2017, in European Patent Application No. 12 830 932.5.
Office Action dated Aug. 14, 2017, in Israeli Patent Application No. 235878.
Office Action dated Aug. 22, 2017, in Korean Patent Application No. 10-2012-7023415.
Office Action dated Aug. 25, 2016, in Eurasian Patent Application No. 201201264.
Office Action dated Aug. 3, 2017, in Chinese Patent Application No. 201480014392.5.
Office Action dated Aug. 3, 2017, in European Patent Application No. 12 831 684.1.
Office Action dated Aug. 8, 2017, in Chilean Patent Application No. 201501874.
Office Action dated Dec. 13, 2016, in Ukrainian Patent Application No. a 2014 03843.
Office Action dated Dec. 14, 2016, in Ukrainian Patent Application No. a 2014 03850.
Office Action dated Dec. 15, 2016, in Ukrainian Patent Application No. a 2014 03845.
Office Action dated Dec. 15, 2016, in Ukrainian Patent Application No. a 2014 03849.
Office Action dated Dec. 15, 2016, in Ukrainian Patent Application No. a 2014 03852.
Office Action dated Dec. 27, 2016, in Ukrainian Patent Application No. a 2012 11548.
Office Action dated Jul. 11, 2017, in Mexican Patent Application No. MX/a/2015/013118 (with English translation).
Office Action dated Jul. 3, 2017, in Mexican Patent Application No. MX/a/2015/012632 (with English translation).
Office Action dated Jul. 6, 2017, in Mexican Patent Application No. MX/a/2015/013103 (with English translation).
Office Action dated Mar. 16, 2017, in Chinese Patent Application No. 201280054819.5.
Office Action dated May 3, 2016, in Chilean Patent Application No. 201601057.
Office Action dated Nov. 15, 2016, in Mexican Patent Application No. MX/a/2014/003068 (with English translation).
Office Action dated Sep. 6, 2017, in Chinese Patent Application No. 2014800154012 (with English translation).
Patent Examination Report No. 1 dated Jun. 8, 2017, in Australian Patent Application No. 2012308686.
Powles et al., "Evolution in Action: Plants Resistant to Herbicides," *Annual Review of Plant Biology*, 61(1):317-347 (2010).
Rakoczy-Trojanowska, "Alternative Methods of Plant Transformation—a short review," Cellular & Molecular Biology Letters, 7:849-858 (2002).
Regalado, "The Next Great GMO Debate," MIT Technology Review,pp. 1-19 (2015).
Search Report dated Jul. 24, 2017, in Chinese Patent Application No. 201480014392.5 (with English translation).
Statement of Grounds and Particulars dated Sep. 1, 2017, in Australian Patent No. 2014262189.

(56) References Cited

OTHER PUBLICATIONS

Stevens, "Formulation of Sprays to Improve the Efficacy of Foliar Fertilisers," *New Zealand Journal of Forestry Science*, 24(1):27-34 (1994).
Stevens, "Organosilicone Surfactants as Adjuvants for Agrochemicals," *New Zealand Journal of Forestry Science*, 24:27-34 (1994).
Summons to Attend Oral Proceedings Pursuant to Rule 115(1) EPC, dated Aug. 7, 2017, in European Patent Application No. 12832160.1.
Teng et al., "Tic21 Is an Essential Translocon Component for Protein Translocation across the Chloroplast Inner Envelope Membrane," *The Plant Cell*, 18:2247-2257 (2006).
Trucco et al., "Amaranthus hybridus can be pollinated frequently by A. tuberculatus under filed conditions," *Heredity*, 94:64-70 (2005).
Voinnet, "Origin, Biogenesis, and Activity of Plant MicroRNAs," *Cell*, 136:669-687 (2009).
Wool et al., "Structure and evolution of mammalian ribosomal proteins," *Biochem. Cell Biol.*, 73:933-947 (1995).
Written Opinion dated Mar. 6, 2017, in Singaporean Patent Application No. 2012061529.
Zhong et al., A Pea Antisense Gene for the Chloroplast Stromal Processing Peptidase Yields Seedling Lethals in *Arabidopsis*: Survivors Show Defective GFP Import in vivo, *The Plant Journal*. 34:802-812 (2003).
Zhang, "Artificial trans-acting small interfering RNA: a tool for plant biology study and crop improvements," *Planta*, 239:1139-1146 (2014).
Anonymous, "Resistant Weeds Spur Research Into New Technologies," Grains Research & Development Corporation, 2013.
Chang et al., "Dual-target gene silencing by using long, sythetic siRNA duplexes without triggering antiviral responses," *Molecules and Cells*, 27(6) 689-695 (2009).
Cheng et al., "Transient Expression of Minimum Linear Gene Cassettes in Onion Epidermal Cells via Direct Transformation," *Appl Biochem Biotechnol*, 159:739-749 (2009).
Christiaens et al., "The challenge of RNAi-mediated control of hemipterans," *Current Opinion in Insect Science*, 6:15-21 (2014).
Constan et al., "An outer envelope membrane component of the plastid protein import apparatus plays an essential role in *Arabidopsis*," *The Plant Journal*, 38:93-106 (2004).
Database EMBL XP-002781749(BG442539) dated Mar. 20, 2001.
Eamens et al., "RNA Silencing in Plants: Yesterday, Today, and Tomorrow," *mPlant Physiology*, 147(2):456-468 (2008).
Eudes et al., "Cell-penetrating peptides," Plant Signaling & Behavior, 3(8):549-5550 (2008).
Egli et al., "A Maize Acetyl-Coenzyme A Carboxylase cDNA Sequence," *Plant Physiol.*, 108: 1299-1300 (1995).
European Search Report dated Jun. 29, 2018, in European Patent Application No. 18157745.3.
European Search Report dated Sep. 7, 2017, in European Patent Application No. 17152830.0.
Examination Report dated Mar. 1, 2018, in Australian Patent Application No. 2013264742.
Extended European Search Report dated Nov. 7, 2017, in European Patent Application No. 15811092.4.
Extended European Search Report dated Nov. 8, 2017, in European Patent Application No. 15737282.2.
Extended European Search Report dated Apr. 13, 2018, in European Patent Application No. 15812530.0.
Extended European Search Report dated Mar. 15, 2018, in European Patent Application No. 17181861.0.
Gallie et al., "Identification of the motifs within the tobacco mosaic virus 5'-leader responsible for enhancing translation," *Nucleic Acids Res.*, 20(17):4631-4638 (1992).
Gasser et al., "Structure, Expression, and Evolution of the 5-Enolpyruvylshikimate-3-phosphate Synthase Genes of Petunia and Tomato," *J. Biol. Chem.*, 263: 4280-4287 (1988).
Gomez-Zurita et al., "Recalibrated Tree of Leaf Beetles (Chrysomelidae) Indicates Independent Diversification of Angiosperms and Their Insect Herbivores," *PLoS One*, 4(e360):1-8 (2007).
Hoermann et al., "Tic32, as Essential Component in Chloroplast Biogenesis," *The Journal of Biological Chemistry*, 279(33):34756-34762 (2004).
Hu et al., "High efficiency transport of quantum dots into plant roots with the aid of silwet L-77," *Plant Physiology and Biochemistry*, 48:703-709 (2010).
International Search Report and the Written Opinion dated Jul. 15 2014, in International Application No. PCT/US2014/025305.
Ivanova et al., "Members of the Toc159 Import Receptor Family Represent Distinct Pathways for Protein Targeting to Plastids," *Molecular Biology of the Cell*, 15:3379-3392 (2004).
Jarvis et al, "An *Arabidopsis* mutant defective in the plastid general protein import apparatus," *Science*, 282:100-103 (1998).
Kovacheva et al., "Further in vivo studies on the role of the molecular chaperone, Hsp93, in plastid protein import," *The Plant Journal*, 50:364-379 (2007).
Kovacheva et al., "In vivo studies on the roles of Tic100, Tic40 and Hsp93 during chloroplast protein import," *The Plant Journal*, 41:412-428 (2005).
Li et at., "Long dsRNA but not siRNA initiates RNAi in western corn rootworm larvae and adults," *Journal of Applied Entomology*, 139(6):432-445 (2015).
Non-Final Office Action dated Mar. 21, 2018, in U.S. Appl. No. 13/619,980.
Office Action dated Aug. 9, 2018, in Canadian Patent Application No. 2,848,371.
Office Action dated Dec. 5, 2017, in Japanese Patent Application No. 2016502033.
Office Action dated Feb. 21, 2018, in Mexican Patent Application No. MX/a/2015/012632 (with English translation).
Office Action dated Jul. 30, 2018, in Canadian Patent Application No. 2,848,576.
Office Action dated Mar. 8, 2018 (with English translation), in Chilean Patent Application No. 201403192.
Partial European Search Report dated Dec. 6, 2017, in European Patent Application No. 17181861.0.
Partial Supplementary European Search Report dated Jan. 11, 2018, in European Patent Application No. 15812530.0.
Powles et al., "Evolution in Action: Plants Resistant to Herbicides," Annual Review of Plant Biology, 61(1):317-347.
Qichuan et al., Seed Science, China Agriculture Press, pp. 101-103, Tables 2-37 (2001).
Regalado, "The Next Great GMO Debate," MIT Technology Review,pp. 1-19 (2015) <https://www.technologyreview.com/s/540136/the-next-great-gmo-debate/>.
Reverdatto et al., "A Multisubunit Acetyl Coenzyme A Carboxylase from Soybean," *Plant Physiol.*, 119: 961-978 (1999).
Richardson et al., "Targeting and assembly of components of the TOC protein import complex at the chloroplast outer envelope membrane," *Frontiers in Plant Science*, 5:1-14 (2014).
Search Report dated Oct. 20, 2017, in Chinese Patent Application No. 201380039346.6.
Small, "RNAi for revealing and engineering plant gene functions," *Current Opinion in Biotechnology*, 18:148-153 (2007).
Stevens, "Formulation of Sprays to Improve the Efficacy of Foliar Fertilisers," New Zealand Forest Research Institute, pp. 27-34 (1994).
Stevens, "Organosilicone Surfactants as Adjuvants for Agrochemicals," *Journal of Pesticide Science*, 38:103-122 (1993).
Sun, "Characterization of Organosilicone Surfactants and Their Effects on Sulfonylurea Herbicide Activity," Thesis Submitted to the Faculty of the Virginia Polytechnic Institute and State University dated Apr. 5, 1996.
Ulrich et al., "Large scale RNAi screen in Tribolium reveals novel target genes for pest control and the proteasome as prime target," *BMC genomics*, 16(1):671 (2015).
Wang et al., "Principle and technology of genetic engineering in plants," in Plant genetic engineering principles and techniques, Beijing: Science Press, pp. 313-315 (1998).
Zaimin et al., Chapter III Seeds and Seedlings, Botany, Northwest A&F University Press, pp. 87-92 (2009).
Zhang, Chapter 10: New Characteristics of Pesticide Research & Development, p. 209 (2010).

(56) References Cited

OTHER PUBLICATIONS

Zhang et al., "Development and Validation of Endogenous Reference Genes for Expression Profiling of Medaka (*Oryzias latipes*) Exposed to Endocrine Disrupting Chemicals by Quantitative Real-Time RT-PCR," *Toxicological Sciences*, 95(2):356-368 (2007).
Zhang et al., "Progress in research of honey bee mite *Varro destructor*," *Journal of Environmental Entomology*, 34(3):345-353 (2012).
Zotti et al., "RNAi technology for insect management and protection of beneficial insects from diseases: lessons, challenges and risk assessments," Neotropical Entomology, 44(3):197-213 (2015).
Asad et al., "Silicon Carbide Whisker-mediated Plant Transformation," Properties and Applicants of Silicon Carbide, pp. 345-358 (2011).
Baker, "Chlorophyll Fluorescence: A Probe of Photosynthesis In Vivo," *Annu. Rev. Plant Biol.*, 59:89-113 (2008).
Baum et al., "Progress Towards RNAi-Mediated Insect Pest Management," *Advances in Insect Physiology*, 47:249-295 (2014).
Belhadj et al., "Methyl Jasmonate Induces Defense Responses in Grapevine and Triggers Protection against Erysiphe necator," *J. Agric Food Chem.*, 54:9119-9125 (2006).
Boij et al., In vivo Studies on the Roles of Tic55-Related Proteins in Chloroplast Protein Import in *Arabidopsis thaliana, Molecular Plant*, 2(6):1397-1409 (2009).
Burleigh, "Relative quantitative RT-PCR to study the expression of plant nutrient transporters in arbuscular mycorrhizas," *Plant Science*, 160: 899- 904 (2001).
Communication Pursuant to Article 94(3) EPC dated Sep. 5, 2018, in European Patent Application No. 17152830.0.
Declaration of Jerzy Zabkiewicz executed Nov. 28, 2017, as filed by Opponent in Australian Patent Application No. 2014262189, pp. 1-4.
Declaration of Jerzy Zabkiewicz executed Nov. 28, 2017, as filed by Opponent in Australian Patent Application No. 2014262189, pp. 1-73.
Declaration of Neena Miller executed Nov. 30, 2017, as filed by Opponent in Australian Patent Application No. 2014262189, pp. 1-114.
Declaration of Neena Miller executed Nov. 30, 2017, as filed by Opponent in Australian Patent Application No. 2014262189, pp. 1-25.
Delye et al., "PCR-based detection of resistance to acetyl-CoA carboxylase-inhibiting herbicides in black-grass (*Alopecurus myosuroides* Huds) and ryegrass (*Lolium rigidum* Gaud)," *Pest Management Science*, 58:474-478 (2002).
Delye et al., "Variation in the gene encoding acetolactate-synthase in Lolium species and proactive detection of mutant, herbicide-resistant alleles," *Weed Research*, 49:326-336 (2009).
Desveaux et al., "PBF-2 Is a Novel Single-Stranded DNA Binding Factor Implicated in PR-10a Gene Activation in Potato," *The Plant Cell*, 12:1477-1489 (2000).
Dietzgen et al., "Transgenic gene silencing strategies for virus control," *Australasian Plant Pathology*, 35:605-618 (2006).
Dilpreet et al., "Glyphosate Resistance in a Johnsongrass (*Sorghum halepense*) Biotype from Arkansas," *Weed Science*, 59(3):299-304 (2011).
Drobyazko R.V., "Reliable and environmentally friendly insecticide," Protection and quarantine of plants, 2012 (pp. 52, 53) (in Russian).
Duhoux et al., "Reference Genes to Study Herbicide Stress Response in *Lolium* sp.: Up-Regulation of P3450 Genes in Plants Resistant to Acetolactate-Synthase Inhibitors," *PLOS One*, 8(5):e63576 (2013).
Extended European Search Report dated Dec. 19, 2018, in European Patent Application No. 16804395.8.
Extended European Search Report dated Nov. 16, 2018, in European Patent Application No. 18182238.8.
Extended European Search Report dated Nov. 21, 2018, in European Patent Application No. 18175809.5.
Extended European Search Report dated Sep. 28, 2018, in European Patent Application No. 16740770.9.

Gan et al., "Bacterially expressed dsRNA protects maize against SCMV infection," *Plant Cell Rep*, 29(11): 1261-1268 (2010).
Gilmer et al., "Latent Viruses of Apple I. Detection with Woody Indicators," *Plant Pathology*, 1(10): 1-9 (1971).
Guttieri et al., "DNA Sequence Variation in Domain A of the Acetolactate Synthase Genes of Herbicide-Resistant and -Susceptible Weed Biotypes," *Weed Science*, 40:670-679 (1992).
Huggett et al., "Real-time RT-PCR normalisation; strategies and considerations," *Genes and Immunity*, 6:279-284 (2005).
Jiang et al., Chapter III Seeds and Seedlings, Botany, Northwest A&F University Press, pp. 87-92 (2009).
Kasmati et al. Molecular and Genetic Analysis of Tic20 Homologues in *Arabidopsis thaliana* Chloroplasts, *The Plant Journal*, 66:877-889 (2011).
Kim et al. "Rice chloroplast-localized heat shock protein 70, OsHsp70CP1, is essential for chloroplast development under high-temperature conditions," *Journal of Plant Physiology*, 170:854-86 (2013).
Kim et al., "Synthesis and characterization of mannosylated pegylated polyethylenimine as a carrier for siRNA," *International Journal of Pharmaceutics*, 427:123-133 (2012).
Kirkwood, "Recent developments in our understanding of the plant cuticle as a barrier to the foliar uptake of pesticides," Pestic Sci, 55:69-77 (1999).
Koehler et al. "Characterization of Chloroplast Protein Import without Tic56, a Component of the 1-Megadalton Transcolon at the Inner Envelope Membrane of Chloroplasts," *Plant Physiology*, 167:972-990 (2015).
Kubis et al. Functional Specialization amongst the *Arabidopsis* Toc159 Family of Chloroplasts Protein Import Receptors, The Plant Cell, 16:2059-2077 (2004).
Kumar et al., "Sequencing, De Novo Assembly and Annotation of the Colorado Potato Beetle, *Leptinotarsa decemlineata*,Transcriptome," PLoS One, 9(1):e86012 (2014).
Lintala et al., "*Arabidopsis* TiC62 Trol Mutant Lacking Thylakoid-Bound Ferredoxin-NADP+ Oxidoreductase Shows Distinct Metabolic Phenotype," *Molecular Plant* 7(1):45-57 (2014).
Liu, "The Transformation of Nucleic Acid Degradants in Plants," China Organic Fertilizers, Agriculture Press, ISBN: 7-1091634 (1991) (with English translation).
Liu, "Calmodulin and Cell Cycle," Foreign Medical Sciences Section of Pathophysiology and Clinical Medicine, 18(4):322-324 (1998).
Liu, "Confocal laser scanning microscopy—an attractive tool for studying the uptake of xenobiotics into plant foliage," *Journal of Microscopy*, 213(pt 2):87-93 (2004).
Lloyd et al. "A Comprehensive Dataset of Genes with a Loss of Function Mutant Phenotype in *Arabidopsis*," *Plant Physiology* 158:1115-1129 (2012).
Lodish et al., Molecular Cell Biology, Fourth Edition, p. 210 (2000).
Lucas et al., "Plasmodesmata—bridging the gap between neighboring plant cells," Trends in Cell Biology, 19:495-503 (2009).
Morozov et al., "Evaluation of Preemergence Herbicides for Control of Diclofop-resistant Italian Ryegrass (*Lolium multiflorum*) in Virginia," Virginia Polytechnic Institute and State University, pp. 43-71 (2004).
Nemeth, "Virus, mycoplasma and rickettsia diseases of fruit trees," Martinus Nijhoff Publishers, 197 -204 (1986).
N-TER Nanoparticle siRNA, Sigma Aldrich TM website, Web. Nov. 20, 2018 <https://www.sigmaaldrich.com/life-science/custom-oligos/sirna-oligos/n-ter-nanoparticle.html>.
Office Action dated Sep. 20, 2018, in Chilean Patent Application No. 201601440 (with English translation).
Partial European Search Report dated Jun. 29, 2018, in European Patent Application No. 18157745.3.
Pratt et al., "Sorghum Expressed Sequence Tags Identify Signature Genes for Drought, Pathogenesis, and Skotomorphogenesis from a Milestone Set of 16,801 Unique Transcripts," *Plant Physiology*, 139:869-884 (2005).
Rudolf et al., "In Vivo Function of Tic22, a Protein Import Component of the Intermembrane Space of Chloroplasts," 6(3):817-829 (2013).

(56) References Cited

OTHER PUBLICATIONS

Schönherr et al., "Size selectivity of aqueous pores in astomatous cuticular membranes isolated from *Populus canescens* (Aiton) Sm. Leaves," Planta, 219:405-411 (2004).
Simeoni et al., "Insight into the mechanism of the peptide-based gene delivery system MPG: implications for delivery of siRNA into mammalian cells," *Nucleic Acids Research*, 31(10:2717-2724 (2003).
Sommer et al., "Toc33 and Toc64-III cooperate in precursor protein import into the chloroplasts of *Arabidopsis thaliana*," *Plant, Cell and Environment*, 970-983 (2013).
Tice, "Selecting the right compounds for screening: does Lipinski's Rule of 5 for pharmaceuticals apply to agrochemicals?" *Pest Management Science*, 57(1):3-16 (2001).
Troesch et al., "The Stromal Processing Peptidase of Chloroplasts is Essential in *Arabidopsis*, with Knockout Mutations Causing Embryo Arrest After the 16-Cell Stage," *PLos One*, 6(8) 1-9 (2011).
Watson et al., "RNA silencing platforms in plants," *FEBS Letters*, 579:5982-5987 (2005).
Yan et al., Seed Science, China Agriculture Press, pp. 101-103, Tables 2-37 (2001).
Yu et al., "Diversity of Acetyl-Coenzyme A Carboxylase Mutations in Resistant Lolium Populations: Evaluation Using Clethodim," *Plant Physiology*, 145:547-558 (2007).
Yu et al., "Glyphosate, paraquat and ACCase multiple herbicide resistance evolved in a *Lolium rigidum* biotype," *Planta*, 225:499-513 (2007).
Zabkiewicz, "Adjuvants and herbicidal efficacy—present status and future prospects," *Weed Research*, 40:139-149 (2000).
Zhao et al., "Ps0r1, a potential target for RNA interference-based pest management," *Insect Molecular Biology*, 20(1):97-104 (2011).
Zhao et al., "Vegetable Standardized Production Technology," Hangzhou: Zhejiang Science and Technology Press, p. 19 (2008).

* cited by examiner

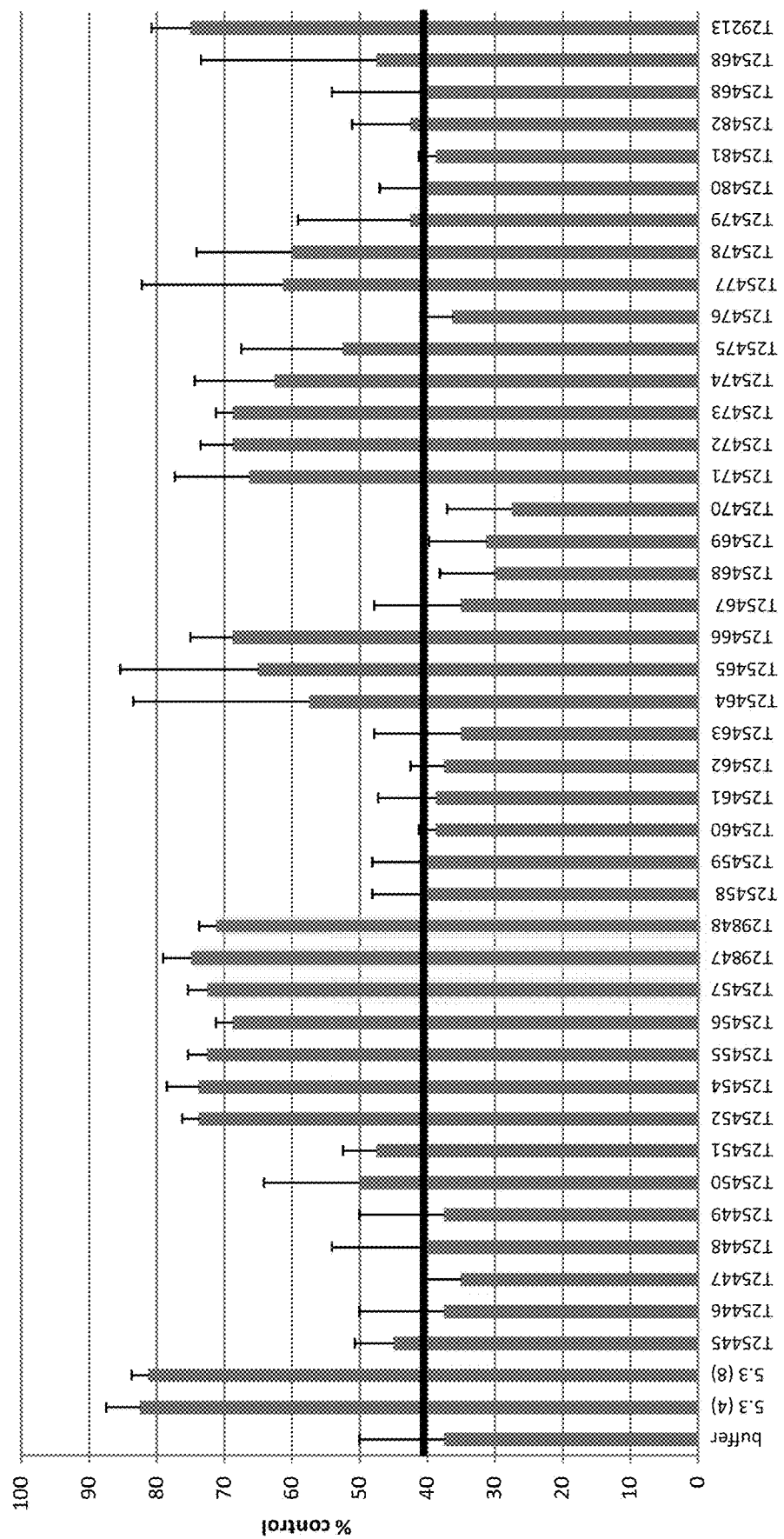

METHODS AND COMPOSITIONS FOR WEED CONTROL

CROSS REFERENCE TO RELATED APPLICATIONS

This application claims the benefit of U.S. Provisional Patent Application No. 61/787,620, filed Mar. 15, 2013, which is incorporated herein by reference in its entirety.

INCORPORATION OF THE SEQUENCE LISTING

This application contains a sequence listing, submitted herewith electronically via EFS web, containing the file named "P34108US01_seqlist.txt" which is 3,451,542 bytes in size (measured in Windows XP), which was created on Mar. 6, 2014, and which is herein incorporated by reference in its entirety.

FIELD OF THE INVENTION

The present disclosure relates generally to the field of weed management. More specifically, compositions containing polynucleotide molecules for altering the physiology of plants and modulating the effect of herbicide treatment are described. Further provided are methods and compositions useful for weed control.

BACKGROUND OF THE INVENTION

Weeds are plants that compete with cultivated plants in an agronomic environment and cost farmers billions of dollars annually in crop losses and the expense of efforts to keep weeds under control. Weeds also serve as hosts for crop diseases and insect pests. The losses caused by weeds in agricultural production environments include decreases in crop yield, reduced crop quality, increased irrigation costs, increased harvesting costs, reduced land value, injury to livestock, and crop damage from insects and diseases harbored by the weeds. The principal means by which weeds cause these effects are: 1) competing with crop plants for water, nutrients, sunlight and other essentials for growth and development, 2) production of toxic or irritant chemicals that cause human or animal health problem, 3) production of immense quantities of seed or vegetative reproductive parts or both that contaminate agricultural products and perpetuate the species in agricultural lands, and 4) production on agricultural and nonagricultural lands of vast amounts of vegetation that must be disposed of Herbicide tolerant weeds are a problem with nearly all herbicides in use, there is a need to effectively manage these weeds. There are over 365 weed biotypes currently identified as being herbicide resistant to one or more herbicides by the Herbicide Resistance Action Committee (HRAC), the North American Herbicide Resistance Action Committee (NAHRAC), and the Weed Science Society of America (WSSA).

Plants have chloroplasts in which nuclear encoded proteins are imported. The import function is a key process related to the normal activity of the chloroplast. Genes associated with the chloroplast protein import and processing include but are not limited to the structural genes that encode for translocon at the outer envelope membrane of a chloroplast (Toc), a translocon at the inner envelope membrane of a chloroplast (Tic), a stroma processing peptidase (SPP) and chaperone like proteins associated with the chloroplast protein import system. The import of essential proteins into the chloroplast can be achieved by modulating the level of import proteins produced by the plants nuclear encoded genes. Many enzymes that are targets for herbicide action are nuclear encoded and imported into the chloroplast.

Embodiments of the present invention provide polynucleotide compositions useful for modulating gene expression in a plant, in particular, weedy plants for the purpose of enhancing control of the weeds in an agronomic environment and for the management of herbicide resistant weeds.

SUMMARY OF THE INVENTION

Several embodiments relate to a method of plant control comprising treating a plant or a part of a plant in need of control with a herbicidal composition comprising a polynucleotide, an organosilicone surfactant and a non-polynucleotide herbicide, wherein the polynucleotide is essentially identical or essentially complementary to a segment of a gene polynucleotide sequence, wherein the protein encoded by the gene coding sequence is a component of a chloroplast protein import system selected from the group consisting of a translocon at the outer envelope membrane of a chloroplast (Toc), a translocon at the inner envelope membrane of a chloroplast (Tic), a stroma processing peptidase (SPP), and chaperone like proteins associated with the chloroplast protein import system, wherein said treated plant is more sensitive to the non-polynucleotide herbicide contained in the herbicidal composition relative to a similar plant treated with a herbicidal composition not containing the polynucleotide.

The polynucleotide alters the rate or activity of importation of proteins or processing of the proteins in a plant cell chloroplast or plastid thereby providing to the plant increased sensitivity to a herbicide. Chloroplast protein import and processing, chloroplast metabolism pathways, chlorophyll function proteins that are provided by genes encoded in the plant nucleus are key in the normal physiology of the plant and in the plant's response to chemical stress, such as, the action of a herbicide or provide proteins and enzymes whose activity is inhibited by a herbicide. Representative weed target gene sequences are aspects of the invention, these include but are not limited to Toc159 (SEQ ID NO: 1-117), Toc 33 (SEQ ID NO:118-155), Toc34 (SEQ ID NO: 156-247), Toc75 (SEQ ID NO: 248-348), OEP80 (349-485), Toc132 (SEQ ID NO: 486-569), Toc64 (SEQ ID NO: 1628-1638), Tic 110 (SEQ ID NO: 570-722), Tic20 (SEQ ID NO:723-771), Tic21 (SEQ ID NO: 772-840), Tic40 (SEQ ID NO: 841-912), Stroma processing peptidase (SPP) (SEQ ID NO: 913-1130), Tic100 (SEQ ID NO: 1131-1207), Tic56 (SEQ ID NO: 1208-1263), Tic22 (SEQ ID NO: 1609-1615), Tic55 (SEQ ID NO: 1616-1623), Tic62 (SEQ ID NO: 1624-1627), and chloroplast protein import system chaperone proteins, for example HSP93 (SEQ ID NO: 1596-1608) and HSP70 (SEQ ID NO: 1584-1595).

Several embodiments relate to a composition comprising a polynucleotide molecule of at least 19 contiguous nucleotides and at least 85 percent identical to a portion of a gene sequence encoding a plant chloroplast import protein and an organosilicone composition or compound. The polynucleotide fragment can be sense or anti-sense ssDNA or ssRNA, dsRNA, or dsDNA, or dsDNA/RNA hybrids and are herein referred to as "chloroplast protein import system trigger polynucleotides". Representative trigger polynucleotide sequences of chloroplast import protein system genes include but are not limited to those polynucleotides illustrated in Tables 2, 3, 5 and 6 and are aspects of the invention.

Several embodiments relate to a herbicidal composition further comprising any combination of two or more of said polynucleotides wherein at least one is a polynucleotide essentially identical or essentially complementary to a segment of a gene polynucleotide sequence, wherein the protein encoded by the gene coding sequence is a component of a chloroplast protein import system selected from the group consisting of a translocon at the outer envelope membrane of a chloroplast (Toc), a translocon at the inner envelope membrane of a chloroplast (Tic), a stroma processing peptidase (SPP), a chaperone like protein, and another is a polynucleotide essentially identical or essentially complementary to a segment of a herbicide target protein polynucleotide gene sequence, wherein the gene sequence encoding a herbicide target protein or a herbicide detoxifying enzyme is selected from the group consisting of 5-enolpyruvylshikimate-3-phosphate synthase (EPSPS), an acetohydroxyacid synthase or an acetolactate synthase (ALS), an acetyl-coenzyme A carboxylase (ACCase), a dihydropteroate synthase, a phytoene desaturase (PDS), a protoporphyrin IX oxygenase (PPO), a hydroxyphenylpyruvate dioxygenase (HPPD), a para-aminobenzoate synthase, a glutamine synthase (GS), a glufosinate-tolerant glutamine synthase, a 1-deoxy-D-xylulose 5-phosphate (DOXP) synthase, a dihydropteroate (DHP) synthase, a phenylalanine ammonia lyase (PAL), a glutathione S-transferase (GST), a D1 protein of photosystem II, a mono-oxygenase, a cytochrome P450, a cellulose synthase, a beta-tubulin, and a serine hydroxymethyltransferase.

The composition can include one or more polynucleotide fragment essentially identical or essentially complementary to a portion of a chloroplast import protein or import processing enzyme gene polynucleotide and one or more non-polynucleotide herbicides, for example, a herbicide that can include but not limited to the members of amide herbicides, aromatic acid herbicides, arsenical herbicides, benzothiazole herbicides, benzoylcyclohexanedione herbicides, benzofuranyl alkylsulfonate herbicides, carbamate herbicides, cyclohexene oxime herbicides, cyclopropylisoxazole herbicides, dicarboximide herbicides, dinitroaniline herbicides, dinitrophenol herbicides, diphenyl ether herbicides, dithiocarbamate herbicides, halogenated aliphatic herbicides, imidazolinone herbicides, inorganic herbicides, nitrile herbicides, organophosphorus herbicides, oxadiazolone herbicides, oxazole herbicides, phenoxy herbicides, phenylenediamine herbicides, pyrazole herbicides, pyridazine herbicides, pyridazinone herbicides, pyridine herbicides, pyrimidinediamine herbicides, pyrimidinyloxybenzylamine herbicides, pyrimidinylthio-benzoate herbicides, quaternary ammonium herbicides, thiocarbamate herbicides, thiocarbonate herbicides, thiourea herbicides, triazine herbicides, triazinone herbicides, triazole herbicides, triazolone herbicides, triazolopyrimidine herbicides, uracil herbicides, and urea herbicides.

In some embodiments, a polynucleotide molecule containing composition as described herein may be applied before, concurrent with, or after the treatment of the plant with one or more herbicidal compounds to provide control of unwanted plants in a field of cultivated plants.

BRIEF DESCRIPTION OF THE FIGURES

The following drawings form part of the present specification and are included to further demonstrate certain embodiments described herein. Some embodiments may be better understood by reference to one or more of these drawings in combination with the detailed description presented herein. Some embodiments can be more fully understood from the following description of the FIGURES:

FIG. 1. Treatment of *Amaranthus palmeri* with dsRNA trigger polynucleotides targeting OEP80.

DETAILED DESCRIPTION

Several embodiments relate to methods and compositions containing a polynucleotide that provide for regulation and/or modulation of plant chloroplast protein import system or import processing enzyme genes, for example, including but not limited Toc159, Toc 33, Toc34, Toc75 OEP80, Toc132, Tic 110, Tic20, Tic21, Tic40, Tic100, Tic56, Toc64, Tic22, Tic55, Tic62, stroma processing peptidase and chloroplast protein import system chaperone proteins, for example Hsp93 and Hsp70.

Chloroplasts have to import more than 95 percent of their protein complement post-translationally from the cytosol. The vast majority of chloroplast proteins are synthesized as precursor proteins (preproteins) in the cytosol and are imported post-translationally into the organelle. Most proteins that are destined for the thylakoid membrane, the stroma and the inner envelope are synthesized with an amino-terminal extension called a presequence, or transit sequence, which is proteolytically removed after import. Preproteins that contain a cleavable transit peptide are recognized in a GTP-regulated manner by receptors of the outer-envelope translocon, which is called the TOC complex. The preproteins cross the outer envelope through an aqueous pore and are then transferred to the translocon in the inner envelope, which is called the TIC complex. The TOC and TIC translocons function together during the translocation process. Completion of import requires energy, which probably comes from the ATP-dependent functioning of molecular chaperones in the stroma. The stromal processing peptidase then cleaves the transit sequence to produce the mature form of the protein, which can fold into its native form. Plant gene polynucleotide sequences regulating the expression or encoding the enzymes involved in the chloroplast protein import system of target weed species are illustrated in SEQ ID NO: 1-1263 and SEQ ID NO: 1584-1638. Representative polynucleotide trigger molecules that are homologous or complementary to a segment of a chloroplast protein import system gene are illustrated in Table 2 (SEQ ID NO: 1264-1483), Table 3 (SEQ ID NO: 1483-1534), Table 5 (SEQ ID NO: 1535-1573) and Table 6 (SEQ ID NO: 1574-1583). The treatment of plants with one or more of the trigger polynucleotides enhances plant sensitivity to one or more chemical herbicides.

Chloroplasts are critical organelles to the plant. Not only are they the centers for photosynthesis, but amino acids, lipid components and fatty acids of the cell membranes are synthesized by chloroplasts and they reduce nitrogen into ammonia and other organic compounds.

Aspects of the method can be applied to manage various weedy plants in agronomic and other cultivated environments.

The following definitions and methods are provided to better define the present embodiments and to guide those of ordinary skill in the art in the practice of the embodiments described herein. Unless otherwise noted, terms are to be understood according to conventional usage by those of ordinary skill in the relevant art. Where a term is provided in the singular, the inventors also contemplate embodiments described by the plural of that term.

Weedy plants are plants that compete with cultivated plants, those of particular importance include, but are not limited to important invasive and noxious weeds and herbicide resistant biotypes in crop production, for example, *Amaranthus* species—*A. albus, A. blitoides, A. hybridus, A. palmeri, A. powellii, A. retroflexus, A. spinosus, A. tuberculatus,* and *A. viridis; Ambrosia* species—*A. trifida, A. artemisifolia;* Lolium species—*L. multiflorum, L. rigidium, L perenne; Digitaria* species—*D. insularis; Euphorbia* species—*E. heterophylla; Kochia* species—*K. scoparia; Sorghum* species—*S. halepense; Conyza* species—*C. bonariensis, C. canadensis, C. sumatrensis; Chloris* species—*C. truncate; Echinochola* species—*E. colona, E. crus-galli; Eleusine* species—*E. indica; Poa* species—*P. annua; Plantago* species—*P. lanceolata; Avena* species—*A. fatua; Chenopodium* species—*C. album; Setaria* species—*S. viridis; Abutilon* species—*A. theophrasti, Ipomoea* species *Sesbania,* species, *Cassia* species, *Sida* species, *Brachiaria,* species and *Solanum* species.

Additional weedy plant species found in cultivated areas include *Alopecurus myosuroides, Avena sterilis, Avena sterilis ludoviciana, Brachiaria plantaginea, Bromus diandrus, Bromus rigidus, Cynosurus echinatus, Digitaria ciliaris, Digitaria ischaemum, Digitaria sanguinalis, Echinochloa oryzicola, Echinochloa phyllopogon, Eriochloa punctata, Hordeum glaucum, Hordeum leporinum, Ischaemum rugosum, Leptochloa chinensis, Lolium persicum, Phalaris minor, Phalaris paradoxa, Rottboellia exalta, Setaria faberi, Setaria viridis var, robusta-alba schreiber, Setaria viridis var, robusta-purpurea, Snowdenia polystachea, Sorghum sudanese, Alisma plantago-aquatica, Amaranthus lividus, Amaranthus quitensis, Ammania auriculata, Ammania coccinea, Anthemis cotula, Apera spica-venti, Bacopa rotundifolia, Bidens pilosa, Bidens subalternans, Brassica tournefortii, Bromus tectorum, Camelina microcarpa, Chrysanthemum coronarium, Cuscuta campestris, Cyperus difformis, Damasonium minus, Descurainia sophia, Diplotaxis tenuifolia, Echium plantagineum, Elatine triandra* var, *pedicellata, Euphorbia heterophylla, Fallopia convolvulus, Fimbristylis miliacea, Galeopsis tetrahit, Galium spurium, Helianthus annuus, Iva xanthifolia, Ixophorus unisetus, Ipomoea indica, Ipomoea purpurea, Ipomoea sepiaria, Ipomoea aquatic, Ipomoea triloba, Lactuca serriola, Limnocharis flava, Limnophila erecta, Limnophila sessiliflora, Lindernia dubia, Lindernia dubia* var, *major, Lindernia micrantha, Lindernia procumbens, Mesembryanthemum crystallinum, Monochoria korsakowii, Monochoria vaginalis, Neslia paniculata, Papaver rhoeas, Parthenium hysterophores, Pentzia suffruticosa, Phalaris minor, Raphanus raphanistrum, Raphanus sativus, Rapistrum rugosum, Rotala indica* var, *uliginosa, Sagittaria guyanensis, Sagittaria montevidensis, Sagittaria pygmaea, Salsola iberica, Scirpus juncoides* var, *ohwianus, Scirpus mucronatus, Setaria lutescens, Sida spinosa, Sinapis arvensis, Sisymbrium orientale, Sisymbrium thellungii, Solanum ptycanthum, Sonchus asper, Sonchus oleraceus, Sorghum bicolor, Stellaria media, Thlaspi arvense, Xanthium strumarium, Arctotheca calendula, Conyza sumatrensis, Crassocephalum crepidiodes, Cuphea carthagenesis, Epilobium adenocaulon, Erigeron philadelphicus, Landoltia punctata, Lepidium virginicum, Monochoria korsakowii, Solanum americanum, Solanum nigrum, Vulpia bromoides, Youngia japonica, Hydrilla verticillata, Carduus nutans, Carduus pycnocephalus, Centaurea solstitialis, Cirsium arvense, Commelina diffusa, Convolvulus arvensis, Daucus carota, Digitaria ischaemum, Echinochloa crus-pavonis, Fimbristylis miliacea, Galeopsis tetrahit, Galium spurium, Limnophila erecta, Matricaria perforate, Papaver rhoeas, Ranunculus acris, Soliva sessilis, Sphenoclea zeylanica, Stellaria media, Nassella trichotoma, Stipa neesiana, Agrostis stolonifera, Polygonum aviculare, Alopecurus japonicus, Beckmannia syzigachne, Bromus tectorum, Chloris inflate, Echinochloa erecta, Portulaca oleracea,* and *Senecio vulgaris.* All plants contain chloroplast import protein system genes, the sequence of which can be isolated and polynucleotides selected according to the methods described herein that are useful for altering the physiology of the plant and making the plant more sensitive to a herbicide.

Numerous chemical herbicide, herein referred to as non-polynucleotide herbicides, are available that can be added to the composition that provide multi-species weed control or alternative modes of action for difficult to control weed species, for example, members of the herbicide families that include but are not limited to 1,5-Diarylpyrazole herbicides, 2-Thiopyrimidine herbicides, 3-CF3-Benzene herbicides, Acetamide herbicides, Amide herbicides, Aminoacrylate herbicides, Aminotriazine herbicides, Aromatic acid herbicides, Arsenical herbicides, Arylaminopropionic acid herbicides, Arylcarboxamide herbicides, Arylcyclodione herbicides, Aryloxyphenoxy-propionate herbicides, Azolecarboxamide herbicides, Azoloazinone herbicides, Azolotriazine herbicides, Benzamide herbicides, Benzenesulfonamide herbicides, Benzhydryl herbicides, Benzimidazole herbicides, Benzofuran herbicides, Benzofuranyl Alkylsulfonate herbicides, Benzohydrazide herbicides, Benzoic acid herbicides, Benzophenylmethanone herbicides, Benzothiadiazinone herbicides, Benzothiazole herbicides, Benzothiazoleacetate herbicides, Benzoxazole herbicides, Benzoylcyclohexanedione herbicides, Benzyloxymethylisoxazole herbicides, Benzylpyrazole herbicides, Benzylpyridine herbicides, Benzylpyrimidone herbicides, Bipyridylium herbicides, Carbamate herbicides, Chloroacetamide herbicides, Chloroacetamide herbicides, Chlorocarbonic acid herbicides, Cyclohexanedione herbicides, Cyclohexene oxime herbicides, Cyclopropylisoxazole herbicides, Diarylether herbicides, Dicarboximide herbicides, Dihydropyrancarboxamide herbicides, Diketo-epoxide herbicides, Diketopiperazine herbicides, Dinitroaniline herbicides, Dinitrophenol herbicides, Diphenylether herbicides, Diphenylfuranone herbicides, Dithiocarbamate herbicides, Fluoroalkene herbicides, Glyphosate herbicides, Halogenated aliphatic herbicides, Hydantocidin herbicides, Hydroxypyrazole herbicides, Imidazolinone herbicides, Indazole herbicides, Indenedione herbicides, Inorganic herbicides, Isoxazole herbicides, Isoxazolesulfone herbicides, Isoxazolidinone herbicides, Nicotinohydrazide herbicides, Nitrile herbicides, Nitrile-amide herbicides, Nitropyrazole herbicides, N-phenylphthalimide herbicides, Organoarsenical herbicides, Organophosphates herbicides, Organophosphorus herbicides, Oxabicycloheptane herbicides, Oxadiazole herbicides, Oxadiazolebenzamide herbicides, Oxadiazolone herbicides, Oxazole herbicides, Oxazolidinedione herbicides, Oxyacetamide herbicides, Phenoxy herbicides, Phenoxyalkyne herbicides, Phenoxycarboxylic acid herbicides, Phenoxypyridazinol herbicides, Phenylalkanoate herbicides, Phenylcarbamate herbicides, Phenylenediamine herbicides, Phenylethylurea herbicides, Phenylimidazole herbicides, Phenylisoxazole herbicides, Phenylpyrazole herbicides, Phenylpyrazoline herbicides, Phenylpyridazine herbicides, Phenylpyridine herbicides, Phenylpyrrolidone herbicides, Phosphinic acid herbicides, Phosphonate herbicides, Phosphoroamidate herbicides, Phosphorodithioate herbicides, Phthalamate herbicides, Propionamide herbicides, Pyrazole herbicides, Pyrazole-arylether herbicides, Pyrazolium herbicides, Pyridazine herbicides, Pyridazinone herbicides, Pyridine herbicides, Pyridinecarboxamide herbicides, Pyridinecarboxylic acid herbicides, Pyridinone herbicides, Pyridyl-benzylamide herbicides, Pyridyl-ether-carboxamide herbicides, Pyrimidinecarboxylic acid herbicides, Pyrimidinediamine herbicides, Pyrimidinedione herbicides, Pyrimidinetrione herbicides, Pyrimidinone herbicides, Pyrimidinyl(thio)benzoate herbicides, Pyrimidinyloxybenzylamine herbicides, Pyrimidylmethanol herbicides, Pyrrolidone herbicides, Quaternary Ammonium herbicides, Quinoline-carboxylic acid herbicides, Quinoxaline herbicides, Semicarbazone herbicides, Sulfonamide herbicides, Sulfonylamino-carbonyl-triazolinone herbicides, Sulfonylurea herbicides, Sulfonylurea herbicides, Tetrazolinone herbicides, Thiadiazole herbicides, Thiatriazine herbicides, Thienopyrimidine herbicides, Thiocarbamate herbicides, Thiocarbonate herbicides, Thiourea herbicides, Tolyltriazole herbicides, Triazine herbicides, Triazinedione herbicides, Triazine-sulfonanilide herbicides, Triazinone herbicides, Triazole herbicides, Triazolecarboxamide herbicides, Triazoleimine herbicides, Triazolinone herbicides, Triazolone herbicides, Triazolopyrimidine herbicides, Triketone herbicides, Uracil herbicides, and Urea herbicides. In particular, the rates of use of the added herbicides can be reduced in compositions comprising polynucleotides as described herein. Use rate reductions of the additional added herbicides can be 10-25 percent, 26-50 percent, 51-75 percent or more can be achieved that enhance the activity of the polynucleotides and herbicide composition and is contemplated as an aspect of the invention.

Additional herbicidal compounds of unspecified modes of action as described in CN101279950A, CN101279951A, DE10000600A1, DE10116399A1, DE102004054666A1, DE102005014638A1, DE102005014906A1, DE102007012168A1, DE102010042866A1, DE10204951A1, DE10234875A1, DE10234876A1, DE10256353A1, DE10256354A1, DE10256367A1, EP1157991A2, EP1238586A1, EP2147919A1, EP2160098A2, JP03968012B2, JP2001253874A, JP2002080454A, JP2002138075A, JP2002145707A, JP2002220389A, JP2003064059A, JP2003096059A, JP2004051628A, JP2004107228A, JP2005008583A, JP2005239675A, JP2005314407A, JP2006232824A, JP2006282552A, JP2007153847A, JP2007161701A, JP2007182404A, JP2008074840A, JP2008074991A, JP2008133207A, JP2008133218A, JP2008169121A, JP2009067739A, JP2009114128A, JP2009126792A, JP2009137851A, US20060111241A1, US20090036311A1, US20090054240A1, US20090215628A1, US20100099561A1, US20100152443A1, US20110105329A1, US20110201501A1, WO2001055066A2, WO2001056975A1, WO2001056979A1, WO2001090071A2, WO2001090080A1, WO2002002540A1, WO2002028182A1, WO2002040473A1, WO2002044173A2, WO2003000679A2, WO2003006422A1, WO2003013247A1, WO2003016308A1, WO2003020704A1, WO2003022051A1, WO2003022831A1, WO2003022843A1, WO2003029243A2, WO2003037085A1, WO2003037878A1, WO2003045878A2, WO2003050087A2, WO2003051823A1, WO2003051824A1, WO2003051846A2, WO2003076409A1, WO2003087067A1, WO2003090539A1, WO2003091217A1, WO2003093269A2, WO2003104206A2, WO2004002947A1, WO2004002981A2, WO2004011429A1, WO2004029060A1, WO2004035545A2, WO2004035563A1, WO2004035564A1, WO2004037787A1, WO2004067518A1, WO2004067527A1, WO2004077950A1, WO2005000824A1, WO2005007627A1, WO2005040152A1, WO2005047233A1, WO2005047281A1, WO2005061443A2, WO2005061464A1, WO2005068434A1, WO2005070889A1, WO2005089551A1, WO2005095335A1, WO2006006569A1, WO2006024820A1, WO2006029828A1, WO2006029829A1, WO2006037945A1, WO2006050803A1, WO2006090792A1, WO2006123088A2, WO2006125687A1, WO2006125688A1, WO2007003294A1, WO2007026834A1, WO2007071900A1, WO2007077201A1, WO2007077247A1, WO2007096576A1, WO2007119434A1, WO2007134984A1, WO2008009908A1, WO2008029084A1, WO2008059948A1, WO2008071918A1, WO2008074991A1, WO2008084073A1, WO2008100426A2, WO2008102908A1, WO2008152072A2, WO2008152073A2, WO2009000757A1, WO2009005297A2, WO2009035150A2, WO2009063180A1, WO2009068170A2, WO2009068171A2, WO2009086041A1, WO2009090401A2, WO2009090402A2, WO2009115788A1, WO2009116558A1, WO2009152995A1, WO2009158258A1, WO2010012649A1, WO2010012649A1, WO2010026989A1, WO2010034153A1, WO2010049270A1, WO2010049369A1, WO2010049405A1, WO2010049414A1, WO2010063422A1, WO2010069802A1, WO2010078906A2, WO2010078912A1, WO2010104217A1, WO2010108611A1, WO2010112826A3, WO2010116122A3, WO2010119906A1, WO2010130970A1, WO2011003776A2, WO2011035874A1, WO2011065451A1, the chemical compositions of which are herein incorporated by reference are useful to include in combination with polynucleotides targeting the plant chloroplast import protein or import processing enzyme genes.

In some embodiments, the composition includes a non-polynucleotide herbicide component such as glyphosate (N-phosphonomethylglycine) herbicide inhibits the shikimic acid pathway which leads to the biosynthesis of aromatic compounds including amino acids, plant hormones and vitamins. Specifically, glyphosate curbs the conversion of phosphoenolpyruvic acid (PEP) and 3-phosphoshikimic acid to 5-enolpyruvyl-3-phosphoshikimic acid by inhibiting the enzyme 5-enolpyruvylshikimate-3-phosphate synthase (hereinafter referred to as EPSP synthase or EPSPS). As used herein, the term "glyphosate" should be considered to include any herbicidally effective form of N-phosphonomethylglycine (including any salt thereof) and other forms which result in the production of the glyphosate anion in planta. Glyphosate is an example of an EPSPS inhibitor herbicide. Herbicides are molecules that affect plant growth or development or reproductive ability. Glyphosate is commercially available in numerous formulations. Examples of these formulations of glyphosate include, without limitation, those sold by Monsanto Company (St Louis, Mo.) as ROUNDUP®, ROUNDUP® ULTRA, ROUNDUP®ULTRAMAX, ROUNDUP®CT, ROUNDUP®EXTRA, ROUNDUP®BIACTIVE, ROUNDUP®BIOFORCE, RODEO®, POLARIS®, SPARK® and ACCORD®. herbicides, all of which contain glyphosate as its isopropylammonium salt, ROUNDUP® WEATHERMAX containing glyphosate as its potassium salt; ROUNDUP® DRY and RIVAL® herbicides, which contain glyphosate as its ammonium salt; ROUNDUP® GEOFORCE, which contains glyphosate as its sodium salt; and TOUCHDOWN® herbicide (Syngenta, Greensboro, N.C.), which contains glyphosate as its trimethylsulfonium salt or monopotassium salt. Various other salts of glyphosate are available for example, dimethylamine salt, isopropylamine salt, trimesium salt, potassium salt, monoammonium salt, and diammonium salt.

In some embodiments, the composition may include a nonpolynucleotide herebicide component that is an acetolactate synthase (ALS) inhibitor herbicide which includes but are not limited to amidosulfuron, azimsulfuron, bensulfuron-methyl, chlorimuron-ethyl, chlorsulfuron, cinosulfuron, cyclosulfamuron, ethametsulfuron-methyl, ethoxysulfuron, flazasulfuron, flupyrsulfuron-methyl-Na, foramsulfuron, halosulfuron-methyl, imazosulfuron, iodosulfuron, metsulfuron-methyl, nicosulfuron, oxasulfuron, primisulfuron-methyl, prosulfuron, pyrazosulfuron-ethyl, rimsulfuron, sulfometuron-methyl, sulfosulfuron, thifensulfuron-methyl, triasulfuron, tribenuron-methyl, trifloxysulfuron, triflusulfuron-methyl, tritosulfuron, imazapic, imazamethabenz-methyl, imazamox, imazapyr, imazaquin, imazethapyr, cloransulam-methyl, diclosulam, florasulam, flumetsulam, metosulam, bispyribac-Na, pyribenzoxim, pyriftalid, pyrithiobac-Na, pyriminobac-methyl, flucarbazone-Na, and procarbazone-Na.

In some embodiments, the composition may include a nonpolynucleotide herbicide component that is an acetyl-CoA carboxylase (ACCase) inhibitor herbicide, which include members of the chemical families of aryloxyphenoxypropionates, cyclohexanediones and phenylpyrazoline that include, but are not limited to an aryloxyphenoxypropionate comprising clodinafop (Propanoic acid, 2-[4-[(5-chloro-3-fluoro-2-pyridinyl)oxy]phenoxy]-,2-propynyl ester, (2R)), cyhalofop (butyl(2R)-2-[4-(4-cyano-2-fluorophenoxy)phenoxy]propionate), diclofop (methyl 2-[4-(2,4-dichlorophenoxy)phenoxy]propanoate), fenoxaprop (ethyl (R)-2-[4-(6-chloro-1,3-benzoxazol-2-yloxy)phenoxy]propionate), fluazifop (2R)-2-[4-[[5-(trifluoromethyl)-2-pyridinyl]oxy]phenoxy]propanoic acid), haloxyfop (2-[4-[[3-chloro-5-(trifluoromethyl)-2-pyridinyl]oxy]phenoxy] propanoic acid), propaquizafop (2-[[(1-methylethylidene) amino]oxy]ethyl(2R)-2-[4-[(6-chloro-2quinoxalinyl)oxy] phenoxy]propanoate) and quizalofop (2R)-2-[4-[(6-chloro-2-quinoxalinyl)oxy]phenoxy]propanoic acid; a cyclohexanedione comprising alloxydim (methyl 2,2-dimethyl-4,6-dioxo-5-[(1E)-1-[(2-propen-1-yloxy)imino]butyl] cyclohexanecarboxylate), butroxydim (2-[1-(ethoxyimino) propyl]-3-hydroxy-5-[2,4,6-trimethyl-3-(1-oxobutyl) phenyl]-2-cyclohexen-1-one), clethodim (2-[1-[[[(2E)-3-chloro-2-propen-1-yl]oxy]imino]propyl]-5-[2-(ethylthio) propyl]-3-hydroxy-2-cyclohexen-1-one), cycloxydim (2-[1-(ethoxyimino)butyl]-3-hydroxy-5-(tetrahydro-2H-thiopyran-3-yl)-2-cyclohexen-1-one), profoxydim (2-[1-[[2-(4-chlorophenoxy)propoxy]imino]butyl]-3-hydroxy-5-(tetrahydro-2H-thiopyran-3-yl)-2-cyclohexen-1-one), sethoxydim (2-[1-(ethoxyimino)butyl]-5-[2-(ethylthio)propyl]-3-hydroxy-2-cyclohexen-1-one), tepraloxydim (2-[1-[[[(2E)-3-chloro-2-propen-1-yl]oxy]imino]propyl]-3-hydroxy-5-(tetrahydro-2H-pyran-4-yl)-2-cyclohexen-1-one) and tralkoxydim (2-[1-(ethoxyimino)propyl]-3-hydroxy-5-(2,4,6-trimethylphenyl)-2-cyclohexen-1-one); a phenylpyrazoline comprising pinoxaden (8-(2,6-diethyl-4-methylphenyl)-1,2,4,5-tetrahydro-7-oxo-7H-pyrazolo[1,2-d][1,4,5] oxadiazepin-9-yl 2,2-dimethylpropanoate).

In some embodiments, the composition may include a nonpolynucleoide herbicide component that is an hydroxyphenyl-pyruvate-dioxygenase (HPPD) inhibitor herbicide which includes but are not limited to Triketones, such as, mesotrione, tefuryltrione, tembotrione, and sulcotrione; Isoxazoles, such as, isoxachlortole, pyrasulfotole, and isoxaflutole; Pyrazoles, such as, benzofenap, pyrazolynate, topramezone and pyrazoxyfen. Additional HPPD inhibitors include benzobicyclon and bicyclopyrone, In some embodiments, the composition may include a nonpolynucleoide herbicide component that is a glutamine synthetase (GS) inhibitor herbicide, which include members of the Phosphinic acids herbicide group such as glufosinate-ammonium and bialaphos.

In some embodiments, the composition may include a nonpolynucleotide herbicide component that is an phytoene desaturase (PDS) inhibitor herbicide, which include but are not limited to norflurazon, diflufenican, picolinafen, beflubutamid, fluridone, flurochloridone and flurtamone.

In some embodiments, the composition may include a nonpolynucleotide herbicide component that is an protoporphyrinogen IX oxidase (PPG oxidas) inhibitor herbicide, which include but is not limited to acifluorfen-Na, bifenox, chlomethoxyfen, fluoroglycofen-ethyl, fomesafen, halosafen, lactofen, oxyfluorfen, fluazolate, pyraflufen-ethyl, cinidon-ethyl, flumioxazin, flumiclorac-pentyl, fluthiacet-methyl, thidiazimin, oxadiazon, oxadiargyl, azafenidin, carfentrazone-ethyl, sulfentrazone, pentoxazone, benzfendizone, butafenacil, pyrazogyl, and profluazol.

In some embodiments, the composition may include a nonpolynucleotide herbicide component that is dihydropteroate synthetase (DHPS) inhibitor herbicides include but are not limited to sulfonamides and asulam.

In some embodiments, the composition may include a nonpolynucleotide herbicide component that is photosystem II D1 protein (psbA) inhibitor herbicides include but are not limited to the chemical families of Triazines, Triazinones, Triazolinone, Uracils, Pyridazinones, Phenyl-carbamates, Ureas, Amides, Nitriles, Benzothiadiazinone, Phenyl-pyridazines and include members such as diuron[3-(3,4-dichlorophenyl)-1,1-dimethylurea)], chlortoluron, isoproturon, linuron, tebuthiuron, bentazone, oxadiazon, bromacil, ametryne, atrazine, cyanazine, hexazinone, metribuzin, simazine, and terbutylazine.

An agronomic field in need of plant control is treated by application of a composition as described herein directly to the surface of the growing plants, such as by a spray. For example, the method is applied to control weeds in a field of crop plants by spraying the field with the composition. The composition can be provided as a tank mix, a sequential treatment of components, or a simultaneous treatment or mixing of one or more of the components of the composition from separate containers. Treatment of the field can occur as often as needed to provide weed control and the components of the composition can be adjusted to target specific weed species or weed families through utilization of specific polynucleotides or polynucleotide compositions capable of selectively targeting the specific species or plant family to be controlled. The composition can be applied at effective use rates according to the time of application to the field, for example, preplant, at planting, post planting, post-harvest. Herbicide components of the composition can be applied at manufacturer's recommended use rates or reduced use rates, for example, 10-25 percent, or 26-50 percent, or 51-75 percent of the recommend use rate. The polynucleotides of the composition can be applied at rates of 1 to 30 grams per acre depending on the number of trigger molecules needed for the scope of weeds in the field.

Crop plants in which weed control may be needed include but are not limited to corn, soybean, cotton, canola, sugar beet, alfalfa, sugarcane, rice, and wheat; vegetable plants including, but not limited to, tomato, sweet pepper, hot pepper, melon, watermelon, cucumber, eggplant, cauliflower, broccoli, lettuce, spinach, onion, peas, carrots, sweet corn, Chinese cabbage, leek, fennel, pumpkin, squash or gourd, radish, Brussels sprouts, tomatillo, garden beans, dry beans, or okra; culinary plants including, but not limited to, basil, parsley, coffee, or tea; or fruit plants including but not limited to apple, pear, cherry, peach, plum, apricot, banana, plantain, oil palm, rubber tree, table grape, wine grape, citrus, avocado, mango, or berry; a tree grown for ornamental or commercial use, including, but not limited to, a fruit or nut tree; ornamental plant (e.g., an ornamental flowering plant or shrub or turf grass). The methods and compositions provided herein can also be applied to plants produced by a cutting, cloning, or grafting process (i.e., a plant not grown from a seed) including fruit trees and plants that include, but are not limited to, avocados, tomatoes, eggplant, cucumber, melons, watermelons, and grapes as well as various ornamental plants.

Polynucleotides

As used herein, the term "DNA", "DNA molecule", "DNA polynucleotide molecule" refers to a single-stranded DNA (ssDNA) or double-stranded DNA (dsDNA) molecule of genomic or synthetic origin, such as, a polymer of deoxyribonucleotide bases or a DNA polynucleotide molecule. As used herein, the term "DNA sequence", "DNA nucleotide sequence" or "DNA polynucleotide sequence" refers to the nucleotide sequence of a DNA molecule. As used herein, the term "RNA", "RNA molecule", "RNA polynucleotide molecule" refers to a single-stranded RNA (ssRNA) or double-stranded RNA (dsRNA) molecule of genomic or synthetic origin, such as, a polymer of ribonucleotide bases that comprise single or double stranded regions. Unless otherwise stated, nucleotide sequences in the text of this specification are given, when read from left to right, in the 5' to 3' direction and generally represent the plus or sense strand of a double strand polynucleotide. It is recognized that the minus or antisense strand may be the functional moiety of a double strand polynucleotide as described herein although unless indicate the disclosed polynucleotide sequences will represent the plus or sense strand polynucleotide sequence. The nomenclature used herein is that required by Title 37 of the United States Code of Federal Regulations § 1.822 and set forth in the tables in WIPO Standard ST.25 (1998), Appendix 2, Tables 1, 2, and 3.

As used herein, "polynucleotide" refers to a DNA or RNA molecule containing multiple nucleotides and generally refers both to "oligonucleotides" (a polynucleotide molecule of typically 50 or fewer nucleotides in length) and polynucleotides of 51 or more nucleotides. Embodiments include compositions including oligonucleotides having a length of 19-25 nucleotides (19-mers, 20-mers, 21-mers, 22-mers, 23-mers, 24-mers, or 25-mers), for example, oligonucleotides essentially homologous or essentially complementary to a component of a chloroplast protein import system, for example, SEQ ID NO: 1264-1483 (Table 2) or fragments thereof or medium-length polynucleotides having a length of 26 or more nucleotides (polynucleotides of 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, about 65, about 70, about 75, about 80, about 85, about 90, about 95, about 100, about 110, about 120, about 130, about 140, about 150, about 160, about 170, about 180, about 190, about 200, about 210, about 220, about 230, about 240, about 250, about 260, about 270, about 280, about 290, or about 300 nucleotides), for example, polynucleotides fragments thereof or long polynucleotides having a length greater than about 300 nucleotides (for example, polynucleotides of between about 300 to about 400 nucleotides, between about 400 to about 500 nucleotides, between about 500 to about 600 nucleotides, between about 600 to about 700 nucleotides, between about 700 to about 800 nucleotides, between about 800 to about 900 nucleotides, between about 900 to about 1000 nucleotides, between about 300 to about 500 nucleotides, between about 300 to about 600 nucleotides, between about 300 to about 700 nucleotides, between about 300 to about 800 nucleotides, between about 300 to about 900 nucleotides, or about 1000 nucleotides in length, or even greater than about 1000 nucleotides in length, for example up to the entire length of a target gene including coding or non-coding or both coding and non-coding portions of the components of a chloroplast protein import system target gene), for example, polynucleotides of SEQ ID NO: 1-1263 and 1584-1638, wherein the selected polynucleotides or fragments thereof are homologous or complementary to a segment of SEQ ID NO: 1-1263 or SEQ ID NO: 1584-1638 and suppresses, represses or otherwise delay the expression of the target chloroplast import protein or import processing enzyme genes. Where a polynucleotide is double-stranded, its length can be similarly described in terms of base pairs. A target gene comprises any polynucleotide molecule in a plant cell or fragment thereof for which the modulation of the expression of the target gene is provided by the methods and compositions. A gene has noncoding genetic elements (components) that provide for the function of the gene, these elements are polynucleotides that provide gene expression regulation, such as, a promoter, an enhancer, a 5' untranslated region, intron regions, and a 3' untranslated region. Oligonucleotides and polynucleotides can be made to any of the genetic elements of a gene and to polynucleotides spanning the junction region of a genetic element, such as, an intron and exon, the junction region of a promoter and a transcribed region, the junction region of a 5' leader and a coding sequence, the junction of a 3' untranslated region and a coding sequence.

Polynucleotide compositions used in the various embodiments include compositions including oligonucleotides or polynucleotides or a mixture of both, including RNA or DNA or RNA/DNA hybrids or chemically modified oligonucleotides or polynucleotides or a mixture thereof. In some embodiments, the polynucleotide may be a combination of ribonucleotides and deoxyribonucleotides, for example, synthetic polynucleotides consisting mainly of ribonucleotides but with one or more terminal deoxyribonucleotides or synthetic polynucleotides consisting mainly of deoxyribonucleotides but with one or more terminal dideoxyribonucleotides. In some embodiments, the polynucleotide includes non-canonical nucleotides such as inosine, thiouridine, or pseudouridine. In some embodiments, the polynucleotide includes chemically or enzymatically modified nucleotides. Examples of chemically modified oligonucleotides or polynucleotides are well known in the art; see, for example, US Patent Publication 20110171287, US Patent Publication 20110171176, and US Patent Publication 20110152353, US Patent Publication, 20110152346, US Patent Publication 20110160082, herein incorporated in its entirety by reference hereto. For example, including but not limited to the naturally occurring phosphodiester backbone of an oligonucleotide or polynucleotide can be partially or completely modified with phosphorothioate, phosphorodithioate, or methylphosphonate internucleotide linkage modifications, modified nucleoside bases or modified sugars can be used in oligonucleotide or polynucleotide synthesis, and oligonucleotides or polynucleotides can be labeled with a fluorescent moiety (for example, fluorescein or rhodamine) or other label (for example, biotin).

The polynucleotides can be single- or double-stranded RNA or single- or double-stranded DNA or double-stranded DNA/RNA hybrids or modified analogues thereof, and can be of oligonucleotide lengths or longer. In more specific embodiments, the polynucleotides that provide single-stranded RNA in the plant cell are selected from the group consisting of (a) a single-stranded RNA molecule (ssRNA), (b) a single-stranded RNA molecule that self-hybridizes to form a double-stranded RNA molecule, (c) a double-stranded RNA molecule (dsRNA), (d) a single-stranded DNA molecule (ssDNA), (e) a single-stranded DNA molecule that self-hybridizes to form a double-stranded DNA molecule, and (f) a single-stranded DNA molecule including a modified Pol III gene that is transcribed to an RNA molecule, (g) a double-stranded DNA molecule (dsDNA), (h) a double-stranded DNA molecule including a modified Pol III gene that is transcribed to an RNA molecule, (i) a double-stranded, hybridized RNA/DNA molecule, or combinations thereof. In some embodiments these polynucleotides include chemically modified nucleotides or non-canonical nucleotides. In some embodiments, the oligonucleotides may be blunt-ended or may comprise a 3' overhang of from 1-5 nucleotides of at least one or both of the strands. Other configurations of the oligonucleotide are known in the field and are contemplated herein. In embodiments of the method the polynucleotides include double-stranded DNA formed by intramolecular hybridization, double-stranded DNA formed by intermolecular hybridization, double-stranded RNA formed by intramolecular hybridization, or double-stranded RNA formed by intermolecular hybridization. In one embodiment the polynucleotides include single-stranded DNA or single-stranded RNA that self-hybridizes to form a hairpin structure having an at least partially double-stranded structure including at least one segment that will hybridize to RNA transcribed from the gene targeted for suppression. Not intending to be bound by any mechanism, it is believed that such polynucleotides are or will produce single-stranded RNA with at least one segment that will hybridize to RNA transcribed from the gene targeted for suppression. In certain other embodiments the polynucleotides further includes a promoter, generally a promoter functional in a plant, for example, a pol II promoter, a pol III promoter, a pol IV promoter, or a pol V promoter.

The term "gene" refers to components that comprise chromosomal DNA, plasmid DNA, cDNA, intron and exon DNA, artificial DNA polynucleotide, or other DNA that encodes a peptide, polypeptide, protein, or RNA transcript molecule, and the genetic elements flanking the coding sequence that are involved in the regulation of expression, such as, promoter regions, 5' leader regions, 3' untranslated region that may exist as native genes or transgenes in a plant genome. A component of a gene or a fragment thereof of a component of a chloroplast protein import system is isolated and subjected to polynucleotide sequencing methods that determines the order of the nucleotides that comprise the gene. Any of the components of the gene are potential targets for a trigger oligonucleotide and polynucleotides.

The trigger polynucleotide molecules are designed to modulate expression by inducing regulation or suppression of an endogenous chloroplast import protein system gene in a plant and are designed to have a nucleotide sequence essentially identical or essentially complementary to the nucleotide sequence of an endogenous chloroplast import protein system gene of a plant or to the sequence of RNA transcribed from an endogenous chloroplast import protein or import processing enzyme or chaperone like protein associated with the import protein system gene of a plant, the sequence thereof determined by isolating the gene or a fragment of the gene from the plant, which can be coding sequence or non-coding sequence. Effective molecules that modulate expression are referred to as "a trigger molecule, or trigger polynucleotide". By "essentially identical" or "essentially complementary" is meant that the trigger polynucleotides (or at least one strand of a double-stranded polynucleotide or portion thereof, or a portion of a single strand polynucleotide) are designed to hybridize to the endogenous gene noncoding sequence or to RNA transcribed (known as messenger RNA or an RNA transcript) from the endogenous gene to effect regulation or suppression of expression of the endogenous gene. Trigger molecules are identified by "tiling" the gene targets with partially overlapping probes or non-overlapping probes of antisense or sense polynucleotides that are essentially identical or essentially complementary to the nucleotide sequence of an endogenous gene. Multiple target sequences can be aligned and sequence regions with homology in common, according to the methods, are identified as potential trigger molecules for the multiple targets. Multiple trigger molecules of various lengths, for example 19-25 nucleotides, 26-50 nucleotides, 51-100 nucleotides, 101-200 nucleotides, 201-300 nucleotides or more can be pooled into a few treatments in order to investigate polynucleotide molecules that cover a portion of a gene sequence (for example, a portion of a coding versus a portion of a noncoding region, or a 5' versus a 3' portion of a gene) or an entire gene sequence including coding and noncoding regions of a target gene. Polynucleotide molecules of the pooled trigger molecules can be divided into smaller pools or single molecules in order to identify trigger molecules that provide the desired effect.

The target gene RNA and DNA polynucleotide molecules (SEQ ID NO:1-1263 and 1584-1638) are sequenced by any number of available methods and equipment. Some of the sequencing technologies are available commercially, such as the sequencing-by-hybridization platform from Affymetrix Inc. (Sunnyvale, Calif.) and the sequencing-by-synthesis platforms from 454 Life Sciences (Bradford, Conn.), Illumina/Solexa (Hayward, Calif.) and Helicos Biosciences (Cambridge, Mass.), and the sequencing-by-ligation platform from Applied Biosystems (Foster City, Calif.), as described below. In addition to the single molecule sequencing performed using sequencing-by-synthesis of Helicos Biosciences, other single molecule sequencing technologies are encompassed and include the SMRT™ technology of Pacific Biosciences, the Ion Torrent™ technology, and nanopore sequencing being developed for example, by Oxford Nanopore Technologies. A chloroplast import protein system or import processing enzyme gene comprising DNA or RNA can be isolated using primers or probes essentially complementary or essentially homologous to SEQ ID NO:1-1263 and 1584-1638 or a fragment thereof. A polymerase chain reaction (PCR) gene fragment can be produced using primers essentially complementary or essentially homologous to SEQ ID NO:1-1263 and 1584-1638 or a fragment thereof that is useful to isolate a chloroplast import protein or import processing enzyme gene from a plant genome. SEQ ID NO: 1-1263 and 1584-1638 or fragments thereof can be used in various sequence capture technologies to isolate additional target gene sequences, for example, including but not limited to Roche NimbleGen® (Madison, Wis.) and Streptavdin-coupled Dynabeads® (Life Technologies, Grand Island, N.Y.) and US20110015084, herein incorporated by reference in its entirety.

Embodiments of functional single-stranded polynucleotides have sequence complementarity that need not be 100 percent, but is at least sufficient to permit hybridization to RNA transcribed from the target gene or DNA of the target gene to form a duplex to permit a gene silencing mechanism. Thus, in embodiments, a polynucleotide fragment is designed to be essentially identical to, or essentially complementary to, a sequence of 19 or more contiguous nucleotides in either the target chloroplast import protein or import processing enzyme gene sequence or messenger RNA transcribed from the target gene. By "essentially identical" is meant having 100 percent sequence identity or at least about 83, 84, 85, 86, 87, 88, 89, 90, 91, 92, 93, 94, 95, 96, 97, 98, or 99 percent sequence identity when compared to the sequence of 19 or more contiguous nucleotides in either the target gene or RNA transcribed from the target gene; by "essentially complementary" is meant having 100 percent sequence complementarity or at least about 83, 84, 85, 86, 87, 88, 89, 90, 91, 92, 93, 94, 95, 96, 97, 98, or 99 percent sequence complementarity when compared to the sequence of 19 or more contiguous nucleotides in either the target gene or RNA transcribed from the target gene. In some embodiments, polynucleotide molecules are designed to have 100 percent sequence identity to or complementarity to one allele or one family member of a given target gene (coding or non-coding sequence of a gene); in other embodiments the polynucleotide molecules are designed to have 100 percent sequence identity to or complementarity to multiple alleles or family members of a given target gene in one or more plant species.

"Identity" refers to the degree of similarity between two polynucleic acid or protein sequences. An alignment of the two sequences is performed by a suitable computer program. A widely used and accepted computer program for performing sequence alignments is CLUSTALW v1.6 (Thompson, et al. Nucl. Acids Res., 22: 4673-4680, 1994). The number of matching bases or amino acids is divided by the total number of bases or amino acids, and multiplied by 100 to obtain a percent identity. For example, if two 580 base pair sequences had 145 matched bases, they would be 25 percent identical. If the two compared sequences are of different lengths, the number of matches is divided by the shorter of the two lengths. For example, if there are 100 matched amino acids between a 200 and a 400 amino acid protein, they are 50 percent identical with respect to the shorter sequence. If the shorter sequence is less than 150 bases or 50 amino acids in length, the number of matches are divided by 150 (for nucleic acid bases) or 50 (for amino acids), and multiplied by 100 to obtain a percent identity.

Trigger molecules for specific gene family members can be identified from coding and/or non-coding sequences of gene families of a plant or multiple plants, by aligning and selecting 200-300 polynucleotide fragments from the least homologous regions amongst the aligned sequences and evaluated using topically applied polynucleotides (as sense or anti-sense ssDNA or ssRNA, dsRNA, or dsDNA) to determine their relative effectiveness in providing the herbicidal phenotype. The effective segments are further subdivided into 50-60 polynucleotide fragments, prioritized by least homology, and reevaluated using topically applied polynucleotides. The effective 50-60 polynucleotide fragments are subdivided into 19-30 polynucleotide fragments, prioritized by least homology, and again evaluated for induction of the herbicidal phenotype. Once relative effectiveness is determined, the fragments are utilized singly, or again evaluated in combination with one or more other fragments to determine the trigger composition or mixture of trigger polynucleotides for providing the herbicidal phenotype.

Trigger molecules for broad activity can be identified from coding and/or non-coding sequences of gene families of a plant or multiple plants, by aligning and selecting 200-300 polynucleotide fragments from the most homologous regions amongst the aligned sequences and evaluated using topically applied polynucleotides (as sense or anti-sense ssDNA or ssRNA, dsRNA, or dsDNA) to determine their relative effectiveness in inducing the herbicidal phenotype. The effective segments are subdivided into 50-60 polynucleotide fragments, prioritized by most homology, and reevaluated using topically applied polynucleotides. The effective 50-60 polynucleotide fragments are subdivided into 19-30 polynucleotide fragments, prioritized by most homology, and again evaluated for induction of the herbicidal phenotype. Once relative effectiveness is determined, the fragments may be utilized singly, or in combination with one or more other fragments to determine the trigger composition or mixture of trigger polynucleotides for providing the herbicidal phenotype.

Methods of making polynucleotides are well known in the art. Chemical synthesis, in vivo synthesis and in vitro synthesis methods and compositions are known in the art and include various viral elements, microbial cells, modified polymerases, and modified nucleotides. Commercial preparation of oligonucleotides often provides two deoxyribonucleotides on the 3' end of the sense strand. Long polynucleotide molecules can be synthesized from commercially available kits, for example, kits from Applied Biosystems/Ambion (Austin, Tex.) have DNA ligated on the 5' end in a microbial expression cassette that includes a bacterial T7 polymerase promoter that makes RNA strands that can be assembled into a dsRNA and kits provided by vaious manufacturers that include T7 RiboMax Express (Promega, Madison, Wis.), AmpliScribe T7-Flash (Epicentre, Madison, Wis.), and TranscriptAid T7 High Yield (Fermentas, Glen Burnie, Md.). dsRNA molecules can be produced from microbial expression cassettes in bacterial cells (Ongvarrasopone et al. ScienceAsia 33:35-39; Yin, Appl. Microbiol. Biotechnol 84:323-333, 2009; Liu et al., BMC Biotechnology 10:85, 2010) that have regulated or deficient RNase III enzyme activity or the use of various viral vectors to produce sufficient quantities of dsRNA. Chloroplast import protein or import processing enzyme gene fragments are inserted into the microbial expression cassettes in a position in which the fragments are express to produce ssRNA or dsRNA useful in the methods described herein to regulate expression of a target gene. Long polynucleotide molecules can also be assembled from multiple RNA or DNA fragments. In some embodiments design parameters such as Reynolds score (Reynolds et al. Nature Biotechnology 22, 326-330 (2004), Tuschl rules (Pei and Tuschl, Nature Methods 3(9): 670-676, 2006), i-score (Nucleic Acids Res 35: e123, 2007), i-Score Designer tool and associated algorithms (Nucleic Acids Res 32: 936-948, 2004. Biochem Biophys Res Commun 316: 1050-1058, 2004, Nucleic Acids Res 32: 893-901, 2004, Cell Cycle 3:

790-5, 2004, Nat Biotechnol 23: 995-1001, 2005, Nucleic Acids Res 35: e27, 2007, BMC Bioinformatics 7: 520, 2006, Nucleic Acids Res 35: e123, 2007, Nat Biotechnol 22: 326-330, 2004) are known in the art and may be used in selecting polynucleotide sequences effective in gene silencing. In some embodiments the sequence of a polynucleotide is screened against the genomic DNA of the intended plant to minimize unintentional silencing of other genes.

Ligands can be tethered to a polynucleotide, for example a dsRNA, ssRNA, dsDNA or ssDNA. Ligands in general can include modifiers, e.g., for enhancing uptake; diagnostic compounds or reporter groups e.g., for monitoring distribution; cross-linking agents; nuclease-resistance conferring moieties; and natural or unusual nucleobases. General examples include lipophiles, lipids (e.g., cholesterol, a bile acid, or a fatty acid (e.g., lithocholic-oleyl, lauroyl, docosnyl, stearoyl, palmitoyl, myristoyl oleoyl, linoleoyl), steroids (e.g., uvaol, hecigenin, diosgenin), terpenes (e.g., triterpenes, e.g., sarsasapogenin, Friedelin, epifriedelanol derivatized lithocholic acid), vitamins (e.g., folic acid, vitamin A, biotin, pyridoxal), carbohydrates, proteins, protein binding agents, integrin targeting molecules, polycationics, peptides, polyamines, and peptide mimics. The ligand may also be a recombinant or synthetic molecule, such as a synthetic polymer, e.g., polyethylene glycol (PEG), PEG-40K, PEG-20K and PEG-5K. Other examples of ligands include lipophilic molecules, e.g, cholesterol, cholic acid, adamantane acetic acid, 1-pyrene butyric acid, dihydrotestosterone, glycerol (e.g., esters and ethers thereof, e.g., $C_{10}$, $C_{11}$, $C_{12}$, $C_{13}$, $C_{14}$, $C_{15}$, $C_{16}$, $C_{17}$, $C_{18}$, $C_{19}$, or $C_{20}$ alkyl; e.g., lauroyl, docosnyl, stearoyl, oleoyl, linoleoyl 1,3-bis-O(hexadecyl)glycerol, 1,3-bis-O(octaadecyl)glycerol), geranyloxyhexyl group, hexadecylglycerol, borneol, menthol, 1,3-propanediol, heptadecyl group, palmitic acid, myristic acid, O3-(oleoyl)lithocholic acid, O3-(oleoyl)cholenic acid, dodecanoyl, lithocholyl, 5.beta.-cholanyl, N,N-distearyl-lithocholamide, 1,2-di-O-stearoylglyceride, dimethoxytrityl, or phenoxazine) and PEG (e.g., PEG-5K, PEG-20K, PEG-40K). Preferred lipophilic moieties include lipid, cholesterols, oleyl, retinyl, or cholesteryl residues.

Conjugating a ligand to a dsRNA can enhance its cellular absorption, lipophilic compounds that have been conjugated to oligonucleotides include 1-pyrene butyric acid, 1,3-bis-O-(hexadecyl)glycerol, and menthol. One example of a ligand for receptor-mediated endocytosis is folic acid. Folic acid enters the cell by folate-receptor-radiated endocytosis. dsRNA compounds bearing folic acid would be efficiently transported into the cell via the folate-receptor-mediated endocytosis. Other ligands that have been conjugated to oligonucleotides include polyethylene glycols, carbohydrate clusters, cross-linking agents, porphyrin conjugates, delivery peptides and lipids such as cholesterol. In certain instances, conjugation of a cationic ligand to oligonucleotides results in improved resistance to nucleases. Representative examples of cationic ligands are propylammonium and dimethylpropylammonium. Interestingly, antisense oligonucleotides were reported to retain their high binding affinity to mRNA when the cationic ligand was dispersed, throughout the oligonucleotide. See M. Manoharan Antisense & Nucleic Acid Drug Development 2002, 12, 103 and references therein.

A biologic delivery can be accomplished by a variety of methods including, without limitation, (1) loading liposomes with a dsRNA acid molecule provided herein and (2) complexing a dsRNA molecule with lipids or liposomes to form nucleic acid-lipid or nucleic acid-liposome complexes. The liposome can be composed of cationic and neutral lipids commonly used to transfect cells in vitro. Cationic lipids can complex (e.g., charge-associate) with negatively charged, nucleic acids to form liposomes. Examples of cationic liposomes include, without limitation, lipofectin, lipofectamine, lipofectace, and DOTAP. Procedures for forming liposomes are well known in the art. Liposome compositions can be formed, for example, from phosphatidylcholine, dimyristoyl phosphatidylcholine, dipalmitoyl phosphatidylcholine, dimyristoyl phosphatidyl glycerol, dioleoyl phosphatidylethanolamine or liposomes comprising dihydrosphingomyelin (DHSM) Numerous lipophilic agents are commercially available, including Lipofectin® (Invitrogen/Life Technologies, Carlsbad, Calif.) and Effectene™ (Qiagen, Valencia, Calif.), In addition, systemic delivery methods can be optimized using commercially available cationic lipids such as DDAB or DOTAP, each of which can be mixed with a neutral lipid such as DOPE or cholesterol. In some cases, liposomes such as those described by Templeton et al. (Nature Biotechnology, 15:647-652 (1997)) can be used. In other embodiments, polycations such as polyethyleneimine can be used to achieve delivery in vivo and ex vivo (Boletta et al., J. Am Soc. Nephrol. 7:1728 (1996)). Additional information regarding the use of liposomes to deliver nucleic acids can be found in U.S. Pat. No. 6,271,359, PCT Publication WO 96/40964 and Morrissey, D. et al. 2005. Nat Biotechnol. 23(8):1002-7.

In certain embodiments, an organosilicone preparation that is commercially available as Silwet® L-77 surfactant having CAS Number 27306-78-1 and EPA Number: CAL. REG. NO. 5905-50073-AA, and currently available from Momentive Performance Materials, Albany, N.Y. can be used to prepare a polynucleotide composition. In certain embodiments where a Silwet L-77 organosilicone preparation is used as a pre-spray treatment of plant leaves or other plant surfaces, freshly made concentrations in the range of about 0.1 to about 2 percent by weight (wt percent) (e.g., about 0.1, 0.2, 0.3, 0.4, 0.5, 0.6, 0.7, 0.8, 0.9, 1.0, 1.1, 1.2, 1.3, 1.4, 1.5, 1.6, 1.7, 1.8, 1.9, 2.0, 2.1, 2.2, 2.3, 2.5 wt percent) are efficacious in preparing a leaf or other plant surface for transfer of polynucleotide molecules into plant cells from a topical application on the surface. In certain embodiments of the methods and compositions provided herein, a composition that comprises a polynucleotide molecule and an organosilicone preparation comprising Silwet L-77 in the range of about 0.1 to about 2 percent by weight (wt percent) (e.g., 0.1, 0.2, 0.3, 0.4, 0.5, 0.6, 0.7, 0.8, 0.9, 1.0, 1.1, 1.2, 1.3, 1.4, 1.5, 1.6, 1.7, 1.8, 1.9, 2.0, 2.1, 2.2, 2.3, 2.5 wt percent) is used or provided.

In certain embodiments, any of the commercially available organosilicone preparations provided such as the following Breakthru S 321, Breakthru S 200 Cat #67674-67-3, Breakthru OE 441 Cat #68937-55-3, Breakthru S 278 Cat #27306-78-1, Breakthru S 243, Breakthru S 233 Cat #134180-76-0, available from manufacturer Evonik Goldschmidt (Germany), Silwet® HS 429, Silwet® HS 312, Silwet® HS 508, Silwet® HS 604 (Momentive Performance Materials, Albany, N.Y.) can be used as transfer agents in a polynucleotide composition. In certain embodiments where an organosilicone preparation is used as a pre-spray treatment of plant leaves or other surfaces, freshly made concentrations in the range of about 0.1 to about 2 percent by weight (wt percent) (e.g., 0.1, 0.2, 0.3, 0.4, 0.5, 0.6, 0.7, 0.8, 0.9, 1.0, 1.1, 1.2, 1.3, 1.4, 1.5, 1.6, 1.7, 1.8, 1.9, 2.0, 2.1, 2.2, 2.3, 2.5 wt percent) are efficacious in preparing a leaf or other plant surface for transfer of polynucleotide molecules into plant cells from a topical application on the surface. In certain embodiments of the methods and compositions provided herein, a composition that comprises a polynucleotide molecule and an organosilicone preparation in the range of about 0.1 to about 2 percent by weight (wt percent) (e.g., 0.1, 0.2, 0.3, 0.4, 0.5, 0.6, 0.7, 0.8, 0.9, 1.0, 1.1, 1.2, 1.3, 1.4, 1.5, 1.6, 1.7, 1.8, 1.9, 2.0, 2.1, 2.2, 2.3, 2.5 wt percent) is used or provided.

Organosilicone preparations used in the methods and compositions provided herein can comprise one or more effective organosilicone compounds. As used herein, the phrase "effective organosilicone compound" is used to describe any organosilicone compound that is found in an organosilicone preparation that enables a polynucleotide to enter a plant cell. In certain embodiments, an effective organosilicone compound can enable a polynucleotide to enter a plant cell in a manner permitting a polynucleotide mediated suppression of a target gene expression in the plant cell. In general, effective organosilicone compounds include, but are not limited to, compounds that can comprise: i) a trisiloxane head group that is covalently linked to, ii) an alkyl linker including, but not limited to, an n-propyl linker, that is covalently linked to, iii) a poly glycol chain, that is covalently linked to, iv) a terminal group. Trisiloxane head groups of such effective organosilicone compounds include, but are not limited to, heptamethyltrisiloxane. Alkyl linkers can include, but are not limited to, an n-propyl linker. Poly glycol chains include, but are not limited to, polyethylene glycol or polypropylene glycol. Poly glycol chains can comprise a mixture that provides an average chain length "n" of about "7.5". In certain embodiments, the average chain length "n" can vary from about 5 to about 14. Terminal groups can include, but are not limited to, alkyl groups such as a methyl group. Effective organosilicone compounds are believed to include, but are not limited to, trisiloxane ethoxylate surfactants or polyalkylene oxide modified heptamethyl trisiloxane.

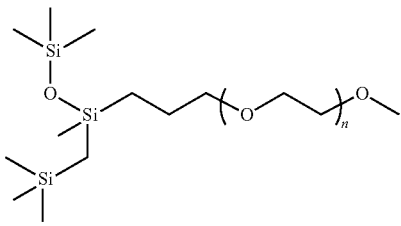

(Compound I: polyalkyleneoxide heptamethyltrisiloxane, average $n$ = 7.5).

In certain embodiments, an organosilicone preparation that comprises an organosilicone compound comprising a trisiloxane head group is used in the methods and compositions provided herein. In certain embodiments, an organosilicone preparation that comprises an organosilicone compound comprising a heptamethyltrisiloxane head group is used in the methods and compositions provided herein. In certain embodiments, an organosilicone composition that comprises Compound I is used in the methods and compositions provided herein. In certain embodiments, an organosilicone composition that comprises Compound I is used in the methods and compositions provided herein. In certain embodiments of the methods and compositions provided herein, a composition that comprises a polynucleotide molecule and one or more effective organosilicone compound in the range of about 0.1 to about 2 percent by weight (wt percent) (e.g., 0.1, 0.2, 0.3, 0.4, 0.5, 0.6, 0.7, 0.8, 0.9, 1.0, 1.1, 1.2, 1.3, 1.4, 1.5, 1.6, 1.7, 1.8, 1.9, 2.0, 2.1, 2.2, 2.3, 2.5 wt percent) is used or provided.

Compositions include but are not limited components that are one or more polynucleotides essentially identical to, or essentially complementary to a chloroplast import protein or import processing enzyme gene sequence (promoter, intron, exon, 5' untranslated region, 3' untranslated region), a transfer agent that provides for the polynucleotide to enter a plant cell, a herbicide that complements the action of the polynucleotide, one or more additional herbicides that further enhance the herbicide activity of the composition or provide an additional mode of action different from the complementing herbicide, various salts and stabilizing agents that enhance the utility of the composition as an admixture of the components of the composition.

In certain aspects, methods include one or more applications of a polynucleotide composition and one or more applications of a transfer agent for conditioning of a plant to permeation by polynucleotides. When the agent for conditioning to permeation is an organosilicone composition or compound contained therein, embodiments of the polynucleotide molecules are double-stranded RNA oligonucleotides, single-stranded RNA oligonucleotides, double-stranded RNA polynucleotides, single-stranded RNA polynucleotides, double-stranded DNA oligonucleotides, single-stranded DNA oligonucleotides, double-stranded DNA polynucleotides, single-stranded DNA polynucleotides, chemically modified RNA or DNA oligonucleotides or polynucleotides or mixtures thereof.

Compositions and methods are useful for modulating the expression a protein of an endogenous gene, wherein the protein is imported into a chloroplast and is a target of a herbicide, for example, an EPSPS gene or a transgenic EPSPS gene (for example, CP4 EPSPS, U.S. Pat. No. RE39,247 and 2mEPSPS, U.S. Pat. No. 6,040,497) gene in a plant cell. In various embodiments, an EPSPS gene includes coding (protein-coding or translatable) sequence, non-coding (non-translatable) sequence, or both coding and non-coding sequence. Compositions can include polynucleotides and oligonucleotides designed to target one or more chloroplast import genes and a herbicide target gene, or multiple segments of one or more the genes. The gene can include multiple consecutive segments, multiple non-consecutive segments of a target gene, multiple alleles of a target gene, or multiple target genes from one or more species.

Provided is a method for modulating expression of a chloroplast import gene or chloroplast protein processing gene in a plant including (a) conditioning of a plant to permeation by polynucleotides and (b) treatment of the plant with the polynucleotide molecules, wherein the polynucleotide molecules include at least one segment of 19 or more contiguous nucleotides cloned from or otherwise identified from the target gene in either anti-sense or sense orientation, whereby the polynucleotide molecules permeate the interior of the plant and induce modulation of the target gene. The conditioning and polynucleotide application can be performed separately or in a single step. When the conditioning and polynucleotide application are performed in separate steps, the conditioning can precede or can follow the polynucleotide application within minutes, hours, or days. In some embodiments more than one conditioning step or more than one polynucleotide molecule application can be performed on the same plant. In embodiments of the method, the segment can be cloned or identified from (a) coding (protein-encoding), (b) non-coding (promoter and other gene related molecules), or (c) both coding and non-coding parts of the target gene. Non-coding parts include DNA, such as promoter regions or the RNA transcribed by the DNA that provide RNA regulatory molecules, including but not limited to: introns, 5' or 3' untranslated regions, microRNAs (miRNA), trans-acting siRNAs, natural antisense siRNAs, and other small RNAs with regulatory function or RNAs having structural or enzymatic function including but not limited to: ribozymes, ribosomal RNAs, t-RNAs, aptamers, and riboswitches.

All publications, patents and patent applications are herein incorporated by reference to the same extent as if each individual publication or patent application was specifically and individually indicated to be incorporated by reference.

The following examples are included to demonstrate examples of certain preferred embodiments. It should be appreciated by those of skill in the art that the techniques disclosed in the examples that follow represent approaches the inventors have found function well in the practice, and thus can be considered to constitute examples of preferred modes for its practice. However, those of skill in the art should, in light of the present disclosure, appreciate that many changes can be made in the specific embodiments that are disclosed and still obtain a like or similar result without departing from the spirit and scope.

EXAMPLES

Example 1. Polynucleotides Related to the Plant Chloroplast Protein Import System and Target Gene Sequences Thereof The target chloroplast protein import system naturally occurs in the genome of plants, including but not limited to *Abutilon theophrasti, Alopecurus myosuroides, Amaranthus albus, Amaranthus chlorostachys, Amaranthus graecizans, Amaranthus hybridus, Amaranthus lividus, Amaranthus palmeri, Amaranthus rudis, Amaranthus spinosus, Amaranthus thunbergii, Amaranthus viridis, Ambrosia artemisifolia, Ambrosia trifida, Avena fatua, Chenopodium album, Commelina diffusa, Convolvulus arvensis, Conyza canadensis, Cyperus esculentus, Digitaria sanguinalis, Echinochloa colona, Echinochloa crus-galli, Euphorbia heterophylla, Festuca arundinacea, Ipomoea hederacea, Kochia scoparia, Lolium arundinaceum, Lolium multiflorum, Lolium rigidium, Portulaca oleracea, Senna obtusifolia, Setaria viridis, Sorghum halepense, Spirodela polyrrhiza, Taraxacum officinale, Trifolium repens, Xanthium strumarium* and other weed species that include molecules related to the expression of a polypeptide identified as an enzyme or protein of a chloroplast import protein system, that include regulatory molecules, cDNAs comprising coding and non-coding regions of the gene and fragments thereof as shown in SEQ ID NO: 1-1263 and SEQ ID NO: 1584-1683, summarized in Table 1.

Polynucleotide molecules are extracted from these plant species by methods standard in the field, for example, total RNA is extracted using Trizol Reagent (Invitrogen Corp, Carlsbad, Calif. Cat. No. 15596-018), following the manufacturer's protocol or modifications thereof by those skilled in the art of polynucleotide extraction that may enhance recover or purity of the extracted RNA. Briefly, start with 1 gram of ground plant tissue for extraction. Prealiquot 10 milliliters (mL) Trizol reagent to 15 mL conical tubes. Add ground powder to tubes and shake to homogenize. Incubate the homogenized samples for 5 minutes (min) at room temperature (RT) and then add 3 mL of chloroform. Shakes tubes vigorously by hand for 15-30 seconds (sec) and incubate at RT for 3 min. Centrifuge the tubes at 7,000 revolutions per minute (rpm) for 10 min at 4 degrees C. (centigrade). Transfer the aqueous phase to a new 1.5 mL tube and add 1 volume of cold isopropanol. Incubate the samples for 20-30 min at RT and centrifuge at 10,000 rpm for 10 min at 4 degrees C. Wash pellet with Sigma-grade 80 percent ethanol. Remove the supernatant and briefly air-dry the pellet. Dissolve the RNA pellet in approximately 200 microliters of DEPC treated water. Heat briefly at 65 degrees C. to dissolve pellet and vortex or pipet to resuspend RNA pellet. Adjust RNA to 1-2 microgram/microliter.

DNA is extracted using EZNA SP Plant DNA Mini kit (Omega Biotek, Norcross Ga., Cat # D5511) and Lysing Matrix E tubes (Q-Biogen, Cat #6914), following the manufacturer's protocol or modifications thereof by those skilled in the art of polynucleotide extraction that may enhance recover or purity of the extracted DNA. Briefly, aliquot ground tissue to a Lysing Matrix E tube on dry ice, add 800 µl Buffer SP1 to each sample, homogenize in a bead beater for 35-45 sec, incubate on ice for 45-60 sec, centrifuge at ≥14000 rpm for 1 min at RT, add 10 microliter RNase A to the lysate, incubate at 65° C. for 10 min, centrifuge for 1 min at RT, add 280 µl Buffer SP2 and vortex to mix, incubate the samples on ice for 5 min, centrifuge at ≥10,000 g for 10 min at RT, transfer the supernatant to a homogenizer column in a 2 ml collection tube, centrifuge at 10,000 g for 2 min at RT, transfer the cleared lysate into a 1.5 ml microfuge tube, add 1.5 volumes Buffer SP3 to the cleared lysate, vortex immediately to obtain a homogeneous mixture, transfer up to 650 µl supernatant to the Hi-Bind column, centrifuge at 10,000 g for 1 min, repeat, apply 100 µl 65° C. Elution Buffer to the column, centrifuge at 10,000 g for 5 min at RT.

Next-generation DNA sequencers, such as the 454-FLX (Roche, Branford, Conn.), the SOLiD (Applied Biosystems), and the Genome Analyzer (HiSeq2000, Illumina, San Diego, Calif.) are used to provide polynucleotide sequence from the DNA and RNA extracted from the plant tissues. Raw sequence data is assembled into contigs. The contig sequence is used to identify trigger polynucleotide molecules that can be applied to the plant to enable regulation of the gene expression and result in an agronomic benefit.

TABLE 1

Target chloroplast import protein system DNA sequence contigs from the various plant species.

| SEQ ID NO | GENE | SPECIES | SEQ_TYPE |
|---|---|---|---|
| 1 | TOC159 | *Abutilon theophrasti* | cDNA |
| 2 | TOC159 | *Abutilon theophrasti* | cDNA |
| 3 | TOC159 | *Abutilon theophrasti* | gDNA |
| 4 | TOC159 | *Abutilon theophrasti* | gDNA |
| 5 | TOC159 | *Abutilon theophrasti* | gDNA |
| 6 | TOC159 | *Abutilon theophrasti* | gDNA |
| 7 | TOC159 | *Abutilon theophrasti* | gDNA |
| 8 | TOC159 | *Abutilon theophrasti* | gDNA |
| 9 | TOC159 | *Abutilon theophrasti* | gDNA |
| 10 | TOC159 | *Abutilon theophrasti* | gDNA |
| 11 | TOC159 | *Abutilon theophrasti* | gDNA |
| 12 | TOC159 | *Abutilon theophrasti* | gDNA |
| 13 | TOC159 | *Abutilon theophrasti* | gDNA |
| 14 | TOC159 | *Alopecurus myosuroides* | cDNA |
| 15 | TOC159 | *Amaranthus albus* | cDNA |
| 16 | TOC159 | *Amaranthus albus* | cDNA |
| 17 | TOC159 | *Amaranthus albus* | cDNA |
| 18 | TOC159 | *Amaranthus chlorostachys* | cDNA |
| 19 | TOC159 | *Amaranthus graecizans* | cDNA |

TABLE 1-continued

Target chloroplast import protein system DNA sequence contigs from the various plant species.

| SEQ ID NO | GENE | SPECIES | SEQ_TYPE |
|---|---|---|---|
| 20 | TOC159 | Amaranthus graecizans | cDNA |
| 21 | TOC159 | Amaranthus hybridus | cDNA |
| 22 | TOC159 | Amaranthus hybridus | cDNA |
| 23 | TOC159 | Amaranthus lividus | cDNA |
| 24 | TOC159 | Amaranthus palmeri | cDNA |
| 25 | TOC159 | Amaranthus palmeri | cDNA |
| 26 | TOC159 | Amaranthus palmeri | cDNA |
| 27 | TOC159 | Amaranthus palmeri | gDNA |
| 28 | TOC159 | Amaranthus palmeri | gDNA |
| 29 | TOC159 | Amaranthus rudis | cDNA |
| 30 | TOC159 | Amaranthus rudis | gDNA |
| 31 | TOC159 | Amaranthus rudis | gDNA |
| 32 | TOC159 | Amaranthus rudis | gDNA |
| 33 | TOC159 | Amaranthus spinosus | gDNA |
| 34 | TOC159 | Amaranthus spinosus | gDNA |
| 35 | TOC159 | Amaranthus thunbergii | cDNA |
| 36 | TOC159 | Amaranthus thunbergii | cDNA |
| 37 | TOC159 | Amaranthus thunbergii | cDNA |
| 38 | TOC159 | Amaranthus thunbergii | cDNA |
| 39 | TOC159 | Amaranthus viridis | cDNA |
| 40 | TOC159 | Amaranthus viridis | cDNA |
| 41 | TOC159 | Ambrosia artemisiifolia | gDNA |
| 42 | TOC159 | Ambrosia artemisiifolia | gDNA |
| 43 | TOC159 | Ambrosia trifida | cDNA |
| 44 | TOC159 | Ambrosia trifida | cDNA |
| 45 | TOC159 | Ambrosia trifida | gDNA |
| 46 | TOC159 | Ambrosia trifida | gDNA |
| 47 | TOC159 | Ambrosia trifida | gDNA |
| 48 | TOC159 | Ambrosia trifida | gDNA |
| 49 | TOC159 | Ambrosia trifida | gDNA |
| 50 | TOC159 | Ambrosia trifida | gDNA |
| 51 | TOC159 | Ambrosia trifida | gDNA |
| 52 | TOC159 | Ambrosia trifida | gDNA |
| 53 | TOC159 | Ambrosia trifida | gDNA |
| 54 | TOC159 | Ambrosia trifida | gDNA |
| 55 | TOC159 | Ambrosia trifida | gDNA |
| 56 | TOC159 | Ambrosia trifida | gDNA |
| 57 | TOC159 | Ambrosia trifida | gDNA |
| 58 | TOC159 | Ambrosia trifida | gDNA |
| 59 | TOC159 | Ambrosia trifida | gDNA |
| 60 | TOC159 | Avena fatua | cDNA |
| 61 | TOC159 | Avena fatua | cDNA |
| 62 | TOC159 | Chenopodium album | cDNA |
| 63 | TOC159 | Chenopodium album | cDNA |
| 64 | TOC159 | Chenopodium album | cDNA |
| 65 | TOC159 | Convolvulus arvensis | cDNA |
| 66 | TOC159 | Convolvulus arvensis | cDNA |
| 67 | TOC159 | Conyza canadensis | cDNA |
| 68 | TOC159 | Conyza canadensis | gDNA |
| 69 | TOC159 | Cyperus esculentus | gDNA |
| 70 | TOC159 | Digitaria sanguinalis | cDNA |
| 71 | TOC159 | Digitaria sanguinalis | cDNA |
| 72 | TOC159 | Digitaria sanguinalis | cDNA |
| 73 | TOC159 | Digitaria sanguinalis | cDNA |
| 74 | TOC159 | Digitaria sanguinalis | gDNA |
| 75 | TOC159 | Digitaria sanguinalis | gDNA |
| 76 | TOC159 | Digitaria sanguinalis | gDNA |
| 77 | TOC159 | Echinochloa colona | cDNA |
| 78 | TOC159 | Echinochloa colona | cDNA |
| 79 | TOC159 | Echinochloa crus-galli | cDNA |
| 80 | TOC159 | Euphorbia heterophylla | cDNA |
| 81 | TOC159 | Euphorbia heterophylla | cDNA |
| 82 | TOC159 | Euphorbia heterophylla | cDNA |
| 83 | TOC159 | Euphorbia heterophylla | cDNA |
| 84 | TOC159 | Festuca arundinacea | gDNA |
| 85 | TOC159 | Festuca arundinacea | gDNA |
| 86 | TOC159 | Festuca arundinacea | gDNA |
| 87 | TOC159 | Ipomoea hederacea | cDNA |
| 88 | TOC159 | Kochia scoparia | cDNA |
| 89 | TOC159 | Lolium arundinaceum | gDNA |
| 90 | TOC159 | Lolium arundinaceum | gDNA |
| 91 | TOC159 | Lolium multiflorum | cDNA |
| 92 | TOC159 | Lolium multiflorum | cDNA |
| 93 | TOC159 | Lolium multiflorum | cDNA |
| 94 | TOC159 | Lolium multiflorum | gDNA |
| 95 | TOC159 | Lolium multiflorum | gDNA |
| 96 | TOC159 | Lolium multiflorum | gDNA |
| 97 | TOC159 | Lolium multiflorum | gDNA |
| 98 | TOC159 | Lolium multiflorum | gDNA |
| 99 | TOC159 | Lolium rigidium | gDNA |
| 100 | TOC159 | Lolium rigidium | gDNA |
| 101 | TOC159 | Portulaca oleracea | gDNA |
| 102 | TOC159 | Portulaca oleracea | gDNA |
| 103 | TOC159 | Portulaca oleracea | gDNA |
| 104 | TOC159 | Senna obtusifolia | cDNA |
| 105 | TOC159 | Senna obtusifolia | cDNA |
| 106 | TOC159 | Sorghum halepense | cDNA |
| 107 | TOC159 | Sorghum halepense | cDNA |
| 108 | TOC159 | Sorghum halepense | gDNA |
| 109 | TOC159 | Spirodela polyrrhiza | gDNA |
| 110 | TOC159 | Taraxacum officinale | gDNA |
| 111 | TOC159 | Trifolium repens | gDNA |
| 112 | TOC159 | Trifolium repens | gDNA |
| 113 | TOC159 | Trifolium repens | gDNA |
| 114 | TOC159 | Trifolium repens | gDNA |
| 115 | TOC159 | Trifolium repens | gDNA |
| 116 | TOC159 | Xanthium strumarium | cDNA |
| 117 | TOC159 | Xanthium strumarium | cDNA |
| 118 | TOC33 | Amaranthus palmeri | cDNA |
| 119 | TOC33 | Amaranthus palmeri | gDNA |
| 120 | TOC33 | Amaranthus palmeri | gDNA |
| 121 | TOC33 | Amaranthus palmeri | gDNA |
| 122 | TOC33 | Amaranthus rudis | cDNA |
| 123 | TOC33 | Amaranthus rudis | gDNA |
| 124 | TOC33 | Amaranthus rudis | gDNA |
| 125 | TOC33 | Amaranthus rudis | gDNA |
| 126 | TOC33 | Ambrosia artemisiifolia | gDNA |
| 127 | TOC33 | Ambrosia artemisiifolia | gDNA |
| 128 | TOC33 | Ambrosia artemisiifolia | gDNA |
| 129 | TOC33 | Ambrosia artemisiifolia | gDNA |
| 130 | TOC33 | Ambrosia trifida | cDNA |
| 131 | TOC33 | Ambrosia trifida | gDNA |
| 132 | TOC33 | Ambrosia trifida | gDNA |
| 133 | TOC33 | Commelina diffusa | cDNA |
| 134 | TOC33 | Cyperus esculentus | gDNA |
| 135 | TOC33 | Cyperus esculentus | gDNA |
| 136 | TOC33 | Euphorbia heterophylla | cDNA |
| 137 | TOC33 | Euphorbia heterophylla | gDNA |
| 138 | TOC33 | Festuca arundinacea | gDNA |
| 139 | TOC33 | Festuca arundinacea | gDNA |
| 140 | TOC33 | Festuca arundinacea | gDNA |
| 141 | TOC33 | Lolium arundinaceum | gDNA |
| 142 | TOC33 | Portulaca oleracea | gDNA |
| 143 | TOC33 | Portulaca oleracea | gDNA |
| 144 | TOC33 | Senna obtusifolia | cDNA |
| 145 | TOC33 | Sorghum halepense | gDNA |
| 146 | TOC33 | Sorghum halepense | gDNA |
| 147 | TOC33 | Sorghum halepense | gDNA |
| 148 | TOC33 | Spirodela polyrrhiza | gDNA |
| 149 | TOC33 | Taraxacum officinale | gDNA |
| 150 | TOC33 | Taraxacum officinale | gDNA |
| 151 | TOC33 | Trifolium repens | gDNA |
| 152 | TOC33 | Trifolium repens | gDNA |
| 153 | TOC33 | Trifolium repens | gDNA |
| 154 | TOC33 | Trifolium repens | gDNA |
| 155 | TOC33 | Xanthium strumarium | cDNA |
| 156 | TOC34 | Abutilon theophrasti | cDNA |
| 157 | TOC34 | Abutilon theophrasti | cDNA |
| 158 | TOC34 | Abutilon theophrasti | gDNA |
| 159 | TOC34 | Abutilon theophrasti | gDNA |
| 160 | TOC34 | Abutilon theophrasti | gDNA |
| 161 | TOC34 | Abutilon theophrasti | gDNA |
| 162 | TOC34 | Alopecurus myosuroides | cDNA |
| 163 | TOC34 | Alopecurus myosuroides | cDNA |
| 164 | TOC34 | Amaranthus albus | cDNA |
| 165 | TOC34 | Amaranthus graecizans | cDNA |
| 166 | TOC34 | Amaranthus hybridus | cDNA |
| 167 | TOC34 | Amaranthus lividus | cDNA |
| 168 | TOC34 | Amaranthus palmeri | cDNA |
| 169 | TOC34 | Amaranthus palmeri | gDNA |

TABLE 1-continued

Target chloroplast import protein system DNA sequence contigs from the various plant species.

| SEQ ID NO | GENE | SPECIES | SEQ_TYPE |
|---|---|---|---|
| 170 | TOC34 | Amaranthus palmeri | gDNA |
| 171 | TOC34 | Amaranthus rudis | cDNA |
| 172 | TOC34 | Amaranthus rudis | cDNA |
| 173 | TOC34 | Amaranthus rudis | gDNA |
| 174 | TOC34 | Amaranthus rudis | gDNA |
| 175 | TOC34 | Amaranthus rudis | gDNA |
| 176 | TOC34 | Amaranthus rudis | gDNA |
| 177 | TOC34 | Amaranthus rudis | gDNA |
| 178 | TOC34 | Amaranthus spinosus | cDNA |
| 179 | TOC34 | Amaranthus thunbergii | cDNA |
| 180 | TOC34 | Amaranthus viridis | cDNA |
| 181 | TOC34 | Ambrosia artemisiifolia | gDNA |
| 182 | TOC34 | Ambrosia artemisiifolia | gDNA |
| 183 | TOC34 | Ambrosia artemisiifolia | gDNA |
| 184 | TOC34 | Ambrosia artemisiifolia | gDNA |
| 185 | TOC34 | Ambrosia artemisiifolia | gDNA |
| 186 | TOC34 | Ambrosia trifida | cDNA |
| 187 | TOC34 | Ambrosia trifida | gDNA |
| 188 | TOC34 | Ambrosia trifida | gDNA |
| 189 | TOC34 | Ambrosia trifida | gDNA |
| 190 | TOC34 | Ambrosia trifida | gDNA |
| 191 | TOC34 | Ambrosia trifida | gDNA |
| 192 | TOC34 | Ambrosia trifida | gDNA |
| 193 | TOC34 | Chenopodium album | cDNA |
| 194 | TOC34 | Commelina diffusa | cDNA |
| 195 | TOC34 | Commelina diffusa | cDNA |
| 196 | TOC34 | Commelina diffusa | cDNA |
| 197 | TOC34 | Conyza canadensis | cDNA |
| 198 | TOC34 | Conyza canadensis | gDNA |
| 199 | TOC34 | Cyperus esculentus | gDNA |
| 200 | TOC34 | Cyperus esculentus | gDNA |
| 201 | TOC34 | Cyperus esculentus | gDNA |
| 202 | TOC34 | Digitaria sanguinalis | cDNA |
| 203 | TOC34 | Echinochloa crus-galli | cDNA |
| 204 | TOC34 | Euphorbia heterophylla | cDNA |
| 205 | TOC34 | Euphorbia heterophylla | gDNA |
| 206 | TOC34 | Festuca arundinacea | gDNA |
| 207 | TOC34 | Festuca arundinacea | gDNA |
| 208 | TOC34 | Festuca arundinacea | gDNA |
| 209 | TOC34 | Festuca arundinacea | gDNA |
| 210 | TOC34 | Festuca arundinacea | gDNA |
| 211 | TOC34 | Festuca arundinacea | gDNA |
| 212 | TOC34 | Ipomoea hederacea | cDNA |
| 213 | TOC34 | Kochia scoparia | gDNA |
| 214 | TOC34 | Kochia scoparia | gDNA |
| 215 | TOC34 | Lolium arundinaceum | gDNA |
| 216 | TOC34 | Lolium arundinaceum | gDNA |
| 217 | TOC34 | Lolium arundinaceum | gDNA |
| 218 | TOC34 | Lolium multiflorum | cDNA |
| 219 | TOC34 | Lolium multiflorum | gDNA |
| 220 | TOC34 | Lolium multiflorum | gDNA |
| 221 | TOC34 | Lolium multiflorum | gDNA |
| 222 | TOC34 | Lolium multiflorum | gDNA |
| 223 | TOC34 | Lolium rigidium | gDNA |
| 224 | TOC34 | Lolium rigidium | gDNA |
| 225 | TOC34 | Lolium rigidium | gDNA |
| 226 | TOC34 | Lolium rigidium | gDNA |
| 227 | TOC34 | Portulaca oleracea | gDNA |
| 228 | TOC34 | Portulaca oleracea | gDNA |
| 229 | TOC34 | Portulaca oleracea | gDNA |
| 230 | TOC34 | Portulaca oleracea | gDNA |
| 231 | TOC34 | Senna obtusifolia | cDNA |
| 232 | TOC34 | Sorghum halepense | gDNA |
| 233 | TOC34 | Sorghum halepense | gDNA |
| 234 | TOC34 | Sorghum halepense | gDNA |
| 235 | TOC34 | Spirodela polyrrhiza | gDNA |
| 236 | TOC34 | Taraxacum officinale | gDNA |
| 237 | TOC34 | Taraxacum officinale | gDNA |
| 238 | TOC34 | Taraxacum officinale | gDNA |
| 239 | TOC34 | Taraxacum officinale | gDNA |
| 240 | TOC34 | Trifolium repens | gDNA |
| 241 | TOC34 | Trifolium repens | gDNA |
| 242 | TOC34 | Trifolium repens | gDNA |
| 243 | TOC34 | Trifolium repens | gDNA |
| 244 | TOC34 | Trifolium repens | gDNA |
| 245 | TOC34 | Trifolium repens | gDNA |
| 246 | TOC34 | Xanthium strumarium | cDNA |
| 247 | TOC34 | Xanthium strumarium | cDNA |
| 248 | TOC75 | Abutilon theophrasti | cDNA |
| 249 | TOC75 | Abutilon theophrasti | gDNA |
| 250 | TOC75 | Abutilon theophrasti | gDNA |
| 251 | TOC75 | Abutilon theophrasti | gDNA |
| 252 | TOC75 | Abutilon theophrasti | gDNA |
| 253 | TOC75 | Abutilon theophrasti | gDNA |
| 254 | TOC75 | Amaranthus albus | cDNA |
| 255 | TOC75 | Amaranthus albus | cDNA |
| 256 | TOC75 | Amaranthus chlorostachys | cDNA |
| 257 | TOC75 | Amaranthus graecizans | cDNA |
| 258 | TOC75 | Amaranthus hybridus | cDNA |
| 259 | TOC75 | Amaranthus lividus | cDNA |
| 260 | TOC75 | Amaranthus palmeri | cDNA |
| 261 | TOC75 | Amaranthus palmeri | gDNA |
| 262 | TOC75 | Amaranthus palmeri | gDNA |
| 263 | TOC75 | Amaranthus palmeri | gDNA |
| 264 | TOC75 | Amaranthus rudis | cDNA |
| 265 | TOC75 | Amaranthus rudis | gDNA |
| 266 | TOC75 | Amaranthus rudis | gDNA |
| 267 | TOC75 | Amaranthus rudis | gDNA |
| 268 | TOC75 | Amaranthus rudis | gDNA |
| 269 | TOC75 | Amaranthus rudis | gDNA |
| 270 | TOC75 | Amaranthus rudis | gDNA |
| 271 | TOC75 | Amaranthus rudis | gDNA |
| 272 | TOC75 | Amaranthus spinosus | cDNA |
| 273 | TOC75 | Amaranthus thunbergii | cDNA |
| 274 | TOC75 | Amaranthus viridis | cDNA |
| 275 | TOC75 | Ambrosia artemisiifolia | gDNA |
| 276 | TOC75 | Ambrosia artemisiifolia | gDNA |
| 277 | TOC75 | Ambrosia artemisiifolia | gDNA |
| 278 | TOC75 | Ambrosia artemisiifolia | gDNA |
| 279 | TOC75 | Ambrosia artemisiifolia | gDNA |
| 280 | TOC75 | Ambrosia trifida | cDNA |
| 281 | TOC75 | Ambrosia trifida | gDNA |
| 282 | TOC75 | Ambrosia trifida | gDNA |
| 283 | TOC75 | Ambrosia trifida | gDNA |
| 284 | TOC75 | Ambrosia trifida | gDNA |
| 285 | TOC75 | Ambrosia trifida | gDNA |
| 286 | TOC75 | Ambrosia trifida | gDNA |
| 287 | TOC75 | Ambrosia trifida | gDNA |
| 288 | TOC75 | Ambrosia trifida | gDNA |
| 289 | TOC75 | Ambrosia trifida | gDNA |
| 290 | TOC75 | Ambrosia trifida | gDNA |
| 291 | TOC75 | Chenopodium album | cDNA |
| 292 | TOC75 | Commelina diffusa | cDNA |
| 293 | TOC75 | Commelina diffusa | cDNA |
| 294 | TOC75 | Convolvulus arvensis | cDNA |
| 295 | TOC75 | Conyza canadensis | cDNA |
| 296 | TOC75 | Conyza canadensis | cDNA |
| 297 | TOC75 | Conyza canadensis | gDNA |
| 298 | TOC75 | Cyperus esculentus | gDNA |
| 299 | TOC75 | Digitaria sanguinalis | cDNA |
| 300 | TOC75 | Digitaria sanguinalis | cDNA |
| 301 | TOC75 | Digitaria sanguinalis | gDNA |
| 302 | TOC75 | Digitaria sanguinalis | gDNA |
| 303 | TOC75 | Echinochloa crus-galli | cDNA |
| 304 | TOC75 | Echinochloa crus-galli | cDNA |
| 305 | TOC75 | Euphorbia heterophylla | cDNA |
| 306 | TOC75 | Euphorbia heterophylla | cDNA |
| 307 | TOC75 | Festuca arundinacea | gDNA |
| 308 | TOC75 | Festuca arundinacea | gDNA |
| 309 | TOC75 | Festuca arundinacea | gDNA |
| 310 | TOC75 | Festuca arundinacea | gDNA |
| 311 | TOC75 | Festuca arundinacea | gDNA |
| 312 | TOC75 | Festuca arundinacea | gDNA |
| 313 | TOC75 | Festuca arundinacea | gDNA |
| 314 | TOC75 | Festuca arundinacea | gDNA |
| 315 | TOC75 | Festuca arundinacea | gDNA |
| 316 | TOC75 | Festuca arundinacea | gDNA |
| 317 | TOC75 | Ipomoea hederacea | cDNA |
| 318 | TOC75 | Kochia scoparia | gDNA |
| 319 | TOC75 | Kochia scoparia | gDNA |

TABLE 1-continued

Target chloroplast import protein system DNA sequence contigs from the various plant species.

| SEQ ID NO | GENE | SPECIES | SEQ_TYPE |
|---|---|---|---|
| 320 | TOC75 | Kochia scoparia | gDNA |
| 321 | TOC75 | Kochia scoparia | gDNA |
| 322 | TOC75 | Kochia scoparia | gDNA |
| 323 | TOC75 | Kochia scoparia | gDNA |
| 324 | TOC75 | Lolium arundinaceum | gDNA |
| 325 | TOC75 | Lolium arundinaceum | gDNA |
| 326 | TOC75 | Lolium arundinaceum | gDNA |
| 327 | TOC75 | Lolium arundinaceum | gDNA |
| 328 | TOC75 | Lolium arundinaceum | gDNA |
| 329 | TOC75 | Lolium rigidium | gDNA |
| 330 | TOC75 | Lolium rigidium | gDNA |
| 331 | TOC75 | Lolium rigidium | gDNA |
| 332 | TOC75 | Lolium rigidium | gDNA |
| 333 | TOC75 | Lolium rigidium | gDNA |
| 334 | TOC75 | Portulaca oleracea | gDNA |
| 335 | TOC75 | Portulaca oleracea | gDNA |
| 336 | TOC75 | Portulaca oleracea | gDNA |
| 337 | TOC75 | Senna obtusifolia | cDNA |
| 338 | TOC75 | Sorghum halepense | gDNA |
| 339 | TOC75 | Sorghum halepense | gDNA |
| 340 | TOC75 | Spirodela polyrrhiza | gDNA |
| 341 | TOC75 | Taraxacum officinale | gDNA |
| 342 | TOC75 | Trifolium repens | gDNA |
| 343 | TOC75 | Trifolium repens | gDNA |
| 344 | TOC75 | Trifolium repens | gDNA |
| 345 | TOC75 | Trifolium repens | gDNA |
| 346 | TOC75 | Trifolium repens | gDNA |
| 347 | TOC75 | Trifolium repens | gDNA |
| 348 | TOC75 | Xanthium strumarium | cDNA |
| 349 | OEP80 | Abutilon theophrasti | cDNA |
| 350 | OEP80 | Abutilon theophrasti | cDNA |
| 351 | OEP80 | Abutilon theophrasti | gDNA |
| 352 | OEP80 | Abutilon theophrasti | gDNA |
| 353 | OEP80 | Abutilon theophrasti | gDNA |
| 354 | OEP80 | Abutilon theophrasti | gDNA |
| 355 | OEP80 | Abutilon theophrasti | gDNA |
| 356 | OEP80 | Abutilon theophrasti | gDNA |
| 357 | OEP80 | Abutilon theophrasti | gDNA |
| 358 | OEP80 | Amaranthus graecizans | cDNA |
| 359 | OEP80 | Amaranthus graecizans | cDNA |
| 360 | OEP80 | Amaranthus hybridus | cDNA |
| 361 | OEP80 | Amaranthus hybridus | cDNA |
| 362 | OEP80 | Amaranthus lividus | cDNA |
| 363 | OEP80 | Amaranthus lividus | cDNA |
| 364 | OEP80 | Amaranthus lividus | cDNA |
| 365 | OEP80 | Amaranthus palmeri | cDNA |
| 366 | OEP80 | Amaranthus palmeri | gDNA |
| 367 | OEP80 | Amaranthus rudis | cDNA |
| 368 | OEP80 | Amaranthus rudis | cDNA |
| 369 | OEP80 | Amaranthus rudis | cDNA |
| 370 | OEP80 | Amaranthus rudis | gDNA |
| 371 | OEP80 | Amaranthus rudis | gDNA |
| 372 | OEP80 | Amaranthus rudis | gDNA |
| 373 | OEP80 | Amaranthus rudis | gDNA |
| 374 | OEP80 | Amaranthus rudis | gDNA |
| 375 | OEP80 | Amaranthus rudis | gDNA |
| 376 | OEP80 | Amaranthus spinosus | cDNA |
| 377 | OEP80 | Amaranthus spinosus | cDNA |
| 378 | OEP80 | Amaranthus thunbergii | cDNA |
| 379 | OEP80 | Amaranthus viridis | cDNA |
| 380 | OEP80 | Amaranthus viridis | cDNA |
| 381 | OEP80 | Ambrosia artemisiifolia | gDNA |
| 382 | OEP80 | Ambrosia artemisiifolia | gDNA |
| 383 | OEP80 | Ambrosia artemisiifolia | gDNA |
| 384 | OEP80 | Ambrosia artemisiifolia | gDNA |
| 385 | OEP80 | Ambrosia artemisiifolia | gDNA |
| 386 | OEP80 | Ambrosia artemisiifolia | gDNA |
| 387 | OEP80 | Ambrosia trifida | cDNA |
| 388 | OEP80 | Ambrosia trifida | cDNA |
| 389 | OEP80 | Ambrosia trifida | gDNA |
| 390 | OEP80 | Ambrosia trifida | gDNA |
| 391 | OEP80 | Ambrosia trifida | gDNA |
| 392 | OEP80 | Ambrosia trifida | gDNA |
| 393 | OEP80 | Ambrosia trifida | gDNA |
| 394 | OEP80 | Ambrosia trifida | gDNA |
| 395 | OEP80 | Chenopodium album | cDNA |
| 396 | OEP80 | Conyza canadensis | cDNA |
| 397 | OEP80 | Conyza canadensis | cDNA |
| 398 | OEP80 | Conyza canadensis | gDNA |
| 399 | OEP80 | Conyza canadensis | gDNA |
| 400 | OEP80 | Cyperus esculentus | gDNA |
| 401 | OEP80 | Cyperus esculentus | gDNA |
| 402 | OEP80 | Cyperus esculentus | gDNA |
| 403 | OEP80 | Echinochloa colona | cDNA |
| 404 | OEP80 | Echinochloa crus-galli | cDNA |
| 405 | OEP80 | Echinochloa crus-galli | cDNA |
| 406 | OEP80 | Euphorbia heterophylla | cDNA |
| 407 | OEP80 | Euphorbia heterophylla | cDNA |
| 408 | OEP80 | Euphorbia heterophylla | cDNA |
| 409 | OEP80 | Euphorbia heterophylla | gDNA |
| 410 | OEP80 | Euphorbia heterophylla | gDNA |
| 411 | OEP80 | Euphorbia heterophylla | gDNA |
| 412 | OEP80 | Euphorbia heterophylla | gDNA |
| 413 | OEP80 | Euphorbia heterophylla | gDNA |
| 414 | OEP80 | Festuca arundinacea | gDNA |
| 415 | OEP80 | Festuca arundinacea | gDNA |
| 416 | OEP80 | Festuca arundinacea | gDNA |
| 417 | OEP80 | Festuca arundinacea | gDNA |
| 418 | OEP80 | Festuca arundinacea | gDNA |
| 419 | OEP80 | Festuca arundinacea | gDNA |
| 420 | OEP80 | Festuca arundinacea | gDNA |
| 421 | OEP80 | Festuca arundinacea | gDNA |
| 422 | OEP80 | Festuca arundinacea | gDNA |
| 423 | OEP80 | Festuca arundinacea | gDNA |
| 424 | OEP80 | Festuca arundinacea | gDNA |
| 425 | OEP80 | Ipomoea hederacea | cDNA |
| 426 | OEP80 | Ipomoea hederacea | cDNA |
| 427 | OEP80 | Kochia scoparia | gDNA |
| 428 | OEP80 | Lolium arundinaceum | gDNA |
| 429 | OEP80 | Lolium arundinaceum | gDNA |
| 430 | OEP80 | Lolium arundinaceum | gDNA |
| 431 | OEP80 | Lolium arundinaceum | gDNA |
| 432 | OEP80 | Lolium arundinaceum | gDNA |
| 433 | OEP80 | Lolium arundinaceum | gDNA |
| 434 | OEP80 | Lolium arundinaceum | gDNA |
| 435 | OEP80 | Lolium arundinaceum | gDNA |
| 436 | OEP80 | Lolium arundinaceum | gDNA |
| 437 | OEP80 | Lolium arundinaceum | gDNA |
| 438 | OEP80 | Lolium arundinaceum | gDNA |
| 439 | OEP80 | Lolium arundinaceum | gDNA |
| 440 | OEP80 | Lolium multiflorum | cDNA |
| 441 | OEP80 | Lolium multiflorum | gDNA |
| 442 | OEP80 | Lolium multiflorum | gDNA |
| 443 | OEP80 | Lolium multiflorum | gDNA |
| 444 | OEP80 | Lolium multiflorum | gDNA |
| 445 | OEP80 | Lolium multiflorum | gDNA |
| 446 | OEP80 | Lolium rigidium | gDNA |
| 447 | OEP80 | Lolium rigidium | gDNA |
| 448 | OEP80 | Lolium rigidium | gDNA |
| 449 | OEP80 | Lolium rigidium | gDNA |
| 450 | OEP80 | Lolium rigidium | gDNA |
| 451 | OEP80 | Lolium rigidium | gDNA |
| 452 | OEP80 | Lolium rigidium | gDNA |
| 453 | OEP80 | Lolium rigidium | gDNA |
| 454 | OEP80 | Lolium rigidium | gDNA |
| 455 | OEP80 | Portulaca oleracea | gDNA |
| 456 | OEP80 | Portulaca oleracea | gDNA |
| 457 | OEP80 | Portulaca oleracea | gDNA |
| 458 | OEP80 | Portulaca oleracea | gDNA |
| 459 | OEP80 | Portulaca oleracea | gDNA |
| 460 | OEP80 | Portulaca oleracea | gDNA |
| 461 | OEP80 | Senna obtusifolia | cDNA |
| 462 | OEP80 | Senna obtusifolia | cDNA |
| 463 | OEP80 | Sorghum halepense | gDNA |
| 464 | OEP80 | Sorghum halepense | gDNA |
| 465 | OEP80 | Sorghum halepense | gDNA |
| 466 | OEP80 | Sorghum halepense | gDNA |
| 467 | OEP80 | Sorghum halepense | gDNA |
| 468 | OEP80 | Spirodela polyrrhiza | gDNA |
| 469 | OEP80 | Spirodela polyrrhiza | gDNA |

TABLE 1-continued

Target chloroplast import protein system DNA sequence contigs from the various plant species.

| SEQ ID NO | GENE | SPECIES | SEQ_TYPE |
|---|---|---|---|
| 470 | OEP80 | Taraxacum officinale | gDNA |
| 471 | OEP80 | Taraxacum officinale | gDNA |
| 472 | OEP80 | Taraxacum officinale | gDNA |
| 473 | OEP80 | Taraxacum officinale | gDNA |
| 474 | OEP80 | Taraxacum officinale | gDNA |
| 475 | OEP80 | Taraxacum officinale | gDNA |
| 476 | OEP80 | Trifolium repens | gDNA |
| 477 | OEP80 | Trifolium repens | gDNA |
| 478 | OEP80 | Trifolium repens | gDNA |
| 479 | OEP80 | Trifolium repens | gDNA |
| 480 | OEP80 | Trifolium repens | gDNA |
| 481 | OEP80 | Trifolium repens | gDNA |
| 482 | OEP80 | Trifolium repens | gDNA |
| 483 | OEP80 | Trifolium repens | gDNA |
| 484 | OEP80 | Trifolium repens | gDNA |
| 485 | OEP80 | Xanthium strumarium | cDNA |
| 486 | TOC132 | Abutilon theophrasti | cDNA |
| 487 | TOC132 | Abutilon theophrasti | cDNA |
| 488 | TOC132 | Abutilon theophrasti | gDNA |
| 489 | TOC132 | Abutilon theophrasti | gDNA |
| 490 | TOC132 | Alopecurus myosuroides | cDNA |
| 491 | TOC132 | Amaranthus albus | cDNA |
| 492 | TOC132 | Amaranthus graecizans | cDNA |
| 493 | TOC132 | Amaranthus graecizans | cDNA |
| 494 | TOC132 | Amaranthus hybridus | cDNA |
| 495 | TOC132 | Amaranthus hybridus | cDNA |
| 496 | TOC132 | Amaranthus hybridus | cDNA |
| 497 | TOC132 | Amaranthus lividus | cDNA |
| 498 | TOC132 | Amaranthus lividus | cDNA |
| 499 | TOC132 | Amaranthus lividus | cDNA |
| 500 | TOC132 | Amaranthus palmeri | cDNA |
| 501 | TOC132 | Amaranthus palmeri | gDNA |
| 502 | TOC132 | Amaranthus rudis | cDNA |
| 503 | TOC132 | Amaranthus rudis | cDNA |
| 504 | TOC132 | Amaranthus rudis | cDNA |
| 505 | TOC132 | Amaranthus rudis | cDNA |
| 506 | TOC132 | Amaranthus rudis | cDNA |
| 507 | TOC132 | Amaranthus rudis | gDNA |
| 508 | TOC132 | Amaranthus rudis | gDNA |
| 509 | TOC132 | Amaranthus rudis | gDNA |
| 510 | TOC132 | Amaranthus rudis | gDNA |
| 511 | TOC132 | Amaranthus rudis | gDNA |
| 512 | TOC132 | Amaranthus spinosus | cDNA |
| 513 | TOC132 | Amaranthus spinosus | cDNA |
| 514 | TOC132 | Amaranthus spinosus | cDNA |
| 515 | TOC132 | Amaranthus thunbergii | cDNA |
| 516 | TOC132 | Amaranthus thunbergii | cDNA |
| 517 | TOC132 | Amaranthus viridis | cDNA |
| 518 | TOC132 | Amaranthus viridis | cDNA |
| 519 | TOC132 | Ambrosia artemisiifolia | gDNA |
| 520 | TOC132 | Ambrosia trifida | cDNA |
| 521 | TOC132 | Ambrosia trifida | cDNA |
| 522 | TOC132 | Avena fatua | cDNA |
| 523 | TOC132 | Chenopodium album | cDNA |
| 524 | TOC132 | Chenopodium album | cDNA |
| 525 | TOC132 | Commelina diffusa | cDNA |
| 526 | TOC132 | Convolvulus arvensis | cDNA |
| 527 | TOC132 | Convolvulus arvensis | cDNA |
| 528 | TOC132 | Conyza canadensis | cDNA |
| 529 | TOC132 | Conyza canadensis | cDNA |
| 530 | TOC132 | Conyza canadensis | cDNA |
| 531 | TOC132 | Conyza canadensis | gDNA |
| 532 | TOC132 | Conyza canadensis | gDNA |
| 533 | TOC132 | Cyperus esculentus | cDNA |
| 534 | TOC132 | Digitaria sanguinalis | cDNA |
| 535 | TOC132 | Digitaria sanguinalis | cDNA |
| 536 | TOC132 | Echinochloa colona | cDNA |
| 537 | TOC132 | Echinochloa crus-galli | cDNA |
| 538 | TOC132 | Euphorbia heterophylla | cDNA |
| 539 | TOC132 | Euphorbia heterophylla | cDNA |
| 540 | TOC132 | Euphorbia heterophylla | cDNA |
| 541 | TOC132 | Euphorbia heterophylla | cDNA |
| 542 | TOC132 | Euphorbia heterophylla | cDNA |
| 543 | TOC132 | Euphorbia heterophylla | gDNA |
| 544 | TOC132 | Euphorbia heterophylla | gDNA |
| 545 | TOC132 | Festuca arundinacea | gDNA |
| 546 | TOC132 | Festuca arundinacea | gDNA |
| 547 | TOC132 | Festuca arundinacea | gDNA |
| 548 | TOC132 | Festuca arundinacea | gDNA |
| 549 | TOC132 | Festuca arundinacea | gDNA |
| 550 | TOC132 | Festuca arundinacea | gDNA |
| 551 | TOC132 | Ipomoea hederacea | cDNA |
| 552 | TOC132 | Kochia scoparia | gDNA |
| 553 | TOC132 | Kochia scoparia | gDNA |
| 554 | TOC132 | Lolium arundinaceum | gDNA |
| 555 | TOC132 | Lolium arundinaceum | gDNA |
| 556 | TOC132 | Lolium rigidium | gDNA |
| 557 | TOC132 | Portulaca oleracea | gDNA |
| 558 | TOC132 | Portulaca oleracea | gDNA |
| 559 | TOC132 | Portulaca oleracea | gDNA |
| 560 | TOC132 | Senna obtusifolia | cDNA |
| 561 | TOC132 | Senna obtusifolia | cDNA |
| 562 | TOC132 | Sorghum halepense | cDNA |
| 563 | TOC132 | Spirodela polyrrhiza | cDNA |
| 564 | TOC132 | Taraxacum officinale | gDNA |
| 565 | TOC132 | Taraxacum officinale | gDNA |
| 566 | TOC132 | Trifolium repens | gDNA |
| 567 | TOC132 | Trifolium repens | gDNA |
| 568 | TOC132 | Xanthium strumarium | cDNA |
| 569 | TOC132 | Xanthium strumarium | cDNA |
| 570 | TIC110 | Abutilon theophrasti | cDNA |
| 571 | TIC110 | Abutilon theophrasti | gDNA |
| 572 | TIC110 | Abutilon theophrasti | gDNA |
| 573 | TIC110 | Abutilon theophrasti | gDNA |
| 574 | TIC110 | Abutilon theophrasti | gDNA |
| 575 | TIC110 | Abutilon theophrasti | gDNA |
| 576 | TIC110 | Abutilon theophrasti | gDNA |
| 577 | TIC110 | Abutilon theophrasti | gDNA |
| 578 | TIC110 | Alopecurus myosuroides | cDNA |
| 579 | TIC110 | Alopecurus myosuroides | cDNA |
| 580 | TIC110 | Amaranthus albus | cDNA |
| 581 | TIC110 | Amaranthus albus | cDNA |
| 582 | TIC110 | Amaranthus albus | cDNA |
| 583 | TIC110 | Amaranthus chlorostachys | cDNA |
| 584 | TIC110 | Amaranthus graecizans | cDNA |
| 585 | TIC110 | Amaranthus hybridus | cDNA |
| 586 | TIC110 | Amaranthus hybridus | cDNA |
| 587 | TIC110 | Amaranthus lividus | cDNA |
| 588 | TIC110 | Amaranthus palmeri | cDNA |
| 589 | TIC110 | Amaranthus palmeri | gDNA |
| 590 | TIC110 | Amaranthus rudis | cDNA |
| 591 | TIC110 | Amaranthus rudis | cDNA |
| 592 | TIC110 | Amaranthus rudis | cDNA |
| 593 | TIC110 | Amaranthus rudis | gDNA |
| 594 | TIC110 | Amaranthus rudis | gDNA |
| 595 | TIC110 | Amaranthus rudis | gDNA |
| 596 | TIC110 | Amaranthus rudis | gDNA |
| 597 | TIC110 | Amaranthus rudis | gDNA |
| 598 | TIC110 | Amaranthus rudis | gDNA |
| 599 | TIC110 | Amaranthus rudis | gDNA |
| 600 | TIC110 | Amaranthus rudis | gDNA |
| 601 | TIC110 | Amaranthus rudis | gDNA |
| 602 | TIC110 | Amaranthus rudis | gDNA |
| 603 | TIC110 | Amaranthus spinosus | cDNA |
| 604 | TIC110 | Amaranthus thunbergii | cDNA |
| 605 | TIC110 | Amaranthus viridis | cDNA |
| 606 | TIC110 | Ambrosia artemisiifolia | cDNA |
| 607 | TIC110 | Ambrosia artemisiifolia | gDNA |
| 608 | TIC110 | Ambrosia artemisiifolia | gDNA |
| 609 | TIC110 | Ambrosia artemisiifolia | gDNA |
| 610 | TIC110 | Ambrosia artemisiifolia | gDNA |
| 611 | TIC110 | Ambrosia artemisiifolia | gDNA |
| 612 | TIC110 | Ambrosia artemisiifolia | gDNA |
| 613 | TIC110 | Ambrosia artemisiifolia | gDNA |
| 614 | TIC110 | Ambrosia artemisiifolia | gDNA |
| 615 | TIC110 | Ambrosia trifida | cDNA |
| 616 | TIC110 | Ambrosia trifida | gDNA |
| 617 | TIC110 | Ambrosia trifida | gDNA |
| 618 | TIC110 | Ambrosia trifida | gDNA |
| 619 | TIC110 | Ambrosia trifida | gDNA |

TABLE 1-continued

Target chloroplast import protein system DNA sequence contigs from the various plant species.

| SEQ ID NO | GENE | SPECIES | SEQ_TYPE |
|---|---|---|---|
| 620 | TIC110 | Ambrosia trifida | gDNA |
| 621 | TIC110 | Ambrosia trifida | gDNA |
| 622 | TIC110 | Ambrosia trifida | gDNA |
| 623 | TIC110 | Ambrosia trifida | gDNA |
| 624 | TIC110 | Ambrosia trifida | gDNA |
| 625 | TIC110 | Ambrosia trifida | gDNA |
| 626 | TIC110 | Ambrosia trifida | gDNA |
| 627 | TIC110 | Ambrosia trifida | gDNA |
| 628 | TIC110 | Avena fatua | cDNA |
| 629 | TIC110 | Chenopodium album | cDNA |
| 630 | TIC110 | Chenopodium album | cDNA |
| 631 | TIC110 | Convolvulus arvensis | cDNA |
| 632 | TIC110 | Convolvulus arvensis | cDNA |
| 633 | TIC110 | Conyza canadensis | cDNA |
| 634 | TIC110 | Conyza canadensis | gDNA |
| 635 | TIC110 | Conyza canadensis | gDNA |
| 636 | TIC110 | Conyza canadensis | gDNA |
| 637 | TIC110 | Conyza canadensis | gDNA |
| 638 | TIC110 | Cyperus esculentus | gDNA |
| 639 | TIC110 | Cyperus esculentus | gDNA |
| 640 | TIC110 | Digitaria sanguinalis | cDNA |
| 641 | TIC110 | Digitaria sanguinalis | cDNA |
| 642 | TIC110 | Digitaria sanguinalis | cDNA |
| 643 | TIC110 | Digitaria sanguinalis | cDNA |
| 644 | TIC110 | Digitaria sanguinalis | gDNA |
| 645 | TIC110 | Digitaria sanguinalis | gDNA |
| 646 | TIC110 | Digitaria sanguinalis | gDNA |
| 647 | TIC110 | Digitaria sanguinalis | gDNA |
| 648 | TIC110 | Echinochloa colona | cDNA |
| 649 | TIC110 | Echinochloa crus-galli | cDNA |
| 650 | TIC110 | Euphorbia heterophylla | cDNA |
| 651 | TIC110 | Euphorbia heterophylla | gDNA |
| 652 | TIC110 | Euphorbia heterophylla | gDNA |
| 653 | TIC110 | Euphorbia heterophylla | gDNA |
| 654 | TIC110 | Euphorbia heterophylla | gDNA |
| 655 | TIC110 | Festuca arundinacea | gDNA |
| 656 | TIC110 | Festuca arundinacea | gDNA |
| 657 | TIC110 | Festuca arundinacea | gDNA |
| 658 | TIC110 | Festuca arundinacea | gDNA |
| 659 | TIC110 | Festuca arundinacea | gDNA |
| 660 | TIC110 | Festuca arundinacea | gDNA |
| 661 | TIC110 | Festuca arundinacea | gDNA |
| 662 | TIC110 | Festuca arundinacea | gDNA |
| 663 | TIC110 | Ipomoea hederacea | cDNA |
| 664 | TIC110 | Kochia scoparia | gDNA |
| 665 | TIC110 | Kochia scoparia | gDNA |
| 666 | TIC110 | Kochia scoparia | gDNA |
| 667 | TIC110 | Kochia scoparia | gDNA |
| 668 | TIC110 | Lolium arundinaceum | gDNA |
| 669 | TIC110 | Lolium arundinaceum | gDNA |
| 670 | TIC110 | Lolium arundinaceum | gDNA |
| 671 | TIC110 | Lolium arundinaceum | gDNA |
| 672 | TIC110 | Lolium arundinaceum | gDNA |
| 673 | TIC110 | Lolium arundinaceum | gDNA |
| 674 | TIC110 | Lolium arundinaceum | gDNA |
| 675 | TIC110 | Lolium arundinaceum | gDNA |
| 676 | TIC110 | Lolium multiflorum | cDNA |
| 677 | TIC110 | Lolium multiflorum | cDNA |
| 678 | TIC110 | Lolium multiflorum | cDNA |
| 679 | TIC110 | Lolium multiflorum | gDNA |
| 680 | TIC110 | Lolium multiflorum | gDNA |
| 681 | TIC110 | Lolium multiflorum | gDNA |
| 682 | TIC110 | Lolium multiflorum | gDNA |
| 683 | TIC110 | Lolium multiflorum | gDNA |
| 684 | TIC110 | Lolium multiflorum | gDNA |
| 685 | TIC110 | Lolium multiflorum | gDNA |
| 686 | TIC110 | Lolium multiflorum | gDNA |
| 687 | TIC110 | Lolium multiflorum | gDNA |
| 688 | TIC110 | Lolium multiflorum | gDNA |
| 689 | TIC110 | Lolium rigidium | gDNA |
| 690 | TIC110 | Lolium rigidium | gDNA |
| 691 | TIC110 | Lolium rigidium | gDNA |
| 692 | TIC110 | Portulaca oleracea | gDNA |
| 693 | TIC110 | Portulaca oleracea | gDNA |
| 694 | TIC110 | Portulaca oleracea | gDNA |
| 695 | TIC110 | Portulaca oleracea | gDNA |
| 696 | TIC110 | Portulaca oleracea | gDNA |
| 697 | TIC110 | Portulaca oleracea | gDNA |
| 698 | TIC110 | Portulaca oleracea | gDNA |
| 699 | TIC110 | Senna obtusifolia | cDNA |
| 700 | TIC110 | Setaria viridis | cDNA |
| 701 | TIC110 | Sorghum halepense | cDNA |
| 702 | TIC110 | Sorghum halepense | cDNA |
| 703 | TIC110 | Sorghum halepense | gDNA |
| 704 | TIC110 | Sorghum halepense | gDNA |
| 705 | TIC110 | Sorghum halepense | gDNA |
| 706 | TIC110 | Spirodela polyrrhiza | gDNA |
| 707 | TIC110 | Taraxacum officinale | gDNA |
| 708 | TIC110 | Taraxacum officinale | gDNA |
| 709 | TIC110 | Taraxacum officinale | gDNA |
| 710 | TIC110 | Taraxacum officinale | gDNA |
| 711 | TIC110 | Taraxacum officinale | gDNA |
| 712 | TIC110 | Taraxacum officinale | gDNA |
| 713 | TIC110 | Trifolium repens | gDNA |
| 714 | TIC110 | Trifolium repens | gDNA |
| 715 | TIC110 | Trifolium repens | gDNA |
| 716 | TIC110 | Trifolium repens | gDNA |
| 717 | TIC110 | Trifolium repens | gDNA |
| 718 | TIC110 | Trifolium repens | gDNA |
| 719 | TIC110 | Trifolium repens | gDNA |
| 720 | TIC110 | Trifolium repens | gDNA |
| 721 | TIC110 | Trifolium repens | gDNA |
| 722 | TIC110 | Xanthium strumarium | cDNA |
| 723 | TIC20 | Abutilon theophrasti | cDNA |
| 724 | TIC20 | Abutilon theophrasti | gDNA |
| 725 | TIC20 | Alopecurus myosuroides | cDNA |
| 726 | TIC20 | Amaranthus albus | cDNA |
| 727 | TIC20 | Amaranthus chlorostachys | cDNA |
| 728 | TIC20 | Amaranthus graecizans | cDNA |
| 729 | TIC20 | Amaranthus hybridus | cDNA |
| 730 | TIC20 | Amaranthus lividus | cDNA |
| 731 | TIC20 | Amaranthus palmeri | cDNA |
| 732 | TIC20 | Amaranthus palmeri | cDNA |
| 733 | TIC20 | Amaranthus palmeri | gDNA |
| 734 | TIC20 | Amaranthus palmeri | gDNA |
| 735 | TIC20 | Amaranthus rudis | cDNA |
| 736 | TIC20 | Amaranthus rudis | gDNA |
| 737 | TIC20 | Amaranthus spinosus | cDNA |
| 738 | TIC20 | Amaranthus thunbergii | cDNA |
| 739 | TIC20 | Amaranthus viridis | cDNA |
| 740 | TIC20 | Ambrosia artemisiifolia | gDNA |
| 741 | TIC20 | Ambrosia trifida | cDNA |
| 742 | TIC20 | Ambrosia trifida | gDNA |
| 743 | TIC20 | Ambrosia trifida | gDNA |
| 744 | TIC20 | Ambrosia trifida | gDNA |
| 745 | TIC20 | Chenopodium album | cDNA |
| 746 | TIC20 | Commelina diffusa | cDNA |
| 747 | TIC20 | Conyza canadensis | cDNA |
| 748 | TIC20 | Conyza canadensis | gDNA |
| 749 | TIC20 | Cyperus esculentus | gDNA |
| 750 | TIC20 | Digitaria sanguinalis | cDNA |
| 751 | TIC20 | Echinochloa colona | cDNA |
| 752 | TIC20 | Echinochloa crus-galli | cDNA |
| 753 | TIC20 | Euphorbia heterophylla | cDNA |
| 754 | TIC20 | Euphorbia heterophylla | gDNA |
| 755 | TIC20 | Festuca arundinacea | gDNA |
| 756 | TIC20 | Festuca arundinacea | gDNA |
| 757 | TIC20 | Ipomoea hederacea | cDNA |
| 758 | TIC20 | Kochia scoparia | gDNA |
| 759 | TIC20 | Lolium arundinaceum | gDNA |
| 760 | TIC20 | Lolium multiflorum | cDNA |
| 761 | TIC20 | Lolium multiflorum | gDNA |
| 762 | TIC20 | Lolium multiflorum | gDNA |
| 763 | TIC20 | Lolium rigidium | gDNA |
| 764 | TIC20 | Portulaca oleracea | gDNA |
| 765 | TIC20 | Senna obtusifolia | cDNA |
| 766 | TIC20 | Sorghum halepense | gDNA |
| 767 | TIC20 | Spirodela polyrrhiza | gDNA |
| 768 | TIC20 | Taraxacum officinale | gDNA |
| 769 | TIC20 | Trifolium repens | gDNA |

TABLE 1-continued

Target chloroplast import protein system DNA sequence contigs from the various plant species.

| SEQ ID NO | GENE | SPECIES | SEQ_TYPE |
|---|---|---|---|
| 770 | TIC20 | Xanthium strumarium | cDNA |
| 771 | TIC20 | Xanthium strumarium | cDNA |
| 772 | TIC21 | Abutilon theophrasti | cDNA |
| 773 | TIC21 | Abutilon theophrasti | gDNA |
| 774 | TIC21 | Abutilon theophrasti | gDNA |
| 775 | TIC21 | Amaranthus albus | cDNA |
| 776 | TIC21 | Amaranthus chlorostachys | cDNA |
| 111 | TIC21 | Amaranthus graecizans | cDNA |
| 778 | TIC21 | Amaranthus hybridus | cDNA |
| 779 | TIC21 | Amaranthus lividus | cDNA |
| 780 | TIC21 | Amaranthus palmeri | cDNA |
| 781 | TIC21 | Amaranthus palmeri | gDNA |
| 782 | TIC21 | Amaranthus palmeri | gDNA |
| 783 | TIC21 | Amaranthus rudis | cDNA |
| 784 | TIC21 | Amaranthus rudis | gDNA |
| 785 | TIC21 | Amaranthus rudis | gDNA |
| 786 | TIC21 | Amaranthus rudis | gDNA |
| 787 | TIC21 | Amaranthus spinosus | cDNA |
| 788 | TIC21 | Amaranthus thunbergii | cDNA |
| 789 | TIC21 | Amaranthus viridis | cDNA |
| 790 | TIC21 | Ambrosia artemisiifolia | gDNA |
| 791 | TIC21 | Ambrosia artemisiifolia | gDNA |
| 792 | TIC21 | Ambrosia artemisiifolia | gDNA |
| 793 | TIC21 | Ambrosia trifida | cDNA |
| 794 | TIC21 | Ambrosia trifida | gDNA |
| 795 | TIC21 | Ambrosia trifida | gDNA |
| 796 | TIC21 | Ambrosia trifida | gDNA |
| 797 | TIC21 | Ambrosia trifida | gDNA |
| 798 | TIC21 | Ambrosia trifida | gDNA |
| 799 | TIC21 | Ambrosia trifida | gDNA |
| 800 | TIC21 | Ambrosia trifida | gDNA |
| 801 | TIC21 | Chenopodium album | cDNA |
| 802 | TIC21 | Commelina diffusa | cDNA |
| 803 | TIC21 | Convolvulus arvensis | cDNA |
| 804 | TIC21 | Conyza canadensis | cDNA |
| 805 | TIC21 | Conyza canadensis | gDNA |
| 806 | TIC21 | Cyperus esculentus | gDNA |
| 807 | TIC21 | Cyperus esculentus | gDNA |
| 808 | TIC21 | Digitaria sanguinalis | cDNA |
| 809 | TIC21 | Digitaria sanguinalis | gDNA |
| 810 | TIC21 | Digitaria sanguinalis | gDNA |
| 811 | TIC21 | Echinochloa colona | cDNA |
| 812 | TIC21 | Echinochloa crus-galli | cDNA |
| 813 | TIC21 | Euphorbia heterophylla | cDNA |
| 814 | TIC21 | Euphorbia heterophylla | gDNA |
| 815 | TIC21 | Euphorbia heterophylla | gDNA |
| 816 | TIC21 | Euphorbia heterophylla | gDNA |
| 817 | TIC21 | Euphorbia heterophylla | gDNA |
| 818 | TIC21 | Festuca arundinacea | gDNA |
| 819 | TIC21 | Ipomoea hederacea | cDNA |
| 820 | TIC21 | Kochia scoparia | gDNA |
| 821 | TIC21 | Lolium arundinaceum | gDNA |
| 822 | TIC21 | Lolium arundinaceum | gDNA |
| 823 | TIC21 | Lolium rigidium | gDNA |
| 824 | TIC21 | Lolium rigidium | gDNA |
| 825 | TIC21 | Lolium rigidium | gDNA |
| 826 | TIC21 | Portulaca oleracea | gDNA |
| 827 | TIC21 | Portulaca oleracea | gDNA |
| 828 | TIC21 | Portulaca oleracea | gDNA |
| 829 | TIC21 | Senna obtusifolia | cDNA |
| 830 | TIC21 | Setaria viridis | cDNA |
| 831 | TIC21 | Sorghum halepense | cDNA |
| 832 | TIC21 | Sorghum halepense | gDNA |
| 833 | TIC21 | Sorghum halepense | gDNA |
| 834 | TIC21 | Spirodela polyrrhiza | gDNA |
| 835 | TIC21 | Taraxacum officinale | gDNA |
| 836 | TIC21 | Taraxacum officinale | gDNA |
| 837 | TIC21 | Trifolium repens | gDNA |
| 838 | TIC21 | Trifolium repens | cDNA |
| 839 | TIC21 | Xanthium strumarium | cDNA |
| 840 | TIC21 | Xanthium strumarium | cDNA |
| 841 | TIC40 | Abutilon theophrasti | cDNA |
| 842 | TIC40 | Abutilon theophrasti | gDNA |
| 843 | TIC40 | Abutilon theophrasti | gDNA |
| 844 | TIC40 | Abutilon theophrasti | gDNA |
| 845 | TIC40 | Abutilon theophrasti | gDNA |
| 846 | TIC40 | Abutilon theophrasti | gDNA |
| 847 | TIC40 | Abutilon theophrasti | gDNA |
| 848 | TIC40 | Abutilon theophrasti | gDNA |
| 849 | TIC40 | Abutilon theophrasti | gDNA |
| 850 | TIC40 | Abutilon theophrasti | gDNA |
| 851 | TIC40 | Alopecurus myosuroides | cDNA |
| 852 | TIC40 | Amaranthus albus | cDNA |
| 853 | TIC40 | Amaranthus albus | cDNA |
| 854 | TIC40 | Amaranthus chlorostachys | cDNA |
| 855 | TIC40 | Amaranthus graecizans | cDNA |
| 856 | TIC40 | Amaranthus hybridus | cDNA |
| 857 | TIC40 | Amaranthus lividus | cDNA |
| 858 | TIC40 | Amaranthus palmeri | cDNA |
| 859 | TIC40 | Amaranthus palmeri | gDNA |
| 860 | TIC40 | Amaranthus palmeri | gDNA |
| 861 | TIC40 | Amaranthus palmeri | gDNA |
| 862 | TIC40 | Amaranthus palmeri | gDNA |
| 863 | TIC40 | Amaranthus palmeri | gDNA |
| 864 | TIC40 | Amaranthus rudis | cDNA |
| 865 | TIC40 | Amaranthus rudis | gDNA |
| 866 | TIC40 | Amaranthus rudis | gDNA |
| 867 | TIC40 | Amaranthus rudis | gDNA |
| 868 | TIC40 | Amaranthus rudis | gDNA |
| 869 | TIC40 | Amaranthus rudis | gDNA |
| 870 | TIC40 | Amaranthus spinosus | cDNA |
| 871 | TIC40 | Amaranthus spinosus | cDNA |
| 872 | TIC40 | Amaranthus thunbergii | cDNA |
| 873 | TIC40 | Amaranthus viridis | cDNA |
| 874 | TIC40 | Ambrosia artemisiifolia | gDNA |
| 875 | TIC40 | Ambrosia artemisiifolia | gDNA |
| 876 | TIC40 | Ambrosia trifida | cDNA |
| 877 | TIC40 | Ambrosia trifida | gDNA |
| 878 | TIC40 | Ambrosia trifida | gDNA |
| 879 | TIC40 | Ambrosia trifida | gDNA |
| 880 | TIC40 | Ambrosia trifida | gDNA |
| 881 | TIC40 | Ambrosia trifida | gDNA |
| 882 | TIC40 | Ambrosia trifida | gDNA |
| 883 | TIC40 | Chenopodium album | cDNA |
| 884 | TIC40 | Commelina diffusa | cDNA |
| 885 | TIC40 | Conyza canadensis | cDNA |
| 886 | TIC40 | Conyza canadensis | gDNA |
| 887 | TIC40 | Cyperus esculentus | gDNA |
| 888 | TIC40 | Echinochloa colona | cDNA |
| 889 | TIC40 | Echinochloa crus-galli | cDNA |
| 890 | TIC40 | Euphorbia heterophylla | cDNA |
| 891 | TIC40 | Euphorbia heterophylla | gDNA |
| 892 | TIC40 | Euphorbia heterophylla | gDNA |
| 893 | TIC40 | Euphorbia heterophylla | gDNA |
| 894 | TIC40 | Euphorbia heterophylla | gDNA |
| 895 | TIC40 | Festuca arundinacea | gDNA |
| 896 | TIC40 | Ipomoea hederacea | cDNA |
| 897 | TIC40 | Kochia scoparia | gDNA |
| 898 | TIC40 | Kochia scoparia | gDNA |
| 899 | TIC40 | Lolium arundinaceum | gDNA |
| 900 | TIC40 | Lolium arundinaceum | gDNA |
| 901 | TIC40 | Lolium rigidium | gDNA |
| 902 | TIC40 | Lolium rigidium | gDNA |
| 903 | TIC40 | Portulaca oleracea | gDNA |
| 904 | TIC40 | Portulaca oleracea | gDNA |
| 905 | TIC40 | Portulaca oleracea | gDNA |
| 906 | TIC40 | Senna obtusifolia | cDNA |
| 907 | TIC40 | Sorghum halepense | cDNA |
| 908 | TIC40 | Sorghum halepense | gDNA |
| 909 | TIC40 | Spirodela polyrrhiza | gDNA |
| 910 | TIC40 | Taraxacum officinale | gDNA |
| 911 | TIC40 | Trifolium repens | cDNA |
| 912 | TIC40 | Xanthium strumarium | cDNA |
| 913 | SPP | Abutilon theophrasti | cDNA |
| 914 | SPP | Abutilon theophrasti | cDNA |
| 915 | SPP | Abutilon theophrasti | gDNA |
| 916 | SPP | Abutilon theophrasti | gDNA |
| 917 | SPP | Abutilon theophrasti | gDNA |
| 918 | SPP | Abutilon theophrasti | gDNA |
| 919 | SPP | Abutilon theophrasti | gDNA |

TABLE 1-continued

Target chloroplast import protein system DNA sequence contigs from the various plant species.

| SEQ ID NO | GENE | SPECIES | SEQ_TYPE |
|---|---|---|---|
| 920 | SPP | *Abutilon theophrasti* | gDNA |
| 921 | SPP | *Abutilon theophrasti* | gDNA |
| 922 | SPP | *Abutilon theophrasti* | gDNA |
| 923 | SPP | *Abutilon theophrasti* | gDNA |
| 924 | SPP | *Abutilon theophrasti* | gDNA |
| 925 | SPP | *Abutilon theophrasti* | gDNA |
| 926 | SPP | *Abutilon theophrasti* | gDNA |
| 927 | SPP | *Abutilon theophrasti* | gDNA |
| 928 | SPP | *Abutilon theophrasti* | gDNA |
| 929 | SPP | *Abutilon theophrasti* | gDNA |
| 930 | SPP | *Alopecurus myosuroides* | cDNA |
| 931 | SPP | *Alopecurus myosuroides* | cDNA |
| 932 | SPP | *Alopecurus myosuroides* | cDNA |
| 933 | SPP | *Amaranthus albus* | cDNA |
| 934 | SPP | *Amaranthus albus* | cDNA |
| 935 | SPP | *Amaranthus albus* | cDNA |
| 936 | SPP | *Amaranthus chlorostachys* | cDNA |
| 937 | SPP | *Amaranthus chlorostachys* | cDNA |
| 938 | SPP | *Amaranthus chlorostachys* | cDNA |
| 939 | SPP | *Amaranthus graecizans* | cDNA |
| 940 | SPP | *Amaranthus graecizans* | cDNA |
| 941 | SPP | *Amaranthus hybridus* | cDNA |
| 942 | SPP | *Amaranthus hybridus* | cDNA |
| 943 | SPP | *Amaranthus hybridus* | cDNA |
| 944 | SPP | *Amaranthus hybridus* | cDNA |
| 945 | SPP | *Amaranthus lividus* | cDNA |
| 946 | SPP | *Amaranthus lividus* | cDNA |
| 947 | SPP | *Amaranthus lividus* | cDNA |
| 948 | SPP | *Amaranthus lividus* | cDNA |
| 949 | SPP | *Amaranthus lividus* | cDNA |
| 950 | SPP | *Amaranthus palmeri* | cDNA |
| 951 | SPP | *Amaranthus palmeri* | gDNA |
| 952 | SPP | *Amaranthus palmeri* | gDNA |
| 953 | SPP | *Amaranthus palmeri* | gDNA |
| 954 | SPP | *Amaranthus palmeri* | gDNA |
| 955 | SPP | *Amaranthus palmeri* | gDNA |
| 956 | SPP | *Amaranthus palmeri* | gDNA |
| 957 | SPP | *Amaranthus rudis* | cDNA |
| 958 | SPP | *Amaranthus rudis* | cDNA |
| 959 | SPP | *Amaranthus rudis* | gDNA |
| 960 | SPP | *Amaranthus rudis* | gDNA |
| 961 | SPP | *Amaranthus rudis* | gDNA |
| 962 | SPP | *Amaranthus rudis* | gDNA |
| 963 | SPP | *Amaranthus rudis* | gDNA |
| 964 | SPP | *Amaranthus rudis* | gDNA |
| 965 | SPP | *Amaranthus rudis* | gDNA |
| 966 | SPP | *Amaranthus rudis* | gDNA |
| 967 | SPP | *Amaranthus spinosus* | cDNA |
| 968 | SPP | *Amaranthus spinosus* | cDNA |
| 969 | SPP | *Amaranthus spinosus* | cDNA |
| 970 | SPP | *Amaranthus thunbergii* | cDNA |
| 971 | SPP | *Amaranthus thunbergii* | cDNA |
| 972 | SPP | *Amaranthus thunbergii* | cDNA |
| 973 | SPP | *Amaranthus thunbergii* | cDNA |
| 974 | SPP | *Amaranthus viridis* | cDNA |
| 975 | SPP | *Amaranthus viridis* | cDNA |
| 976 | SPP | *Amaranthus viridis* | cDNA |
| 977 | SPP | *Ambrosia artemisiifolia* | gDNA |
| 978 | SPP | *Ambrosia artemisiifolia* | gDNA |
| 979 | SPP | *Ambrosia artemisiifolia* | gDNA |
| 980 | SPP | *Ambrosia artemisiifolia* | gDNA |
| 981 | SPP | *Ambrosia artemisiifolia* | gDNA |
| 982 | SPP | *Ambrosia artemisiifolia* | gDNA |
| 983 | SPP | *Ambrosia artemisiifolia* | gDNA |
| 984 | SPP | *Ambrosia artemisiifolia* | gDNA |
| 985 | SPP | *Ambrosia artemisiifolia* | gDNA |
| 986 | SPP | *Ambrosia artemisiifolia* | gDNA |
| 987 | SPP | *Ambrosia artemisiifolia* | gDNA |
| 988 | SPP | *Ambrosia artemisiifolia* | gDNA |
| 989 | SPP | *Ambrosia artemisiifolia* | gDNA |
| 990 | SPP | *Ambrosia artemisiifolia* | gDNA |
| 991 | SPP | *Ambrosia artemisiifolia* | gDNA |
| 992 | SPP | *Ambrosia trifida* | cDNA |
| 993 | SPP | *Ambrosia trifida* | cDNA |
| 994 | SPP | *Ambrosia trifida* | cDNA |
| 995 | SPP | *Ambrosia trifida* | cDNA |
| 996 | SPP | *Ambrosia trifida* | cDNA |
| 997 | SPP | *Ambrosia trifida* | gDNA |
| 998 | SPP | *Ambrosia trifida* | gDNA |
| 999 | SPP | *Ambrosia trifida* | gDNA |
| 1000 | SPP | *Ambrosia trifida* | gDNA |
| 1001 | SPP | *Ambrosia trifida* | gDNA |
| 1002 | SPP | *Ambrosia trifida* | gDNA |
| 1003 | SPP | *Ambrosia trifida* | gDNA |
| 1004 | SPP | *Ambrosia trifida* | gDNA |
| 1005 | SPP | *Ambrosia trifida* | gDNA |
| 1006 | SPP | *Ambrosia trifida* | gDNA |
| 1007 | SPP | *Ambrosia trifida* | gDNA |
| 1008 | SPP | *Ambrosia trifida* | gDNA |
| 1009 | SPP | *Ambrosia trifida* | gDNA |
| 1010 | SPP | *Ambrosia trifida* | gDNA |
| 1011 | SPP | *Ambrosia trifida* | gDNA |
| 1012 | SPP | *Ambrosia trifida* | gDNA |
| 1013 | SPP | *Ambrosia trifida* | gDNA |
| 1014 | SPP | *Ambrosia trifida* | gDNA |
| 1015 | SPP | *Ambrosia trifida* | gDNA |
| 1016 | SPP | *Ambrosia trifida* | gDNA |
| 1017 | SPP | *Ambrosia trifida* | gDNA |
| 1018 | SPP | *Ambrosia trifida* | gDNA |
| 1019 | SPP | *Avena fatua* | cDNA |
| 1020 | SPP | *Chenopodium album* | cDNA |
| 1021 | SPP | *Chenopodium album* | cDNA |
| 1022 | SPP | *Convolvulus arvensis* | cDNA |
| 1023 | SPP | *Conyza canadensis* | cDNA |
| 1024 | SPP | *Conyza canadensis* | gDNA |
| 1025 | SPP | *Cyperus esculentus* | gDNA |
| 1026 | SPP | *Cyperus esculentus* | gDNA |
| 1027 | SPP | *Digitaria sanguinalis* | cDNA |
| 1028 | SPP | *Digitaria sanguinalis* | cDNA |
| 1029 | SPP | *Digitaria sanguinalis* | gDNA |
| 1030 | SPP | *Digitaria sanguinalis* | gDNA |
| 1031 | SPP | *Digitaria sanguinalis* | gDNA |
| 1032 | SPP | *Digitaria sanguinalis* | gDNA |
| 1033 | SPP | *Echinochloa colona* | cDNA |
| 1034 | SPP | *Echinochloa colona* | cDNA |
| 1035 | SPP | *Echinochloa crus-galli* | cDNA |
| 1036 | SPP | *Euphorbia heterophylla* | cDNA |
| 1037 | SPP | *Euphorbia heterophylla* | cDNA |
| 1038 | SPP | *Euphorbia heterophylla* | cDNA |
| 1039 | SPP | *Euphorbia heterophylla* | gDNA |
| 1040 | SPP | *Euphorbia heterophylla* | gDNA |
| 1041 | SPP | *Euphorbia heterophylla* | gDNA |
| 1042 | SPP | *Euphorbia heterophylla* | gDNA |
| 1043 | SPP | *Euphorbia heterophylla* | gDNA |
| 1044 | SPP | *Euphorbia heterophylla* | gDNA |
| 1045 | SPP | *Festuca arundinacea* | gDNA |
| 1046 | SPP | *Festuca arundinacea* | gDNA |
| 1047 | SPP | *Festuca arundinacea* | gDNA |
| 1048 | SPP | *Festuca arundinacea* | gDNA |
| 1049 | SPP | *Festuca arundinacea* | gDNA |
| 1050 | SPP | *Festuca arundinacea* | gDNA |
| 1051 | SPP | *Festuca arundinacea* | gDNA |
| 1052 | SPP | *Festuca arundinacea* | gDNA |
| 1053 | SPP | *Festuca arundinacea* | gDNA |
| 1054 | SPP | *Festuca arundinacea* | gDNA |
| 1055 | SPP | *Festuca arundinacea* | gDNA |
| 1056 | SPP | *Ipomoea hederacea* | cDNA |
| 1057 | SPP | *Ipomoea hederacea* | cDNA |
| 1058 | SPP | *Kochia scoparia* | gDNA |
| 1059 | SPP | *Kochia scoparia* | gDNA |
| 1060 | SPP | *Kochia scoparia* | gDNA |
| 1061 | SPP | *Kochia scoparia* | gDNA |
| 1062 | SPP | *Kochia scoparia* | gDNA |
| 1063 | SPP | *Kochia scoparia* | gDNA |
| 1064 | SPP | *Kochia scoparia* | gDNA |
| 1065 | SPP | *Kochia scoparia* | gDNA |
| 1066 | SPP | *Kochia scoparia* | gDNA |
| 1067 | SPP | *Lolium arundinaceum* | gDNA |
| 1068 | SPP | *Lolium arundinaceum* | gDNA |
| 1069 | SPP | *Lolium arundinaceum* | gDNA |

TABLE 1-continued

Target chloroplast import protein system DNA sequence contigs from the various plant species.

| SEQ ID NO | GENE | SPECIES | SEQ_TYPE |
|---|---|---|---|
| 1070 | SPP | *Lolium arundinaceum* | gDNA |
| 1071 | SPP | *Lolium arundinaceum* | gDNA |
| 1072 | SPP | *Lolium arundinaceum* | gDNA |
| 1073 | SPP | *Lolium arundinaceum* | gDNA |
| 1074 | SPP | *Lolium arundinaceum* | gDNA |
| 1075 | SPP | *Lolium arundinaceum* | gDNA |
| 1076 | SPP | *Lolium arundinaceum* | gDNA |
| 1077 | SPP | *Lolium arundinaceum* | gDNA |
| 1078 | SPP | *Lolium arundinaceum* | gDNA |
| 1079 | SPP | *Lolium arundinaceum* | gDNA |
| 1080 | SPP | *Lolium arundinaceum* | gDNA |
| 1081 | SPP | *Lolium arundinaceum* | gDNA |
| 1082 | SPP | *Lolium multiflorum* | cDNA |
| 1083 | SPP | *Lolium multiflorum* | cDNA |
| 1084 | SPP | *Lolium multiflorum* | cDNA |
| 1085 | SPP | *Lolium multiflorum* | gDNA |
| 1086 | SPP | *Lolium multiflorum* | gDNA |
| 1087 | SPP | *Lolium multiflorum* | gDNA |
| 1088 | SPP | *Lolium multiflorum* | gDNA |
| 1089 | SPP | *Lolium multiflorum* | gDNA |
| 1090 | SPP | *Lolium multiflorum* | gDNA |
| 1091 | SPP | *Lolium multiflorum* | gDNA |
| 1092 | SPP | *Lolium rigidium* | gDNA |
| 1093 | SPP | *Lolium rigidium* | gDNA |
| 1094 | SPP | *Lolium rigidium* | gDNA |
| 1095 | SPP | *Lolium rigidium* | gDNA |
| 1096 | SPP | *Lolium rigidium* | gDNA |
| 1097 | SPP | *Portulaca oleracea* | gDNA |
| 1098 | SPP | *Portulaca oleracea* | gDNA |
| 1099 | SPP | *Portulaca oleracea* | gDNA |
| 1100 | SPP | *Portulaca oleracea* | gDNA |
| 1101 | SPP | *Portulaca oleracea* | gDNA |
| 1102 | SPP | *Portulaca oleracea* | gDNA |
| 1103 | SPP | *Portulaca oleracea* | gDNA |
| 1104 | SPP | *Portulaca oleracea* | gDNA |
| 1105 | SPP | *Portulaca oleracea* | gDNA |
| 1106 | SPP | *Senna obtusifolia* | cDNA |
| 1107 | SPP | *Sorghum halepense* | cDNA |
| 1108 | SPP | *Sorghum halepense* | gDNA |
| 1109 | SPP | *Sorghum halepense* | gDNA |
| 1110 | SPP | *Sorghum halepense* | gDNA |
| 1111 | SPP | *Sorghum halepense* | gDNA |
| 1112 | SPP | *Sorghum halepense* | gDNA |
| 1113 | SPP | *Spirodela polyrrhiza* | gDNA |
| 1114 | SPP | *Taraxacum officinale* | gDNA |
| 1115 | SPP | *Taraxacum officinale* | gDNA |
| 1116 | SPP | *Taraxacum officinale* | gDNA |
| 1117 | SPP | *Taraxacum officinale* | gDNA |
| 1118 | SPP | *Taraxacum officinale* | gDNA |
| 1119 | SPP | *Trifolium repens* | gDNA |
| 1120 | SPP | *Trifolium repens* | gDNA |
| 1121 | SPP | *Trifolium repens* | gDNA |
| 1122 | SPP | *Trifolium repens* | gDNA |
| 1123 | SPP | *Trifolium repens* | gDNA |
| 1124 | SPP | *Trifolium repens* | gDNA |
| 1125 | SPP | *Trifolium repens* | gDNA |
| 1126 | SPP | *Trifolium repens* | gDNA |
| 1127 | SPP | *Trifolium repens* | gDNA |
| 1128 | SPP | *Xanthium strumarium* | cDNA |
| 1129 | SPP | *Xanthium strumarium* | cDNA |
| 1130 | SPP | *Xanthium strumarium* | cDNA |
| 1131 | TIC100 | *Abutilon theophrasti* | cDNA |
| 1132 | TIC100 | *Abutilon theophrasti* | gDNA |
| 1133 | TIC100 | *Abutilon theophrasti* | gDNA |
| 1134 | TIC100 | *Abutilon theophrasti* | gDNA |
| 1135 | TIC100 | *Abutilon theophrasti* | gDNA |
| 1136 | TIC100 | *Amaranthus chlorostachys* | cDNA |
| 1137 | TIC100 | *Amaranthus graecizans* | cDNA |
| 1138 | TIC100 | *Amaranthus hybridus* | cDNA |
| 1139 | TIC100 | *Amaranthus hybridus* | cDNA |
| 1140 | TIC100 | *Amaranthus lividus* | cDNA |
| 1141 | TIC100 | *Amaranthus lividus* | cDNA |
| 1142 | TIC100 | *Amaranthus palmeri* | cDNA |
| 1143 | TIC100 | *Amaranthus palmeri* | cDNA |
| 1144 | TIC100 | *Amaranthus palmeri* | gDNA |
| 1145 | TIC100 | *Amaranthus rudis* | cDNA |
| 1146 | TIC100 | *Amaranthus rudis* | cDNA |
| 1147 | TIC100 | *Amaranthus rudis* | gDNA |
| 1148 | TIC100 | *Amaranthus rudis* | gDNA |
| 1149 | TIC100 | *Amaranthus rudis* | gDNA |
| 1150 | TIC100 | *Amaranthus rudis* | gDNA |
| 1151 | TIC100 | *Amaranthus rudis* | gDNA |
| 1152 | TIC100 | *Amaranthus rudis* | gDNA |
| 1153 | TIC100 | *Amaranthus rudis* | gDNA |
| 1154 | TIC100 | *Amaranthus rudis* | gDNA |
| 1155 | TIC100 | *Amaranthus rudis* | gDNA |
| 1156 | TIC100 | *Amaranthus rudis* | gDNA |
| 1157 | TIC100 | *Amaranthus spinosus* | cDNA |
| 1158 | TIC100 | *Amaranthus thunbergii* | cDNA |
| 1159 | TIC100 | *Amaranthus thunbergii* | cDNA |
| 1160 | TIC100 | *Amaranthus viridis* | cDNA |
| 1161 | TIC100 | *Amaranthus viridis* | cDNA |
| 1162 | TIC100 | *Ambrosia artemisiifolia* | gDNA |
| 1163 | TIC100 | *Ambrosia artemisiifolia* | gDNA |
| 1164 | TIC100 | *Ambrosia artemisiifolia* | gDNA |
| 1165 | TIC100 | *Ambrosia artemisiifolia* | gDNA |
| 1166 | TIC100 | *Ambrosia artemisiifolia* | gDNA |
| 1167 | TIC100 | *Ambrosia trifida* | cDNA |
| 1168 | TIC100 | *Ambrosia trifida* | gDNA |
| 1169 | TIC100 | *Ambrosia trifida* | gDNA |
| 1170 | TIC100 | *Ambrosia trifida* | gDNA |
| 1171 | TIC100 | *Ambrosia trifida* | gDNA |
| 1172 | TIC100 | *Ambrosia trifida* | gDNA |
| 1173 | TIC100 | *Ambrosia trifida* | gDNA |
| 1174 | TIC100 | *Ambrosia trifida* | gDNA |
| 1175 | TIC100 | *Chenopodium album* | cDNA |
| 1176 | TIC100 | *Chenopodium album* | cDNA |
| 1177 | TIC100 | *Chenopodium album* | cDNA |
| 1178 | TIC100 | *Conyza canadensis* | cDNA |
| 1179 | TIC100 | *Conyza canadensis* | gDNA |
| 1180 | TIC100 | *Digitaria sanguinalis* | cDNA |
| 1181 | TIC100 | *Digitaria sanguinalis* | gDNA |
| 1182 | TIC100 | *Digitaria sanguinalis* | gDNA |
| 1183 | TIC100 | *Digitaria sanguinalis* | gDNA |
| 1184 | TIC100 | *Digitaria sanguinalis* | gDNA |
| 1185 | TIC100 | *Digitaria sanguinalis* | gDNA |
| 1186 | TIC100 | *Euphorbia heterophylla* | cDNA |
| 1187 | TIC100 | *Euphorbia heterophylla* | gDNA |
| 1188 | TIC100 | *Ipomoea hederacea* | cDNA |
| 1189 | TIC100 | *Kochia scoparia* | gDNA |
| 1190 | TIC100 | *Kochia scoparia* | gDNA |
| 1191 | TIC100 | *Kochia scoparia* | gDNA |
| 1192 | TIC100 | *Kochia scoparia* | gDNA |
| 1193 | TIC100 | *Portulaca oleracea* | gDNA |
| 1194 | TIC100 | *Portulaca oleracea* | gDNA |
| 1195 | TIC100 | *Portulaca oleracea* | gDNA |
| 1196 | TIC100 | *Senna obtusifolia* | cDNA |
| 1197 | TIC100 | *Spirodela polyrrhiza* | gDNA |
| 1198 | TIC100 | *Taraxacum officinale* | gDNA |
| 1199 | TIC100 | *Taraxacum officinale* | gDNA |
| 1200 | TIC100 | *Taraxacum officinale* | gDNA |
| 1201 | TIC100 | *Taraxacum officinale* | gDNA |
| 1202 | TIC100 | *Trifolium repens* | gDNA |
| 1203 | TIC100 | *Trifolium repens* | gDNA |
| 1204 | TIC100 | *Trifolium repens* | gDNA |
| 1205 | TIC100 | *Trifolium repens* | gDNA |
| 1206 | TIC100 | *Trifolium repens* | gDNA |
| 1207 | TIC100 | *Xanthium strumarium* | gDNA |
| 1208 | TIC56 | *Abutilon theophrasti* | cDNA |
| 1209 | TIC56 | *Abutilon theophrasti* | gDNA |
| 1210 | TIC56 | *Abutilon theophrasti* | gDNA |
| 1211 | TIC56 | *Abutilon theophrasti* | gDNA |
| 1212 | TIC56 | *Abutilon theophrasti* | gDNA |
| 1213 | TIC56 | *Amaranthus graecizans* | cDNA |
| 1214 | TIC56 | *Amaranthus graecizans* | cDNA |
| 1215 | TIC56 | *Amaranthus hybridus* | cDNA |
| 1216 | TIC56 | *Amaranthus lividus* | cDNA |
| 1217 | TIC56 | *Amaranthus palmeri* | cDNA |
| 1218 | TIC56 | *Amaranthus palmeri* | gDNA |
| 1219 | TIC56 | *Amaranthus palmeri* | gDNA |

TABLE 1-continued

Target chloroplast import protein system DNA sequence contigs from the various plant species.

| SEQ ID NO | GENE | SPECIES | SEQ_TYPE |
|---|---|---|---|
| 1220 | TIC56 | Amaranthus rudis | cDNA |
| 1221 | TIC56 | Amaranthus rudis | gDNA |
| 1222 | TIC56 | Amaranthus rudis | gDNA |
| 1223 | TIC56 | Amaranthus rudis | gDNA |
| 1224 | TIC56 | Amaranthus rudis | gDNA |
| 1225 | TIC56 | Amaranthus rudis | gDNA |
| 1226 | TIC56 | Amaranthus rudis | gDNA |
| 1227 | TIC56 | Amaranthus rudis | gDNA |
| 1228 | TIC56 | Amaranthus spinosus | cDNA |
| 1229 | TIC56 | Amaranthus spinosus | cDNA |
| 1230 | TIC56 | Amaranthus thunbergii | cDNA |
| 1231 | TIC56 | Amaranthus viridis | cDNA |
| 1232 | TIC56 | Amaranthus viridis | cDNA |
| 1233 | TIC56 | Ambrosia artemisiifolia | gDNA |
| 1234 | TIC56 | Ambrosia artemisiifolia | gDNA |
| 1235 | TIC56 | Ambrosia artemisiifolia | gDNA |
| 1236 | TIC56 | Ambrosia artemisiifolia | gDNA |
| 1237 | TIC56 | Ambrosia trifida | cDNA |
| 1238 | TIC56 | Ambrosia trifida | gDNA |
| 1239 | TIC56 | Ambrosia trifida | gDNA |
| 1240 | TIC56 | Ambrosia trifida | gDNA |
| 1241 | TIC56 | Ambrosia trifida | gDNA |
| 1242 | TIC56 | Chenopodium album | cDNA |
| 1243 | TIC56 | Conyza canadensis | cDNA |
| 1244 | TIC56 | Conyza canadensis | cDNA |
| 1245 | TIC56 | Conyza canadensis | gDNA |
| 1246 | TIC56 | Digitaria sanguinalis | cDNA |
| 1247 | TIC56 | Digitaria sanguinalis | gDNA |
| 1248 | TIC56 | Digitaria sanguinalis | gDNA |
| 1249 | TIC56 | Euphorbia heterophylla | cDNA |
| 1250 | TIC56 | Euphorbia heterophylla | gDNA |
| 1251 | TIC56 | Euphorbia heterophylla | gDNA |
| 1252 | TIC56 | Euphorbia heterophylla | gDNA |
| 1253 | TIC56 | Ipomoea hederacea | cDNA |
| 1254 | TIC56 | Kochia scoparia | gDNA |
| 1255 | TIC56 | Portulaca oleracea | gDNA |
| 1256 | TIC56 | Portulaca oleracea | gDNA |
| 1257 | TIC56 | Senna obtusifolia | cDNA |
| 1258 | TIC56 | Spirodela polyrrhiza | gDNA |
| 1259 | TIC56 | Taraxacum officinale | gDNA |
| 1260 | TIC56 | Trifolium repens | gDNA |
| 1261 | TIC56 | Trifolium repens | gDNA |
| 1262 | TIC56 | Xanthium strumarium | cDNA |
| 1263 | TIC56 | Xanthium strumarium | cDNA |
| 1584 | HSP70 | Amaranthus palmeri | cDNA |
| 1585 | HSP70 | Amaranthus palmeri | gDNA |
| 1586 | HSP70-1 | Amaranthus palmeri | cDNA |
| 1587 | HSP70-1 | Amaranthus palmeri | cDNA |
| 1588 | HSP70-1 | Amaranthus palmeri | gDNA |
| 1589 | HSP70-1 | Amaranthus palmeri | gDNA |
| 1590 | HSP70T-1 | Amaranthus palmeri | cDNA |
| 1591 | HSP70T-1 | Amaranthus palmeri | gDNA |
| 1592 | HSP70T-1 | Amaranthus palmeri | gDNA |
| 1593 | HSP70T-2 | Amaranthus palmeri | cDNA |
| 1594 | HSP70T-2 | Amaranthus palmeri | cDNA |
| 1595 | HSP70T-2 | Amaranthus palmeri | gDNA |
| 1596 | HSP93III | Amaranthus palmeri | cDNA |
| 1597 | HSP93IIIb | Amaranthus palmeri | cDNA |
| 1598 | HSP93IIIb | Amaranthus palmeri | gDNA |
| 1599 | HSP93IIIb | Amaranthus palmeri | gDNA |
| 1600 | HSP93IIIb | Amaranthus palmeri | gDNA |
| 1601 | HSP93IIIb | Amaranthus palmeri | cDNA |
| 1602 | HSP93IIIb | Amaranthus palmeri | cDNA |
| 1603 | HSP93V | Amaranthus palmeri | cDNA |
| 1604 | HSP93V | Amaranthus palmeri | cDNA |
| 1605 | HSP93V | Amaranthus palmeri | cDNA |
| 1606 | HSP93V | Amaranthus palmeri | gDNA |
| 1607 | HSP93V | Amaranthus palmeri | gDNA |
| 1608 | HSP93V | Amaranthus palmeri | gDNA |
| 1609 | TIC22-like | Amaranthus palmeri | cDNA |
| 1610 | TIC22-like | Amaranthus palmeri | gDNA |
| 1611 | TIC22-like1 | Amaranthus palmeri | cDNA |
| 1612 | TIC22-like1 | Amaranthus palmeri | gDNA |
| 1613 | TIC22-like2 | Amaranthus palmeri | cDNA |
| 1614 | TIC22-like2 | Amaranthus palmeri | gDNA |
| 1615 | TIC22-like2 | Amaranthus palmeri | gDNA |
| 1616 | TIC55II | Amaranthus palmeri | cDNA |
| 1617 | TIC55II | Amaranthus palmeri | cDNA |
| 1618 | TIC55II | Amaranthus palmeri | gDNA |
| 1619 | TIC55II | Amaranthus palmeri | gDNA |
| 1620 | TIC55IV | Amaranthus palmeri | cDNA |
| 1621 | TIC55IV | Amaranthus palmeri | gDNA |
| 1622 | TIC55IV | Amaranthus palmeri | gDNA |
| 1623 | TIC55IV | Amaranthus palmeri | gDNA |
| 1624 | TIC62 | Amaranthus palmeri | cDNA |
| 1625 | TIC62 | Amaranthus palmeri | gDNA |
| 1626 | TIC62 | Amaranthus palmeri | gDNA |
| 1627 | TIC62 | Amaranthus palmeri | gDNA |
| 1628 | TOC64I | Amaranthus palmeri | cDNA |
| 1629 | TOC64I | Amaranthus palmeri | gDNA |
| 1630 | TOC64III | Amaranthus palmeri | cDNA |
| 1631 | TOC64III | Amaranthus palmeri | gDNA |
| 1632 | TOC64III | Amaranthus palmeri | gDNA |
| 1633 | TOC64V | Amaranthus palmeri | cDNA |
| 1634 | TOC64V | Amaranthus palmeri | cDNA |
| 1635 | TOC64V | Amaranthus palmeri | cDNA |
| 1636 | TOC64V | Amaranthus palmeri | gDNA |
| 1637 | TOC64V | Amaranthus palmeri | gDNA |
| 1638 | TOC64V | Amaranthus palmeri | gDNA |

Example 2. Polynucleotide Molecules Homologous in Weed Species

The gene sequences and fragments of SEQ ID NO: 1-1263 were compared and 25-mers of contiguous polynucleotides were identified that have homology across the various gene sequences for each set of chloroplast protein import system genes and across the various target weed species. The purpose is to identify trigger polynucleotide molecules that are useful alone or in combination with a herbicide to provide enhanced weed control across a range of weed species, including glyphosate and other herbicide resistant weed biotypes. The method can be applied to any set of target gene sequences to identify trigger polynucleotides common to more than one weed species. The sequences shown in Table 2 represent the 25-mers of the respective gene sequences in SEQ ID NO: 1-1263 that have homology to eight or more weed species. It is contemplated that additional 25-mers can be selected from the gene sequences that are specific for a single weed species or a few weeds species within a genus or trigger polynucleotide molecules that are at least 19 contiguous nucleotides and at least 85 percent identical to a gene sequence of SEQ ID NO: 1-1263. The 25-mer oligonucleotides are combined into a 5-10 polynucleotide pooled set and tested for efficacy against the broadest range of weed species in which the polynucleotide is essentially identical or essentially complementary to a gene sequence in the genome of the treated weed species. Efficacious sets are divided into smaller sets of 2-3 polynucleotides or tested individually for efficacy. Each polynucleotide set is prepared with the transfer agent and applied to a plant or a field of plants in combination with a herbicide, or followed by a herbicide treatment one to three days after the oligonucleotide application, to determine the effect in the plant's susceptibility to the herbicide. The effect is measured as stunting the growth and/or killing of the plant and is measured 8-14 days or 21 days after treatment with the polynucleotide set and the herbicide.

TABLE 2

Plant chloroplast import system gene trigger polynucleotides.

| SEQ ID NO | Seq | Gene | # Species | Species |
|---|---|---|---|---|
| 1264 | TTTGGTAATGAAT GTGGTTGAGCGT | OEP80 | 8 | Amaranthus graecizans, Amaranthus hybridus, Amaranthus lividus, Amaranthus palmeri, Amaranthus rudis, Amaranthus spinosus, Amaranthus viridis, Chenopodium album |
| 1265 | TTGGTAATGAATG TGGTTGAGCGTG | OEP80 | 8 | Amaranthus graecizans, Amaranthus hybridus, Amaranthus lividus, Amaranthus palmeri, Amaranthus rudis, Amaranthus spinosus, Amaranthus viridis, Chenopodium album |
| 1266 | TTGATTTGGTAAT GAATGTGGTTGA | OEP80 | 8 | Amaranthus graecizans, Amaranthus hybridus, Amaranthus lividus, Amaranthus palmeri, Amaranthus rudis, Amaranthus spinosus, Amaranthus viridis, Chenopodium album |
| 1267 | TGGTAATGAATGT GGTTGAGCGTGT | OEP80 | 8 | Amaranthus graecizans, Amaranthus hybridus, Amaranthus lividus, Amaranthus palmeri, Amaranthus rudis, Amaranthus spinosus, Amaranthus viridis, Chenopodium album |
| 1268 | TGGATTGAAGGT GATGATAAGCGTA | OEP80 | 8 | Amaranthus graecizans, Amaranthus hybridus, Amaranthus lividus, Amaranthus palmeri, Amaranthus rudis, Amaranthus spinosus, Amaranthus viridis, Chenopodium album |
| 1269 | TGATTTGGTAATG AATGTGGTTGAG | OEP80 | 8 | Amaranthus graecizans, Amaranthus hybridus, Amaranthus lividus, Amaranthus palmeri, Amaranthus rudis, Amaranthus spinosus, Amaranthus viridis, Chenopodium album |
| 1270 | TCACACGCTCAAC CACATTCATTAC | OEP80 | 8 | Amaranthus graecizans, Amaranthus hybridus, Amaranthus lividus, Amaranthus palmeri, Amaranthus rudis, Amaranthus spinosus, Amaranthus viridis, Chenopodium album |
| 1271 | TCAACCACATTCA TTACCAAATCAA | OEP80 | 8 | Amaranthus graecizans, Amaranthus hybridus, Amaranthus lividus, Amaranthus palmeri, Amaranthus rudis, Amaranthus spinosus, Amaranthus viridis, Chenopodium album |
| 1272 | TACGCTTATCATC ACCTTCAATCCA | OEP80 | 8 | Amaranthus graecizans, Amaranthus hybridus, Amaranthus lividus, Amaranthus palmeri, Amaranthus rudis, Amaranthus spinosus, Amaranthus viridis, Chenopodium album |
| 1273 | TAATGAATGTGGT TGAGCGTGTGAG | OEP80 | 8 | Amaranthus graecizans, Amaranthus hybridus, Amaranthus lividus, Amaranthus palmeri, Amaranthus rudis, Amaranthus spinosus, Amaranthus viridis, Chenopodium album |
| 1274 | GTTGATTTGGTAA TGAATGTGGTTG | OEP80 | 8 | Amaranthus graecizans, Amaranthus hybridus, Amaranthus lividus, Amaranthus palmeri, Amaranthus rudis, Amaranthus spinosus, Amaranthus viridis, Chenopodium album |
| 1275 | GTACGCTTATCAT CACCTTCAATCC | OEP80 | 8 | Amaranthus graecizans, Amaranthus hybridus, Amaranthus lividus, Amaranthus palmeri, Amaranthus rudis, Amaranthus spinosus, Amaranthus viridis, Chenopodium album |

TABLE 2-continued

Plant chloroplast import system gene trigger polynucleotides.

| SEQ ID NO | Seq | Gene | # Species | Species |
|---|---|---|---|---|
| 1276 | GTAATGAATGTGG TTGAGCGTGTGA | OEP80 | 8 | Amaranthus graecizans, Amaranthus hybridus, Amaranthus lividus, Amaranthus palmeri, Amaranthus rudis, Amaranthus spinosus, Amaranthus viridis, Chenopodium album |
| 1277 | GGTAATGAATGTG GTTGAGCGTGTG | OEP80 | 8 | Amaranthus graecizans, Amaranthus hybridus, Amaranthus lividus, Amaranthus palmeri, Amaranthus rudis, Amaranthus spinosus, Amaranthus viridis, Chenopodium album |
| 1278 | GGTAAAGTTGATT TGGTAATGAATG | OEP80 | 8 | Abutilon theophrasti, Amaranthus graecizans, Amaranthus hybridus, Amaranthus lividus, Amaranthus palmeri, Amaranthus rudis, Amaranthus spinosus, Amaranthus viridis |
| 1279 | GGATTGAAGGTG ATGATAAGCGTAC | OEP80 | 8 | Amaranthus graecizans, Amaranthus hybridus, Amaranthus lividus, Amaranthus palmeri, Amaranthus rudis, Amaranthus spinosus, Amaranthus viridis, Chenopodium album |
| 1280 | GCTCAACCACATT CATTACCAAATC | OEP80 | 8 | Amaranthus graecizans, Amaranthus hybridus, Amaranthus lividus, Amaranthus palmeri, Amaranthus rudis, Amaranthus spinosus, Amaranthus viridis, Chenopodium album |
| 1281 | GATTTGGTAATGA ATGTGGTTGAGC | OEP80 | 8 | Amaranthus graecizans, Amaranthus hybridus, Amaranthus lividus, Amaranthus palmeri, Amaranthus rudis, Amaranthus spinosus, Amaranthus viridis, Chenopodium album |
| 1282 | CTCACACGCTCAA CCACATTCATTA | OEP80 | 8 | Amaranthus graecizans, Amaranthus hybridus, Amaranthus lividus, Amaranthus palmeri, Amaranthus rudis, Amaranthus spinosus, Amaranthus viridis, Chenopodium album |
| 1283 | CTCAACCACATTC ATTACCAAATCA | OEP80 | 8 | Amaranthus graecizans, Amaranthus hybridus, Amaranthus lividus, Amaranthus palmeri, Amaranthus rudis, Amaranthus spinosus, Amaranthus viridis, Chenopodium album |
| 1284 | TTTCCACCCTCATC TTTGATCTCCT | TIC100 | 9 | Amaranthus chlorostachys, Amaranthus graecizans, Amaranthus hybridus, Amaranthus lividus, Amaranthus palmeri, Amaranthus rudis, Amaranthus spinosus, Amaranthus thunbergii, Amaranthus viridis |
| 1285 | TTTAGCTTCATCG AGTTTCGGGTCT | TIC100 | 9 | Amaranthus chlorostachys, Amaranthus graecizans, Amaranthus hybridus, Amaranthus lividus, Amaranthus palmeri, Amaranthus rudis, Amaranthus spinosus, Amaranthus thunbergii, Amaranthus viridis |
| 1286 | TTCTGGTACGGCT ACATGATTCATG | TIC100 | 9 | Amaranthus chlorostachys, Amaranthus graecizans, Amaranthus hybridus, Amaranthus lividus, Amaranthus palmeri, Amaranthus rudis, Amaranthus spinosus, Amaranthus thunbergii, Amaranthus viridis |
| 1287 | TTCCACCCTCATCT TGATCTCCTC | TIC100 | 9 | Amaranthus chlorostachys, Amaranthus graecizans, Amaranthus hybridus, Amaranthus lividus, Amaranthus palmeri, Amaranthus rudis, Amaranthus spinosus, Amaranthus thunbergii, Amaranthus viridis |

TABLE 2-continued

Plant chloroplast import system gene trigger polynucleotides.

| SEQ ID NO | Seq | Gene | # Species | Species |
|---|---|---|---|---|
| 1288 | TTCCACATGAATC ATGTAGCCGTAC | TIC100 | 9 | Amaranthus chlorostachys, Amaranthus graecizans, Amaranthus hybridus, Amaranthus lividus, Amaranthus palmeri, Amaranthus rudis, Amaranthus spinosus, Amaranthus thunbergii, Amaranthus viridis |
| 1289 | TTCATCGAGTTTC GGGTCTGTTTCA | TIC100 | 9 | Amaranthus chlorostachys, Amaranthus graecizans, Amaranthus hybridus, Amaranthus lividus, Amaranthus palmeri, Amaranthus rudis, Amaranthus spinosus, Amaranthus thunbergii, Amaranthus viridis |
| 1290 | TTAGCTTCATCGA GTTTCGGGTCTG | TIC100 | 9 | Amaranthus chlorostachys, Amaranthus graecizans, Amaranthus hybridus, Amaranthus lividus, Amaranthus palmeri, Amaranthus rudis, Amaranthus spinosus, Amaranthus thunbergii, Amaranthus viridis |
| 1291 | TTACTTCTGGTAC GGCTACATGATT | TIC100 | 9 | Amaranthus chlorostachys, Amaranthus graecizans, Amaranthus hybridus, Amaranthus lividus, Amaranthus palmeri, Amaranthus rudis, Amaranthus spinosus, Amaranthus thunbergii, Amaranthus viridis |
| 1292 | TGGTACGGCTACA TGATTCATGTGG | TIC100 | 9 | Amaranthus chlorostachys, Amaranthus graecizans, Amaranthus hybridus, Amaranthus lividus, Amaranthus palmeri, Amaranthus rudis, Amaranthus spinosus, Amaranthus thunbergii, Amaranthus viridis |
| 1293 | TGGAAGCATGGC AGAATGCATGGTT | TIC100 | 9 | Amaranthus graecizans, Amaranthus hybridus, Amaranthus lividus, Amaranthus palmeri, Amaranthus rudis, Amaranthus spinosus, Amaranthus thunbergii, Amaranthus viridis, Conyza canadensis |
| 1294 | TGATTAGCTTCA TCGAGTTTCGGG | TIC100 | 9 | Amaranthus chlorostachys, Amaranthus graecizans, Amaranthus hybridus, Amaranthus lividus, Amaranthus palmeri, Amaranthus rudis, Amaranthus spinosus, Amaranthus thunbergii, Amaranthus viridis |
| 1295 | TGATGATTTAGCT TCATCGAGTTTC | TIC100 | 9 | Amaranthus chlorostachys, Amaranthus graecizans, Amaranthus hybridus, Amaranthus lividus, Amaranthus palmeri, Amaranthus rudis, Amaranthus spinosus, Amaranthus thunbergii, Amaranthus viridis |
| 1296 | TGATGATGATTTA GCTTCATCGAGT | TIC100 | 9 | Amaranthus chlorostachys, Amaranthus graecizans, Amaranthus hybridus, Amaranthus lividus, Amaranthus palmeri, Amaranthus rudis, Amaranthus spinosus, Amaranthus thunbergii, Amaranthus viridis |
| 1297 | TGATGATGATGAT TTAGCTTCATCG | TIC100 | 9 | Amaranthus chlorostachys, Amaranthus graecizans, Amaranthus hybridus, Amaranthus lividus, Amaranthus palmeri, Amaranthus rudis, Amaranthus spinosus, Amaranthus thunbergii, Amaranthus viridis |

TABLE 2-continued

Plant chloroplast import system gene trigger polynucleotides.

| SEQ ID NO | Seq | Gene | # Species | Species |
|---|---|---|---|---|
| 1298 | TGATGATGATGAT GATTTAGCTTCA | TIC100 | 9 | Amaranthus chlorostachys, Amaranthus graecizans, Amaranthus hybridus, Amaranthus lividus, Amaranthus palmeri, Amaranthus rudis, Amaranthus spinosus, Amaranthus thunbergii, Amaranthus viridis |
| 1299 | TGAATCATGTAGC CGTACCAGAAGT | TIC100 | 9 | Amaranthus chlorostachys, Amaranthus graecizans, Amaranthus hybridus, Amaranthus lividus, Amaranthus palmeri, Amaranthus rudis, Amaranthus spinosus, Amaranthus thunbergii, Amaranthus viridis |
| 1300 | TGAAGCTAAATCA TCATCATCATCA | TIC100 | 9 | Amaranthus chlorostachys, Amaranthus graecizans, Amaranthus hybridus, Amaranthus lividus, Amaranthus palmeri, Amaranthus rudis, Amaranthus spinosus, Amaranthus thunbergii, Amaranthus viridis |
| 1301 | TGAAACAGACCCG AAACTCGATGAA | TIC100 | 9 | Amaranthus chlorostachys, Amaranthus graecizans, Amaranthus hybridus, Amaranthus lividus, Amaranthus palmeri, Amaranthus rudis, Amaranthus spinosus, Amaranthus thunbergii, Amaranthus viridis |
| 1302 | TCTGGTACGGCTA CATGATTCATGT | TIC100 | 9 | Amaranthus chlorostachys, Amaranthus graecizans, Amaranthus hybridus, Amaranthus lividus, Amaranthus palmeri, Amaranthus rudis, Amaranthus spinosus, Amaranthus thunbergii, Amaranthus viridis |
| 1303 | TCTGAAACAGACC CGAAACTCGATG | TIC100 | 9 | Amaranthus chlorostachys, Amaranthus graecizans, Amaranthus hybridus, Amaranthus lividus, Amaranthus palmeri, Amaranthus rudis, Amaranthus spinosus, Amaranthus thunbergii, Amaranthus viridis |
| 1304 | AGCTTCTGAAATG CCCGACGCTGTT | TIC110 | 12 | Amaranthus graecizans, Amaranthus hybridus, Amaranthus lividus, Amaranthus palmeri, Amaranthus rudis, Amaranthus spinosus, Amaranthus thunbergii, Amaranthus viridis, Ambrosia trifida, Conyza canadensis, Digitaria sanguinalis, Xanthium strumarium |
| 1305 | AACAGCGTCGGG CATTTCAGAAGCT | TIC110 | 12 | Amaranthus graecizans, Amaranthus hybridus, Amaranthus lividus, Amaranthus palmeri, Amaranthus rudis, Amaranthus spinosus, Amaranthus thunbergii, Amaranthus viridis, Ambrosia trifida, Conyza canadensis, Digitaria sanguinalis, Xanthium strumarium |
| 1306 | TGTGCTGCTTTCC TTACAGATGCTT | TIC110 | 10 | Amaranthus albus, Amaranthus chlorostachys, Amaranthus graecizans, Amaranthus hybridus, Amaranthus lividus, Amaranthus palmeri, Amaranthus rudis, Amaranthus spinosus, Amaranthus thunbergii, Amaranthus viridis |
| 1307 | GTGCTGCTTTCCT TACAGATGCTTT | TIC110 | 10 | Amaranthus albus, Amaranthus chlorostachys, Amaranthus graecizans, Amaranthus hybridus, Amaranthus lividus, Amaranthus palmeri, Amaranthus rudis, Amaranthus spinosus, Amaranthus thunbergii, Amaranthus viridis |

TABLE 2-continued

Plant chloroplast import system gene trigger polynucleotides.

| SEQ ID NO | Seq | Gene | # Species | Species |
|---|---|---|---|---|
| 1308 | GCTTCTGAAATGC CCGACGCTGTTC | TIC110 | 10 | Amaranthus graecizans, Amaranthus hybridus, Amaranthus lividus, Amaranthus palmeri, Amaranthus rudis, Amaranthus spinosus, Amaranthus thunbergii, Amaranthus viridis, Ambrosia trifida, Conyza canadensis |
| 1309 | GAACAGCGTCGG GCATTTCAGAAGC | TIC110 | 10 | Amaranthus graecizans, Amaranthus hybridus, Amaranthus lividus, Amaranthus palmeri, Amaranthus rudis, Amaranthus spinosus, Amaranthus thunbergii, Amaranthus viridis, Ambrosia trifida, Conyza canadensis |
| 1310 | AAGCATCTGTAAG GAAAGCAGCACA | TIC110 | 10 | Amaranthus albus, Amaranthus chlorostachys, Amaranthus graecizans, Amaranthus hybridus, Amaranthus lividus, Amaranthus palmeri, Amaranthus rudis, Amaranthus spinosus, Amaranthus thunbergii, Amaranthus viridis |
| 1311 | AAAGCATCTGTAA GGAAAGCAGCAC | TIC110 | 10 | Amaranthus albus, Amaranthus chlorostachys, Amaranthus graecizans, Amaranthus hybridus, Amaranthus lividus, Amaranthus palmeri, Amaranthus rudis, Amaranthus spinosus, Amaranthus thunbergii, Amaranthus viridis |
| 1312 | TTTGAGCATATTC TGCAGGCAGCCC | TIC110 | 9 | Amaranthus albus, Amaranthus graecizans, Amaranthus hybridus, Amaranthus lividus, Amaranthus palmeri, Amaranthus rudis, Amaranthus spinosus, Amaranthus thunbergii, Amaranthus viridis |
| 1313 | TTTCTCTGCCTCAA TAAAGCCACGG | TIC110 | 9 | Amaranthus albus, Amaranthus graecizans, Amaranthus hybridus, Amaranthus lividus, Amaranthus palmeri, Amaranthus rudis, Amaranthus spinosus, Amaranthus thunbergii, Amaranthus viridis |
| 1314 | TTTCAATGGCAGC AGCCATCTTTGA | TIC110 | 9 | Amaranthus albus, Amaranthus graecizans, Amaranthus hybridus, Amaranthus lividus, Amaranthus palmeri, Amaranthus rudis, Amaranthus spinosus, Amaranthus thunbergii, Amaranthus viridis |
| 1315 | TTTAGACAGCAGG CCGAGGTCATTT | TIC110 | 9 | Amaranthus albus, Amaranthus graecizans, Amaranthus hybridus, Amaranthus lividus, Amaranthus palmeri, Amaranthus rudis, Amaranthus spinosus, Amaranthus thunbergii, Amaranthus viridis |
| 1316 | TTGGTTCAAGCCG TGGCTTTATTGA | TIC110 | 9 | Amaranthus albus, Amaranthus graecizans, Amaranthus hybridus, Amaranthus lividus, Amaranthus palmeri, Amaranthus rudis, Amaranthus spinosus, Amaranthus thunbergii, Amaranthus viridis |
| 1317 | TTGCTGAAGCTTC TGTCGATATATT | TIC110 | 9 | Amaranthus chlorostachys, Amaranthus graecizans, Amaranthus hybridus, Amaranthus lividus, Amaranthus palmeri, Amaranthus rudis, Amaranthus spinosus, Amaranthus thunbergii, Amaranthus viridis |
| 1318 | TTGCCAGCAATTG ACATAGCAGCTT | TIC110 | 9 | Amaranthus albus, Amaranthus chlorostachys, Amaranthus graecizans, Amaranthus |

TABLE 2-continued

Plant chloroplast import system gene trigger polynucleotides.

| SEQ ID NO | Seq | Gene | # Species | Species |
|---|---|---|---|---|
| | | | | hybridus, Amaranthus lividus, Amoranthus palmeri, Amaranthus rudis, Amaranthus thunbergii, Amaranthus viridis |
| 1319 | TTCTGTCGATATATTTCTTCATGGA | TIC110 | 9 | Amaranthus chlorostachys, Amaranthus graecizans, Amaranthus hybridus, Amaranthus lividus, Amoranthus palmeri, Amaranthus rudis, Amaranthus spinosus, Amaranthus thunbergii, Amaranthus viridis |
| 1320 | TTCTCTGCCTCAATAAAGCCACGGC | TIC110 | 9 | Amaranthus albus, Amaranthus graecizans, Amaranthus hybridus, Amaranthus lividus, Amoranthus palmeri, Amaranthus rudis, Amaranthus spinosus, Amaranthus thunbergii, Amaranthus viridis |
| 1321 | TTCAATGGCAGCAGCCATCTTTGAA | TIC110 | 9 | Amaranthus albus, Amaranthus graecizans, Amaranthus hybridus, Amaranthus lividus, Amoranthus palmeri, Amaranthus rudis, Amaranthus spinosus, Amaranthus thunbergii, Amaranthus viridis |
| 1322 | TTCAAGCCGTGGCTTTATTGAGGCA | TIC110 | 9 | Amaranthus albus, Amaranthus graecizans, Amaranthus hybridus, Amaranthus lividus, Amoranthus palmeri, Amaranthus rudis, Amaranthus spinosus, Amaranthus thunbergii, Amaranthus viridis |
| 1323 | TTCAAAGATGGCTGCTGCCATTGAA | TIC110 | 9 | Amaranthus albus, Amaranthus graecizans, Amaranthus hybridus, Amaranthus lividus, Amoranthus palmeri, Amaranthus rudis, Amaranthus spinosus, Amaranthus thunbergii, Amaranthus viridis |
| 1324 | TGCTGCATATATCCAAATTCCATAT | TIC20 | 11 | Abutilon theophrasti, Amaranthus albus, Amaranthus chlorostachys, Amaranthus graecizans, Amaranthus hybridus, Amaranthus lividus, Amoranthus palmeri, Amaranthus rudis, Amaranthus spinosus, Amaranthus thunbergii, Amaranthus viridis |
| 1325 | TCATATGGAATTTGGATATATGCAG | TIC20 | 11 | Abutilon theophrasti, Amaranthus albus, Amaranthus chlorostachys, Amaranthus graecizans, Amaranthus hybridus, Amaranthus lividus, Amoranthus palmeri, Amaranthus rudis, Amaranthus spinosus, Amaranthus thunbergii, Amaranthus viridis |
| 1326 | TATGGAATTTGGATATATGCAGCAT | TIC20 | 11 | Abutilon theophrasti, Amaranthus albus, Amaranthus chlorostachys, Amaranthus graecizans, Amaranthus hybridus, Amaranthus lividus, Amoranthus palmeri, Amaranthus rudis, Amaranthus spinosus, Amaranthus thunbergii, Amaranthus viridis |
| 1327 | GCTGCATATATCCAAATTCCATATG | TIC20 | 11 | Abutilon theophrasti, Amaranthus albus, Amaranthus chlorostachys, Amaranthus graecizans, Amaranthus hybridus, Amaranthus lividus, Amoranthus palmeri, Amaranthus rudis, Amaranthus spinosus, Amaranthus thunbergii, Amaranthus viridis |

TABLE 2-continued

Plant chloroplast import system gene trigger polynucleotides.

| SEQ ID NO | Seq | Gene | # Species | Species |
|---|---|---|---|---|
| 1328 | GATGCTGCATATA TCCAAATTCCAT | TIC20 | 11 | Abutilon theophrasti, Amaranthus albus, Amaranthus chlorostachys, Amaranthus graecizans, Amaranthus hybridus, Amaranthus lividus, Amoranthus palmeri, Amaranthus rudis, Amaranthus spinosus, Amaranthus thunbergii, Amaranthus viridis |
| 1329 | CTGCATATATCCA AATTCCATATGA | TIC20 | 11 | Abutilon theophrasti, Amaranthus albus, Amaranthus chlorostachys, Amaranthus graecizans, Amaranthus hybridus, Amaranthus lividus, Amoranthus palmeri, Amaranthus rudis, Amaranthus spinosus, Amaranthus thunbergii, Amaranthus viridis |
| 1330 | CATATGGAATTTG GATATATGCAGC | TIC20 | 11 | Abutilon theophrasti, Amaranthus albus, Amaranthus chlorostachys, Amaranthus graecizans, Amaranthus hybridus, Amaranthus lividus, Amoranthus palmeri, Amaranthus rudis, Amaranthus spinosus, Amaranthus thunbergii, Amaranthus viridis |
| 1331 | ATGGAATTTGGAT ATATGCAGCATC | TIC20 | 11 | Abutilon theophrasti, Amaranthus albus, Amaranthus chlorostachys, Amaranthus graecizans, Amaranthus hybridus, Amaranthus lividus, Amoranthus palmeri, Amaranthus rudis, Amaranthus spinosus, Amaranthus thunbergii, Amaranthus viridis |
| 1332 | ATGCTGCATATAT CCAAATTCCATA | TIC20 | 11 | Abutilon theophrasti, Amaranthus albus, Amaranthus chlorostachys, Amaranthus graecizans, Amaranthus hybridus, Amaranthus lividus, Amoranthus palmeri, Amaranthus rudis, Amaranthus spinosus, Amaranthus thunbergii, Amaranthus viridis |
| 1333 | ATATGGAATTTGG ATATATGCAGCA | TIC20 | 11 | Abutilon theophrasti, Amaranthus albus, Amaranthus chlorostachys, Amaranthus graecizans, Amaranthus hybridus, Amaranthus lividus, Amoranthus palmeri, Amaranthus rudis, Amaranthus spinosus, Amaranthus thunbergii, Amaranthus viridis |
| 1334 | TTTGTGCTTACCTT GGGATCGTGAG | TIC20 | 10 | Amaranthus albus, Amaranthus chlorostachys, Amaranthus graecizans, Amaranthus hybridus, Amaranthus lividus, Amoranthus palmeri, Amaranthus rudis, Amaranthus spinosus, Amaranthus thunbergii, Amaranthus viridis |
| 1335 | TTTGTATGCGATG CTGCATATATCC | TIC20 | 10 | Amaranthus albus, Amaranthus chlorostachys, Amaranthus graecizans, Amaranthus hybridus, Amaranthus lividus, Amoranthus palmeri, Amaranthus rudis, Amaranthus spinosus, Amaranthus thunbergii, Amaranthus viridis |
| 1336 | TTTGGATATATGC AGCATCGCATAC | TIC20 | 10 | Amaranthus albus, Amaranthus chlorostachys, Amaranthus graecizans, Amaranthus hybridus, Amaranthus lividus, Amoranthus palmeri, Amaranthus rudis, Amaranthus |

TABLE 2-continued

Plant chloroplast import system gene trigger polynucleotides.

| SEQ ID NO | Seq | Gene | # Species | Species |
|---|---|---|---|---|
| | | | | spinosus, Amaranthus thunbergii, Amaranthus viridis |
| 1337 | TTTGCAGGTTGTTGGTACTGTCAGT | TIC20 | 10 | Amaranthus albus, Amaranthus chlorostachys, Amaranthus graecizans, Amaranthus hybridus, Amaranthus lividus, Amaranthus palmeri, Amaranthus rudis, Amaranthus spinosus, Amaranthus thunbergii, Amaranthus viridis |
| 1338 | TTTCTCCTCACGATCCCAAGGTAAG | TIC20 | 10 | Amaranthus albus, Amaranthus chlorostachys, Amaranthus graecizans, Amaranthus hybridus, Amaranthus lividus, Amaranthus palmeri, Amaranthus rudis, Amaranthus spinosus, Amaranthus thunbergii, Amaranthus viridis |
| 1339 | TTGTTGGTACTGTCAGTCGTTGGCT | TIC20 | 10 | Amaranthus albus, Amaranthus chlorostachys, Amaranthus graecizans, Amaranthus hybridus, Amaranthus lividus, Amaranthus palmeri, Amaranthus rudis, Amaranthus spinosus, Amaranthus thunbergii, Amaranthus viridis |
| 1340 | TTGTGCTTACCTTGGGATCGTGAGG | TIC20 | 10 | Amaranthus albus, Amaranthus chlorostachys, Amaranthus graecizans, Amaranthus hybridus, Amaranthus lividus, Amaranthus palmeri, Amaranthus rudis, Amaranthus spinosus, Amaranthus thunbergii, Amaranthus viridis |
| 1341 | TTGTATGCGATGCTGCATATATCCA | TIC20 | 10 | Amaranthus albus, Amaranthus chlorostachys, Amaranthus graecizans, Amaranthus hybridus, Amaranthus lividus, Amaranthus palmeri, Amaranthus rudis, Amaranthus spinosus, Amaranthus thunbergii, Amaranthus viridis |
| 1342 | TTGGTACTGTCAGTCGTTGGCTGCC | TIC20 | 10 | Amaranthus albus, Amaranthus chlorostachys, Amaranthus graecizans, Amaranthus hybridus, Amaranthus lividus, Amaranthus palmeri, Amaranthus rudis, Amaranthus spinosus, Amaranthus thunbergii, Amaranthus viridis |
| 1343 | TTGGGATCGTGAGGAGAAAGGAGTG | TIC20 | 10 | Amaranthus albus, Amaranthus chlorostachys, Amaranthus graecizans, Amaranthus hybridus, Amaranthus lividus, Amaranthus palmeri, Amaranthus rudis, Amaranthus spinosus, Amaranthus thunbergii, Amaranthus viridis |
| 1344 | TTTGGAATTGTTGCGATCAGTGACA | TIC21 | 10 | Amaranthus albus, Amaranthus chlorostachys, Amaranthus graecizans, Amaranthus hybridus, Amaranthus lividus, Amaranthus palmeri, Amaranthus rudis, Amaranthus spinosus, Amaranthus thunbergii, Amaranthus viridis |
| 1345 | TTTGAATCTTCTTGGTATGGGCTCT | TIC21 | 10 | Amaranthus albus, Amaranthus chlorostachys, Amaranthus graecizans, Amaranthus hybridus, Amaranthus lividus, Amaranthus palmeri, Amaranthus rudis, Amaranthus spinosus, Amaranthus thunbergii, Amaranthus viridis |

TABLE 2-continued

Plant chloroplast import system gene trigger polynucleotides.

| SEQ ID NO | Seq | Gene | # Species | Species |
|---|---|---|---|---|
| 1346 | TTTCCTCTTTGGA ATTGTTGCGATC | TIC21 | 10 | Amaranthus albus, Amaranthus chlorostachys, Amaranthus graecizans, Amaranthus hybridus, Amaranthus lividus, Amaranthus palmeri, Amaranthus rudis, Amaranthus spinosus, Amaranthus thunbergii, Amaranthus viridis |
| 1347 | TTTATTGCTGTTG ATAATTGTGCAG | TIC21 | 10 | Amaranthus albus, Amaranthus chlorostachys, Amaranthus graecizans, Amaranthus hybridus, Amaranthus lividus, Amaranthus palmeri, Amaranthus rudis, Amaranthus spinosus, Amaranthus thunbergii, Amaranthus viridis |
| 1348 | TTGTTGCGATCAG TGACATCACCTA | TIC21 | 10 | Amaranthus albus, Amaranthus chlorostachys, Amaranthus graecizans, Amaranthus hybridus, Amaranthus lividus, Amaranthus palmeri, Amaranthus rudis, Amaranthus spinosus, Amaranthus thunbergii, Amaranthus viridis |
| 1349 | TTGGTATGGGCTC TGCGGTCTTGGG | TIC21 | 10 | Amaranthus albus, Amaranthus chlorostachys, Amaranthus graecizans, Amaranthus hybridus, Amaranthus lividus, Amaranthus palmeri, Amaranthus rudis, Amaranthus spinosus, Amaranthus thunbergii, Amaranthus viridis |
| 1350 | TTGGAATTGTTGC GATCAGTGACAT | TIC21 | 10 | Amaranthus albus, Amaranthus chlorostachys, Amaranthus graecizans, Amaranthus hybridus, Amaranthus lividus, Amaranthus palmeri, Amaranthus rudis, Amaranthus spinosus, Amaranthus thunbergii, Amaranthus viridis |
| 1351 | TTGCGATCAGTGA CATCACCTAGCG | TIC21 | 10 | Amaranthus albus, Amaranthus chlorostachys, Amaranthus graecizans, Amaranthus hybridus, Amaranthus lividus, Amaranthus palmeri, Amaranthus rudis, Amaranthus spinosus, Amaranthus thunbergii, Amaranthus viridis |
| 1352 | TTGCAATCCCAAG ACCGCAGAGCCC | TIC21 | 10 | Amaranthus albus, Amaranthus chlorostachys, Amaranthus graecizans, Amaranthus hybridus, Amaranthus lividus, Amaranthus palmeri, Amaranthus rudis, Amaranthus spinosus, Amaranthus thunbergii, Amaranthus viridis |
| 1353 | TTGACCGCTAGGT GATGTCACTGAT | TIC21 | 10 | Amaranthus albus, Amaranthus chlorostachys, Amaranthus graecizans, Amaranthus hybridus, Amaranthus lividus, Amaranthus palmeri, Amaranthus rudis, Amaranthus spinosus, Amaranthus thunbergii, Amaranthus viridis |
| 1354 | TTGAATCTTCTTG GTATGGGCTCTG | TIC21 | 10 | Amaranthus albus, Amaranthus chlorostachys, Amaranthus graecizans, Amaranthus hybridus, Amaranthus lividus, Amaranthus palmeri, Amaranthus rudis, Amaranthus spinosus, Amaranthus thunbergii, Amaranthus viridis |
| 1355 | TTCTTGGTATGGG CTCTGCGGTCTT | TIC21 | 10 | Amaranthus albus, Amaranthus chlorostachys, Amaranthus graecizans, Amaranthus |

TABLE 2-continued

Plant chloroplast import system gene trigger polynucleotides.

| SEQ ID NO | Seq | Gene | # Species | Species |
|---|---|---|---|---|
| | | | | hybridus, Amaranthus lividus, Amaranthus palmeri, Amaranthus rudis, Amaranthus spinosus, Amaranthus thunbergii, Amaranthus viridis |
| 1356 | TTCGGACTTGTTT CCTCTTTGGAAT | TIC21 | 10 | Amaranthus albus, Amaranthus chlorostachys, Amaranthus graecizans, Amaranthus hybridus, Amaranthus lividus, Amaranthus palmeri, Amaranthus rudis, Amaranthus spinosus, Amaranthus thunbergii, Amaranthus viridis |
| 1357 | TTCCTCTTTGGAA TTGTTGCGATCA | TIC21 | 10 | Amaranthus albus, Amaranthus chlorostachys, Amaranthus graecizans, Amaranthus hybridus, Amaranthus lividus, Amaranthus palmeri, Amaranthus rudis, Amaranthus spinosus, Amaranthus thunbergii, Amaranthus viridis |
| 1358 | TTCCAAAGAGGAA ACAAGTCCGAAG | TIC21 | 10 | Amaranthus albus, Amaranthus chlorostachys, Amaranthus graecizans, Amaranthus hybridus, Amaranthus lividus, Amaranthus palmeri, Amaranthus rudis, Amaranthus spinosus, Amaranthus thunbergii, Amaranthus viridis |
| 1359 | TTATTGCTGTTGA TAATTGTGCAGT | TIC21 | 10 | Amaranthus albus, Amaranthus chlorostachys, Amaranthus graecizans, Amaranthus hybridus, Amaranthus lividus, Amaranthus palmeri, Amaranthus rudis, Amaranthus spinosus, Amaranthus thunbergii, Amaranthus viridis |
| 1360 | TGTTTCCTCTTTGG AATTGTTGCGA | TIC21 | 10 | Amaranthus albus, Amaranthus chlorostachys, Amaranthus graecizans, Amaranthus hybridus, Amaranthus lividus, Amaranthus palmeri, Amaranthus rudis, Amaranthus spinosus, Amaranthus thunbergii, Amaranthus viridis |
| 1361 | TGTTGCGATCAGT GACATCACCTAG | TIC21 | 10 | Amaranthus albus, Amaranthus chlorostachys, Amaranthus graecizans, Amaranthus hybridus, Amaranthus lividus, Amaranthus palmeri, Amaranthus rudis, Amaranthus spinosus, Amaranthus thunbergii, Amaranthus viridis |
| 1362 | TGTCACTGATCGC AACAATTCCAAA | TIC21 | 10 | Amaranthus albus, Amaranthus chlorostachys, Amaranthus graecizans, Amaranthus hybridus, Amaranthus lividus, Amaranthus palmeri, Amaranthus rudis, Amaranthus spinosus, Amaranthus thunbergii, Amaranthus viridis |
| 1363 | TGGTATGGGCTCT GCGGTCTTGGGA | TIC21 | 10 | Amaranthus albus, Amaranthus chlorostachys, Amaranthus graecizans, Amaranthus hybridus, Amaranthus lividus, Amaranthus palmeri, Amaranthus rudis, Amaranthus spinosus, Amaranthus thunbergii, Amaranthus viridis |

TABLE 2-continued

Plant chloroplast import system gene trigger polynucleotides.

| SEQ ID NO | Seq | Gene | # Species | Species |
|---|---|---|---|---|
| 1364 | TTTGCTATGCAAC AAACTTTCAAGA | TIC40 | 10 | Amaranthus albus, Amaranthus chlorostachys, Amaranthus graecizans, Amaranthus hybridus, Amaranthus lividus, Amaranthus palmeri, Amaranthus rudis, Amaranthus spinosus, Amaranthus thunbergii, Amaranthus viridis |
| 1365 | TTTCAAGACTATG ATGAGCCAGATG | TIC40 | 10 | Amaranthus albus, Amaranthus chlorostachys, Amaranthus graecizans, Amaranthus hybridus, Amaranthus lividus, Amaranthus palmeri, Amaranthus rudis, Amaranthus spinosus, Amaranthus thunbergii, Amaranthus viridis |
| 1366 | TTGTTGCATAGCA AATTTCTTCAAC | TIC40 | 10 | Amaranthus albus, Amaranthus chlorostachys, Amaranthus graecizans, Amaranthus hybridus, Amaranthus lividus, Amaranthus palmeri, Amaranthus rudis, Amaranthus spinosus, Amaranthus thunbergii, Amaranthus viridis |
| 1367 | TTGCTATGCAACA AACTTTCAAGAC | TIC40 | 10 | Amaranthus albus, Amaranthus chlorostachys, Amaranthus graecizans, Amaranthus hybridus, Amaranthus lividus, Amaranthus palmeri, Amaranthus rudis, Amaranthus spinosus, Amaranthus thunbergii, Amaranthus viridis |
| 1368 | TTGCATAGCAAAT TTCTTCAACCAT | TIC40 | 10 | Amaranthus albus, Amaranthus chlorostachys, Amaranthus graecizans, Amaranthus hybridus, Amaranthus lividus, Amaranthus palmeri, Amaranthus rudis, Amaranthus spinosus, Amaranthus thunbergii, Amaranthus viridis |
| 1369 | TTCAAGACTATGA TGAGCCAGATGG | TIC40 | 10 | Amaranthus albus, Amaranthus chlorostachys, Amaranthus graecizans, Amaranthus hybridus, Amaranthus lividus, Amaranthus palmeri, Amaranthus rudis, Amaranthus spinosus, Amaranthus thunbergii, Amaranthus viridis |
| 1370 | TGTTGCATAGCAA ATTTCTTCAACC | TIC40 | 10 | Amaranthus albus, Amaranthus chlorostachys, Amaranthus graecizans, Amaranthus hybridus, Amaranthus lividus, Amaranthus palmeri, Amaranthus rudis, Amaranthus spinosus, Amaranthus thunbergii, Amaranthus viridis |
| 1371 | TGGTTGAAGAAAT TTGCTATGCAAC | TIC40 | 10 | Amaranthus albus, Amaranthus chlorostachys, Amaranthus graecizans, Amaranthus hybridus, Amaranthus lividus, Amaranthus palmeri, Amaranthus rudis, Amaranthus spinosus, Amaranthus thunbergii, Amaranthus viridis |
| 1372 | TGGCTCATCATAG TCTTGAAAGTTT | TIC40 | 10 | Amaranthus albus, Amaranthus chlorostachys, Amaranthus graecizans, Amaranthus hybridus, Amaranthus lividus, Amaranthus palmeri, Amaranthus rudis, Amaranthus spinosus, Amaranthus thunbergii, Amaranthus viridis |
| 1373 | TGCTATGCAACAA ACTTTCAAGACT | TIC40 | 10 | Amaranthus albus, Amaranthus chlorostachys, Amaranthus graecizans, Amaranthus |

TABLE 2-continued

Plant chloroplast import system gene trigger polynucleotides.

| SEQ ID NO | Seq | Gene | # Species | Species |
|---|---|---|---|---|
| | | | | hybridus, Amaranthus lividus, Amaranthus palmeri, Amaranthus rudis, Amaranthus spinosus, Amaranthus thunbergii, Amaranthus viridis |
| 1374 | TGCATAGCAAATT TCTTCAACCATG | TIC40 | 10 | Amaranthus albus, Amaranthus chlorostachys, Amaranthus graecizans, Amaranthus hybridus, Amaranthus lividus, Amaranthus palmeri, Amaranthus rudis, Amaranthus spinosus, Amaranthus thunbergii, Amaranthus viridis |
| 1375 | TGCAACAAACTTT CAAGACTATGAT | TIC40 | 10 | Amaranthus albus, Amaranthus chlorostachys, Amaranthus graecizans, Amaranthus hybridus, Amaranthus lividus, Amaranthus palmeri, Amaranthus rudis, Amaranthus spinosus, Amaranthus thunbergii, Amaranthus viridis |
| 1376 | TGAAGAAATTTGC TATGCAACAAAC | TIC40 | 10 | Amaranthus albus, Amaranthus chlorostachys, Amaranthus graecizans, Amaranthus hybridus, Amaranthus lividus, Amaranthus palmeri, Amaranthus rudis, Amaranthus spinosus, Amaranthus thunbergii, Amaranthus viridis |
| 1377 | TCTTGAAAGTTTG TTGCATAGCAAA | TIC40 | 10 | Amaranthus albus, Amaranthus chlorostachys, Amaranthus graecizans, Amaranthus hybridus, Amaranthus lividus, Amaranthus palmeri, Amaranthus rudis, Amaranthus spinosus, Amaranthus thunbergii, Amaranthus viridis |
| 1378 | TCTGGCTCATCAT AGTCTTGAAAGT | TIC40 | 10 | Amaranthus albus, Amaranthus chlorostachys, Amaranthus graecizans, Amaranthus hybridus, Amaranthus lividus, Amaranthus palmeri, Amaranthus rudis, Amaranthus spinosus, Amaranthus thunbergii, Amaranthus viridis |
| 1379 | TCCCATCTGGCTC ATCATAGTCTTG | TIC40 | 10 | Amaranthus albus, Amaranthus chlorostachys, Amaranthus graecizans, Amaranthus hybridus, Amaranthus lividus, Amaranthus palmeri, Amaranthus rudis, Amaranthus spinosus, Amaranthus thunbergii, Amaranthus viridis |
| 1380 | TCATCATAGTCTT GAAAGTTTGTTG | TIC40 | 10 | Amaranthus albus, Amaranthus chlorostachys, Amaranthus graecizans, Amaranthus hybridus, Amaranthus lividus, Amaranthus palmeri, Amaranthus rudis, Amaranthus spinosus, Amaranthus thunbergii, Amaranthus viridis |
| 1381 | TCATAGTCTTGAA AGTTTGTTGCAT | TIC40 | 10 | Amaranthus albus, Amaranthus chlorostachys, Amaranthus graecizans, Amaranthus hybridus, Amaranthus lividus, Amaranthus palmeri, Amaranthus rudis, Amaranthus spinosus, Amaranthus thunbergii, Amaranthus viridis |

TABLE 2-continued

Plant chloroplast import system gene trigger polynucleotides.

| SEQ ID NO | Seq | Gene | # Species | Species |
|---|---|---|---|---|
| 1382 | TCAAGACTATGAT GAGCCAGATGGG | TIC40 | 10 | Amaranthus albus, Amaranthus chlorostachys, Amaranthus graecizans, Amaranthus hybridus, Amaranthus lividus, Amaranthus palmeri, Amaranthus rudis, Amaranthus spinosus, Amaranthus thunbergii, Amaranthus viridis |
| 1383 | TATGCAACAAACT TTCAAGACTATG | TIC40 | 10 | Amaranthus albus, Amaranthus chlorostachys, Amaranthus graecizans, Amaranthus hybridus, Amaranthus lividus, Amaranthus palmeri, Amaranthus rudis, Amaranthus spinosus, Amaranthus thunbergii, Amaranthus viridis |
| 1384 | TTAAGTTGAATCA GCTCACATGGTC | TIC56 | 8 | Amaranthus graecizans, Amaranthus hybridus, Amaranthus lividus, Amaranthus palmeri, Amaranthus spinosus, Amaranthus thunbergii, Amaranthus viridis, Chenopodium album |
| 1385 | TCTTCTCGGAACA TATTCATGGCTT | TIC56 | 8 | Amaranthus graecizans, Amaranthus hybridus, Amaranthus lividus, Amaranthus palmeri, Amaranthus rudis, Amaranthus spinosus, Amaranthus thunbergii, Amaranthus viridis |
| 1386 | TCTTAAGTTGAAT CAGCTCACATGG | TIC56 | 8 | Amaranthus graecizans, Amaranthus hybridus, Amaranthus lividus, Amaranthus palmeri, Amaranthus spinosus, Amaranthus thunbergii, Amaranthus viridis, Chenopodium album |
| 1387 | TCATGTCCTTGAT TACAGCTTTACT | TIC56 | 8 | Amaranthus graecizans, Amaranthus hybridus, Amaranthus lividus, Amaranthus palmeri, Amaranthus rudis, Amaranthus spinosus, Amaranthus thunbergii, Amaranthus viridis |
| 1388 | TAAGTTGAATCAG CTCACATGGTCC | TIC56 | 8 | Amaranthus graecizans, Amaranthus hybridus, Amaranthus lividus, Amaranthus palmeri, Amaranthus spinosus, Amaranthus thunbergii, Amaranthus viridis, Chenopodium album |
| 1389 | TAAAGCTGTAATC AAGGACATGAGG | TIC56 | 8 | Amaranthus graecizans, Amaranthus hybridus, Amaranthus lividus, Amaranthus palmeri, Amaranthus rudis, Amaranthus spinosus, Amaranthus thunbergii, Amaranthus viridis |
| 1390 | GTCTTAAGTTGAA TCAGCTCACATG | TIC56 | 8 | Amaranthus graecizans, Amaranthus hybridus, Amaranthus lividus, Amaranthus palmeri, Amaranthus spinosus, Amaranthus thunbergii, Amaranthus viridis, Chenopodium album |
| 1391 | GTAAAGCTGTAAT CAAGGACATGAG | TIC56 | 8 | Amaranthus graecizans, Amaranthus hybridus, Amaranthus lividus, Amaranthus palmeri, Amaranthus rudis, Amaranthus spinosus, Amaranthus thunbergii, Amaranthus viridis |
| 1392 | GGACCATGTGAG CTGATTCAACTTA | TIC56 | 8 | Amaranthus graecizans, Amaranthus hybridus, Amaranthus lividus, Amaranthus palmeri, Amaranthus spinosus, Amaranthus thunbergii, Amaranthus viridis, Chenopodium album |
| 1393 | GCCTCATGTCCTT GATTACAGCTTT | TIC56 | 8 | Amaranthus graecizans, Amaranthus hybridus, Amaranthus lividus, Amaranthus palmeri, Amaranthus rudis, Amaranthus spinosus, Amaranthus thunbergii, Amaranthus viridis |

TABLE 2-continued

Plant chloroplast import system gene trigger polynucleotides.

| SEQ ID NO | Seq | Gene | # Species | Species |
|---|---|---|---|---|
| 1394 | GCCATGAATATGT TCCGAGAAGATG | TIC56 | 8 | Amaranthus graecizans, Amaranthus hybridus, Amaranthus lividus, Amaranthus palmeri, Amaranthus rudis, Amaranthus spinosus, Amaranthus thunbergii, Amaranthus viridis |
| 1395 | GCATCTTCTCGGA ACATATTCATGG | TIC56 | 8 | Amaranthus graecizans, Amaranthus hybridus, Amaranthus lividus, Amaranthus palmeri, Amaranthus rudis, Amaranthus spinosus, Amaranthus thunbergii, Amaranthus viridis |
| 1396 | GAGGACCATGTG AGCTGATTCAACT | TIC56 | 8 | Amaranthus graecizans, Amaranthus hybridus, Amaranthus lividus, Amaranthus palmeri, Amaranthus spinosus, Amaranthus thunbergii, Amaranthus viridis, Chenopodium album |
| 1397 | GACCATGTGAGCT GATTCAACTTAA | TIC56 | 8 | Amaranthus graecizans, Amaranthus hybridus, Amaranthus lividus, Amaranthus palmeri, Amaranthus spinosus, Amaranthus thunbergii, Amaranthus viridis, Chenopodium album |
| 1398 | CTTAAGTTGAATC AGCTCACATGGT | TIC56 | 8 | Amaranthus graecizans, Amaranthus hybridus, Amaranthus lividus, Amaranthus palmeri, Amaranthus spinosus, Amaranthus thunbergii, Amaranthus viridis, Chenopodium album |
| 1399 | CTCATGTCCTTGA TTACAGCTTTAC | TIC56 | 8 | Amaranthus graecizans, Amaranthus hybridus, Amaranthus lividus, Amaranthus palmeri, Amaranthus rudis, Amaranthus spinosus, Amaranthus thunbergii, Amaranthus viridis |
| 1400 | CGCCTCATGTCCT TGATTACAGCTT | TIC56 | 8 | Amaranthus graecizans, Amaranthus hybridus, Amaranthus lividus, Amaranthus palmeri, Amaranthus rudis, Amaranthus spinosus, Amaranthus thunbergii, Amaranthus viridis |
| 1401 | CCTCATGTCCTTG ATTACAGCTTTA | TIC56 | 8 | Amaranthus graecizans, Amaranthus hybridus, Amaranthus lividus, Amaranthus palmeri, Amaranthus rudis, Amaranthus spinosus, Amaranthus thunbergii, Amaranthus viridis |
| 1402 | CCATGTGAGCTGA TTCAACTTAAGA | TIC56 | 8 | Amaranthus graecizans, Amaranthus hybridus, Amaranthus lividus, Amaranthus palmeri, Amaranthus spinosus, Amaranthus thunbergii, Amaranthus viridis, Chenopodium album |
| 1403 | CCATGAATATGTT CCGAGAAGATGC | TIC56 | 8 | Amaranthus graecizans, Amaranthus hybridus, Amaranthus lividus, Amaranthus palmeri, Amaranthus rudis, Amaranthus spinosus, Amaranthus thunbergii, Amaranthus viridis |
| 1404 | TTGGTACTGGTAA TGATGCAGCACC | TOC132 | 9 | Amaranthus albus, Amaranthus graecizans, Amaranthus hybridus, Amaranthus lividus, Amaranthus palmeri, Amaranthus rudis, Amaranthus spinosus, Amaranthus thunbergii, Amaranthus viridis |
| 1405 | TGGTGGTGCTGCA TCATTACCAGTA | TOC132 | 9 | Amaranthus albus, Amaranthus graecizans, Amaranthus hybridus, Amaranthus lividus, Amaranthus palmeri, Amaranthus rudis, Amaranthus spinosus, Amaranthus thunbergii, Amaranthus viridis |

TABLE 2-continued

Plant chloroplast import system gene trigger polynucleotides.

| SEQ ID NO | Seq | Gene | # Species | Species |
|---|---|---|---|---|
| 1406 | TGGTGCTGCATCATTACCAGTACCA | TOC132 | 9 | *Amaranthus albus, Amaranthus graecizans, Amaranthus hybridus, Amaranthus lividus, Amaranthus palmeri, Amaranthus rudis, Amaranthus spinosus, Amaranthus thunbergii, Amaranthus viridis* |
| 1407 | TGGTACTGGTAATGATGCAGCACCA | TOC132 | 9 | *Amaranthus albus, Amaranthus graecizans, Amaranthus hybridus, Amaranthus lividus, Amaranthus palmeri, Amaranthus rudis, Amaranthus spinosus, Amaranthus thunbergii, Amaranthus viridis* |
| 1408 | TGGTAATGATGCAGCACCACCAGAT | TOC132 | 9 | *Amaranthus albus, Amaranthus graecizans, Amaranthus hybridus, Amaranthus lividus, Amaranthus palmeri, Amaranthus rudis, Amaranthus spinosus, Amaranthus thunbergii, Amaranthus viridis* |
| 1409 | TGCTGCATCATTACCAGTACCAATG | TOC132 | 9 | *Amaranthus albus, Amaranthus graecizans, Amaranthus hybridus, Amaranthus lividus, Amaranthus palmeri, Amaranthus rudis, Amaranthus spinosus, Amaranthus thunbergii, Amaranthus viridis* |
| 1410 | TGCAGCACCACCAGATTCTTCATCA | TOC132 | 9 | *Amaranthus albus, Amaranthus graecizans, Amaranthus hybridus, Amaranthus lividus, Amaranthus palmeri, Amaranthus rudis, Amaranthus spinosus, Amaranthus thunbergii, Amaranthus viridis* |
| 1411 | TGATGCAGCACCACCAGATTCTTCA | TOC132 | 9 | *Amaranthus albus, Amaranthus graecizans, Amaranthus hybridus, Amaranthus lividus, Amaranthus palmeri, Amaranthus rudis, Amaranthus spinosus, Amaranthus thunbergii, Amaranthus viridis* |
| 1412 | TGATGAAGAATCTGGTGGTGCTGCA | TOC132 | 9 | *Amaranthus albus, Amaranthus graecizans, Amaranthus hybridus, Amaranthus lividus, Amaranthus palmeri, Amaranthus rudis, Amaranthus spinosus, Amaranthus thunbergii, Amaranthus viridis* |
| 1413 | TGAAGAATCTGGTGGTGCTGCATCA | TOC132 | 9 | *Amaranthus albus, Amaranthus graecizans, Amaranthus hybridus, Amaranthus lividus, Amaranthus palmeri, Amaranthus rudis, Amaranthus spinosus, Amaranthus thunbergii, Amaranthus viridis* |
| 1414 | TCTGGTGGTGCTGCATCATTACCAG | TOC132 | 9 | *Amaranthus albus, Amaranthus graecizans, Amaranthus hybridus, Amaranthus lividus, Amaranthus palmeri, Amaranthus rudis, Amaranthus spinosus, Amaranthus thunbergii, Amaranthus viridis* |
| 1415 | TACTGGTAATGATGCAGCACCACCA | TOC132 | 9 | *Amaranthus albus, Amaranthus graecizans, Amaranthus hybridus, Amaranthus lividus, Amaranthus palmeri, Amaranthus rudis, Amaranthus spinosus, Amaranthus thunbergii, Amaranthus viridis* |

TABLE 2-continued

Plant chloroplast import system gene trigger polynucleotides.

| SEQ ID NO | Seq | Gene | # Species | Species |
|---|---|---|---|---|
| 1416 | TAATGATGCAGCA CCACCAGATTCT | TOC132 | 9 | Amaranthus albus, Amaranthus graecizans, Amaranthus hybridus, Amaranthus lividus, Amaranthus palmeri, Amaranthus rudis, Amaranthus spinosus, Amaranthus thunbergii, Amaranthus viridis |
| 1417 | GTGGTGCTGCATC ATTACCAGTACC | TOC132 | 9 | Amaranthus albus, Amaranthus graecizans, Amaranthus hybridus, Amaranthus lividus, Amaranthus palmeri, Amaranthus rudis, Amaranthus spinosus, Amaranthus thunbergii, Amaranthus viridis |
| 1418 | GTGCTGCATCATT ACCAGTACCAAT | TOC132 | 9 | Amaranthus albus, Amaranthus graecizans, Amaranthus hybridus, Amaranthus lividus, Amaranthus palmeri, Amaranthus rudis, Amaranthus spinosus, Amaranthus thunbergii, Amaranthus viridis |
| 1419 | GTACTGGTAATGA TGCAGCACCACC | TOC132 | 9 | Amaranthus albus, Amaranthus graecizans, Amaranthus hybridus, Amaranthus lividus, Amaranthus palmeri, Amaranthus rudis, Amaranthus spinosus, Amaranthus thunbergii, Amaranthus viridis |
| 1420 | GTAATGATGCAGC ACCACCAGATTC | TOC132 | 9 | Amaranthus albus, Amaranthus graecizans, Amaranthus hybridus, Amaranthus lividus, Amaranthus palmeri, Amaranthus rudis, Amaranthus spinosus, Amaranthus thunbergii, Amaranthus viridis |
| 1421 | GGTGGTGCTGCAT CATTACCAGTAC | TOC132 | 9 | Amaranthus albus, Amaranthus graecizans, Amaranthus hybridus, Amaranthus lividus, Amaranthus palmeri, Amaranthus rudis, Amaranthus spinosus, Amaranthus thunbergii, Amaranthus viridis |
| 1422 | GGTGCTGCATCAT TACCAGTACCAA | TOC132 | 9 | Amaranthus albus, Amaranthus graecizans, Amaranthus hybridus, Amaranthus lividus, Amaranthus palmeri, Amaranthus rudis, Amaranthus spinosus, Amaranthus thunbergii, Amaranthus viridis |
| 1423 | GGTACTGGTAATG ATGCAGCACCAC | TOC132 | 9 | Amaranthus albus, Amaranthus graecizans, Amaranthus hybridus, Amaranthus lividus, Amaranthus palmeri, Amaranthus rudis, Amaranthus spinosus, Amaranthus thunbergii, Amaranthus viridis |
| 1424 | TGGACACCCATGG TTGGGACCATGA | TOC159 | 10 | Abutilon theophrasti, Amaranthus albus, Amaranthus graecizans, Amaranthus hybridus, Amaranthus lividus, Amaranthus palmeri, Amaranthus spinosus, Amaranthus thunbergii, Amaranthus viridis, Chenopodium album |
| 1425 | TCATGGTCCCAAC CATGGGTGTCCA | TOC159 | 10 | Abutilon theophrasti, Amaranthus albus, Amaranthus graecizans, Amaranthus hybridus, Amaranthus lividus, Amaranthus palmeri, Amaranthus spinosus, Amaranthus thunbergii, Amaranthus viridis, Chenopodium album |

TABLE 2-continued

Plant chloroplast import system gene trigger polynucleotides.

| SEQ ID NO | Seq | Gene | # Species | Species |
|---|---|---|---|---|
| 1426 | GGCTGGATTCACA GACAAGAGATCT | TOC159 | 10 | Amaranthus albus, Amaranthus graecizans, Amaranthus hybridus, Amaranthus lividus, Amaranthus palmeri, Amaranthus rudis, Amaranthus spinosus, Amaranthus thunbergii, Amaranthus viridis, Chenopodium album |
| 1427 | GACACCCATGGTT GGGACCATGATT | TOC159 | 10 | Abutilon theophrasti, Amaranthus albus, Amaranthus graecizans, Amaranthus hybridus, Amaranthus lividus, Amaranthus palmeri, Amaranthus spinosus, Amaranthus thunbergii, Amaranthus viridis, Senna obtusifolia |
| 1428 | CAATCATGGTCCC AACCATGGGTGT | TOC159 | 10 | Abutilon theophrasti, Amaranthus albus, Amaranthus graecizans, Amaranthus hybridus, Amaranthus lividus, Amaranthus palmeri, Amaranthus spinosus, Amaranthus thunbergii, Amaranthus viridis, Senna obtusifolia |
| 1429 | AGATCTCTTGTCT GTGAATCCAGCC | TOC159 | 10 | Amaranthus albus, Amaranthus graecizans, Amaranthus hybridus, Amaranthus lividus, Amaranthus palmeri, Amaranthus rudis, Amaranthus spinosus, Amaranthus thunbergii, Amaranthus viridis, Chenopodium album |
| 1430 | ACACCCATGGTTG GGACCATGATTG | TOC159 | 10 | Abutilon theophrasti, Amaranthus albus, Amaranthus graecizans, Amaranthus hybridus, Amaranthus lividus, Amaranthus palmeri, Amaranthus spinosus, Amaranthus thunbergii, Amaranthus viridis, Senna obtusifolia |
| 1431 | AATCATGGTCCCA ACCATGGGTGTC | TOC159 | 10 | Abutilon theophrasti, Amaranthus albus, Amaranthus graecizans, Amaranthus hybridus, Amaranthus lividus, Amaranthus palmeri, Amaranthus spinosus, Amaranthus thunbergii, Amaranthus viridis, Senna obtusifolia |
| 1432 | TTTGTGGGACAGC GTAGTCATATTA | TOC159 | 9 | Amaranthus albus, Amaranthus graecizans, Amaranthus hybridus, Amaranthus lividus, Amaranthus palmeri, Amaranthus rudis, Amaranthus spinosus, Amaranthus thunbergii, Amaranthus viridis |
| 1433 | TTTGGTTACCTGC ACAGTTACTGCT | TOC159 | 9 | Amaranthus albus, Amaranthus graecizans, Amaranthus hybridus, Amaranthus lividus, Amaranthus palmeri, Amaranthus rudis, Amaranthus spinosus, Amaranthus thunbergii, Amaranthus viridis |
| 1434 | TTTGAGCGAGTAG CATAGCAACAAT | TOC159 | 9 | Amaranthus albus, Amaranthus graecizans, Amaranthus hybridus, Amaranthus lividus, Amaranthus palmeri, Amaranthus rudis, Amaranthus spinosus, Amaranthus thunbergii, Amaranthus viridis |
| 1435 | TTTCCTTGAACAT CCTGGTTCTTGG | TOC159 | 9 | Amaranthus albus, Amaranthus graecizans, Amaranthus hybridus, Amaranthus lividus, Amaranthus palmeri, Amaranthus rudis, Amaranthus spinosus, Amaranthus thunbergii, Amaranthus viridis |
| 1436 | TTTCCTCCGATTG CCAAGTCTCCTC | TOC159 | 9 | Amaranthus albus, Amaranthus graecizans, Amaranthus hybridus, Amaranthus lividus, Amaranthus |

TABLE 2-continued

Plant chloroplast import system gene trigger polynucleotides.

| SEQ ID NO | Seq | Gene | # Species | Species |
|---|---|---|---|---|
| | | | | palmeri, Amaranthus rudis, Amaranthus spinosus, Amaranthus thunbergii, Amaranthus viridis |
| 1437 | TTTCCCAAGAACCAGGATGTTCAAG | TOC159 | 9 | Amaranthus albus, Amaranthus graecizans, Amaranthus hybridus, Amaranthus lividus, Amaranthus palmeri, Amaranthus rudis, Amaranthus spinosus, Amaranthus thunbergii, Amaranthus viridis |
| 1438 | TTTATGTGGATAGGCTGGATTCACA | TOC159 | 9 | Amaranthus albus, Amaranthus graecizans, Amaranthus hybridus, Amaranthus lividus, Amaranthus palmeri, Amaranthus rudis, Amaranthus spinosus, Amaranthus thunbergii, Amaranthus viridis |
| 1439 | TTTACCTTCTCTTCACCAAATATTG | TOC159 | 9 | Amaranthus albus, Amaranthus graecizans, Amaranthus hybridus, Amaranthus lividus, Amaranthus palmeri, Amaranthus rudis, Amaranthus spinosus, Amaranthus thunbergii, Amaranthus viridis |
| 1440 | TTGTGGGACAGCGTAGTCATATTAT | TOC159 | 9 | Amaranthus albus, Amaranthus graecizans, Amaranthus hybridus, Amaranthus lividus, Amaranthus palmeri, Amaranthus rudis, Amaranthus spinosus, Amaranthus thunbergii, Amaranthus viridis |
| 1441 | TTGTCTGTGAATCCAGCCTATCCAC | TOC159 | 9 | Amaranthus albus, Amaranthus graecizans, Amaranthus hybridus, Amaranthus lividus, Amaranthus palmeri, Amaranthus rudis, Amaranthus spinosus, Amaranthus thunbergii, Amaranthus viridis |
| 1442 | TTGTCCTCAAGATGGGTAGATCATT | TOC159 | 9 | Amaranthus albus, Amaranthus graecizans, Amaranthus hybridus, Amaranthus lividus, Amaranthus palmeri, Amaranthus rudis, Amaranthus spinosus, Amaranthus thunbergii, Amaranthus viridis |
| 1443 | TTGGTTACCTGCACAGTTACTGCTG | TOC159 | 9 | Amaranthus albus, Amaranthus graecizans, Amaranthus hybridus, Amaranthus lividus, Amaranthus palmeri, Amaranthus rudis, Amaranthus spinosus, Amaranthus thunbergii, Amaranthus viridis |
| 1444 | TTTGGTCAAGACTATCATTGATGTT | TOC34 | 9 | Amaranthus albus, Amaranthus graecizans, Amaranthus hybridus, Amaranthus lividus, Amaranthus palmeri, Amaranthus rudis, Amaranthus spinosus, Amaranthus thunbergii, Amaranthus viridis |
| 1445 | TTTCTTCTGGATAAGACAATCGATG | TOC34 | 9 | Amaranthus albus, Amaranthus graecizans, Amaranthus hybridus, Amaranthus lividus, Amaranthus palmeri, Amaranthus rudis, Amaranthus spinosus, Amaranthus thunbergii, Amaranthus viridis |
| 1446 | TTTCATGGATACCAAATTTGGTCAA | TOC34 | 9 | Amaranthus albus, Amaranthus graecizans, Amaranthus hybridus, Amaranthus lividus, Amaranthus palmeri, Amaranthus rudis, Amaranthus spinosus, Amaranthus thunbergii, Amaranthus viridis |

TABLE 2-continued

Plant chloroplast import system gene trigger polynucleotides.

| SEQ ID NO | Seq | Gene | # Species | Species |
|---|---|---|---|---|
| 1447 | TTGTCTTATCCAG AAGAAAGCCTTT | TOC34 | 9 | Amaranthus albus, Amaranthus graecizans, Amaranthus hybridus, Amaranthus lividus, Amaranthus palmeri, Amaranthus rudis, Amaranthus spinosus, Amaranthus thunbergii, Amaranthus viridis |
| 1448 | TTGTCAACCAAGA TACCCTTACTTC | TOC34 | 9 | Amaranthus albus, Amaranthus graecizans, Amaranthus hybridus, Amaranthus lividus, Amaranthus palmeri, Amaranthus rudis, Amaranthus spinosus, Amaranthus thunbergii, Amaranthus viridis |
| 1449 | TTGGTCAAGACTA TCATTGATGTTG | TOC34 | 9 | Amaranthus albus, Amaranthus graecizans, Amaranthus hybridus, Amaranthus lividus, Amaranthus palmeri, Amaranthus rudis, Amaranthus spinosus, Amaranthus thunbergii, Amaranthus viridis |
| 1450 | TTGACCAAATTTG GTATCCATGAAA | TOC34 | 9 | Amaranthus albus, Amaranthus graecizans, Amaranthus hybridus, Amaranthus lividus, Amaranthus palmeri, Amaranthus rudis, Amaranthus spinosus, Amaranthus thunbergii, Amaranthus viridis |
| 1451 | TTCTTCTGGATAA GACAATCGATGT | TOC34 | 9 | Amaranthus albus, Amaranthus graecizans, Amaranthus hybridus, Amaranthus lividus, Amaranthus palmeri, Amaranthus rudis, Amaranthus spinosus, Amaranthus thunbergii, Amaranthus viridis |
| 1452 | TTCTGGATAAGAC AATCGATGTATT | TOC34 | 9 | Amaranthus albus, Amaranthus graecizans, Amaranthus hybridus, Amaranthus lividus, Amaranthus palmeri, Amaranthus rudis, Amaranthus spinosus, Amaranthus thunbergii, Amaranthus viridis |
| 1453 | TTCATGGATACCA AATTTGGTCAAG | TOC34 | 9 | Amaranthus albus, Amaranthus graecizans, Amaranthus hybridus, Amaranthus lividus, Amaranthus palmeri, Amaranthus rudis, Amaranthus spinosus, Amaranthus thunbergii, Amaranthus viridis |
| 1454 | TGTCAACCAAGAT ACCCTTACTTCC | TOC34 | 9 | Amaranthus albus, Amaranthus graecizans, Amaranthus hybridus, Amaranthus lividus, Amaranthus palmeri, Amaranthus rudis, Amaranthus spinosus, Amaranthus thunbergii, Amaranthus viridis |
| 1455 | TGGTCAAGACTAT CATTGATGTTGT | TOC34 | 9 | Amaranthus albus, Amaranthus graecizans, Amaranthus hybridus, Amaranthus lividus, Amaranthus palmeri, Amaranthus rudis, Amaranthus spinosus, Amaranthus thunbergii, Amaranthus viridis |
| 1456 | TGGATACCAAATT TGGTCAAGACTA | TOC34 | 9 | Amaranthus albus, Amaranthus graecizans, Amaranthus hybridus, Amaranthus lividus, Amaranthus palmeri, Amaranthus rudis, Amaranthus spinosus, Amaranthus thunbergii, Amaranthus viridis |

TABLE 2-continued

Plant chloroplast import system gene trigger polynucleotides.

| SEQ ID NO | Seq | Gene | # Species | Species |
|---|---|---|---|---|
| 1457 | TGGATAAGACAAT CGATGTATTGCT | TOC34 | 9 | Amaranthus albus, Amaranthus graecizans, Amaranthus hybridus, Amaranthus lividus, Amaranthus palmeri, Amaranthus rudis, Amaranthus spinosus, Amaranthus thunbergii, Amaranthus viridis |
| 1458 | TGGAAGTAAGGG TATCTTGGTTGAC | TOC34 | 9 | Amaranthus albus, Amaranthus graecizans, Amaranthus hybridus, Amaranthus lividus, Amaranthus palmeri, Amaranthus rudis, Amaranthus spinosus, Amaranthus thunbergii, Amaranthus viridis |
| 1459 | TGATGGATTGAGT TACGAAGACTTC | TOC34 | 9 | Amaranthus albus, Amaranthus graecizans, Amaranthus hybridus, Amaranthus lividus, Amaranthus palmeri, Amaranthus rudis, Amaranthus spinosus, Amaranthus thunbergii, Amaranthus viridis |
| 1460 | TGATAGTCTTGAC CAAATTTGGTAT | TOC34 | 9 | Amaranthus albus, Amaranthus graecizans, Amaranthus hybridus, Amaranthus lividus, Amaranthus palmeri, Amaranthus rudis, Amaranthus spinosus, Amaranthus thunbergii, Amaranthus viridis |
| 1461 | TGACCAAATTTGG TATCCATGAAAC | TOC34 | 9 | Amaranthus albus, Amaranthus graecizans, Amaranthus hybridus, Amaranthus lividus, Amaranthus palmeri, Amaranthus rudis, Amaranthus spinosus, Amaranthus thunbergii, Amaranthus viridis |
| 1462 | TCTTGACCAAATT TGGTATCCATGA | TOC34 | 9 | Amaranthus albus, Amaranthus graecizans, Amaranthus hybridus, Amaranthus lividus, Amaranthus palmeri, Amaranthus rudis, Amaranthus spinosus, Amaranthus thunbergii, Amaranthus viridis |
| 1463 | TCTTCTGGATAAG ACAATCGATGTA | TOC34 | 9 | Amaranthus albus, Amaranthus graecizans, Amaranthus hybridus, Amaranthus lividus, Amaranthus palmeri, Amaranthus rudis, Amaranthus spinosus, Amaranthus thunbergii, Amaranthus viridis |
| 1464 | TACAGGAGAATG GGCAAGGGTTCG T | TOC75 | 10 | Amaranthus chlorostachys, Amaranthus graecizans, Amaranthus hybridus, Amaranthus lividus, Amaranthus palmeri, Amaranthus rudis, Amaranthus spinosus, Amaranthus thunbergii, Amaranthus viridis, Euphorbia heterophylla |
| 1465 | GACGAACCCTTGC CCATTCTCCTGT | TOC75 | 10 | Amaranthus chlorostachys, Amaranthus graecizans, Amaranthus hybridus, Amaranthus lividus, Amaranthus palmeri, Amaranthus rudis, Amaranthus spinosus, Amaranthus thunbergii, Amaranthus viridis, Euphorbia heterophylla |
| 1466 | ACGAACCCTTGCC CATTCTCCTGTA | TOC75 | 10 | Amaranthus chlorostachys, Amaranthus graecizans, Amaranthus hybridus, Amaranthus lividus, Amaranthus palmeri, Amaranthus rudis, Amaranthus spinosus, Amaranthus thunbergii, Amaranthus viridis, Euphorbia heterophylla |

TABLE 2-continued

Plant chloroplast import system gene trigger polynucleotides.

| SEQ ID NO | Seq | Gene | # Species | Species |
|---|---|---|---|---|
| 1467 | ACAGGAGAATGGGCAAGGGTTCGTC | TOC75 | 10 | Amaranthus chlorostachys, Amaranthus graecizans, Amaranthus hybridus, Amaranthus lividus, Amaranthus palmeri, Amaranthus rudis, Amaranthus spinosus, Amaranthus thunbergii, Amaranthus viridis, Euphorbia heterophylla |
| 1468 | TTTGCTGAACATGGAAACGATCTTG | TOC75 | 9 | Amaranthus chlorostachys, Amaranthus graecizans, Amaranthus hybridus, Amaranthus lividus, Amaranthus palmeri, Amaranthus rudis, Amaranthus spinosus, Amaranthus thunbergii, Amaranthus viridis |
| 1469 | TTTGAAATGGTTTCTTTGAGACCTG | TOC75 | 9 | Amaranthus albus, Amaranthus graecizans, Amaranthus hybridus, Amaranthus lividus, Amaranthus palmeri, Amaranthus rudis, Amaranthus spinosus, Amaranthus thunbergii, Amaranthus viridis |
| 1470 | TTTCTTCAATGGTGGAAACGGAGGT | TOC75 | 9 | Amaranthus albus, Amaranthus graecizans, Amaranthus hybridus, Amaranthus lividus, Amaranthus palmeri, Amaranthus rudis, Amaranthus spinosus, Amaranthus thunbergii, Amaranthus viridis |
| 1471 | TTTCTCAAAGCTTGCTTGCCTGCTT | TOC75 | 9 | Amaranthus albus, Amaranthus graecizans, Amaranthus hybridus, Amaranthus lividus, Amaranthus palmeri, Amaranthus rudis, Amaranthus spinosus, Amaranthus thunbergii, Amaranthus viridis |
| 1472 | TTTCAGTCATATCAGGATCCATCTC | TOC75 | 9 | Amaranthus albus, Amaranthus graecizans, Amaranthus hybridus, Amaranthus lividus, Amaranthus palmeri, Amaranthus rudis, Amaranthus spinosus, Amaranthus thunbergii, Amaranthus viridis |
| 1473 | TTTCAAAGAATGAATCTTCAGTACC | TOC75 | 9 | Amaranthus albus, Amaranthus graecizans, Amaranthus hybridus, Amaranthus lividus, Amaranthus palmeri, Amaranthus rudis, Amaranthus spinosus, Amaranthus thunbergii, Amaranthus viridis |
| 1474 | TTTATATTTCTCAAAGCTTGCTTGC | TOC75 | 9 | Amaranthus albus, Amaranthus graecizans, Amaranthus hybridus, Amaranthus lividus, Amaranthus palmeri, Amaranthus rudis, Amaranthus spinosus, Amaranthus thunbergii, Amaranthus viridis |
| 1475 | TTTAGTTACTTGTGGAATGTTTGAG | TOC75 | 9 | Amaranthus albus, Amaranthus graecizans, Amaranthus hybridus, Amaranthus lividus, Amaranthus palmeri, Amaranthus rudis, Amaranthus spinosus, Amaranthus thunbergii, Amaranthus viridis |
| 1476 | TTTACAGGAGAATGGGCAAGGGTTC | TOC75 | 9 | Amaranthus chlorostachys, Amaranthus graecizans, Amaranthus hybridus, Amaranthus lividus, Amaranthus palmeri, Amaranthus rudis, Amaranthus spinosus, Amaranthus thunbergii, Amaranthus viridis |
| 1477 | TTTAATATAGAAGCAGGCAAGCAAG | TOC75 | 9 | Amaranthus albus, Amaranthus graecizans, Amaranthus hybridus, Amaranthus lividus, Amaranthus palmeri, Amaranthus rudis, Amaranthus |

TABLE 2-continued

Plant chloroplast import system gene trigger polynucleotides.

| SEQ ID NO | Seq | Gene | # Species | Species |
|---|---|---|---|---|
| | | | | spinosus, Amaranthus thunbergii, Amaranthus viridis |
| 1478 | TTGTGTGGGAGA CCTTCCAAGTTAT | TOC75 | 9 | Amaranthus chlorostachys, Amaranthus graecizans, Amaranthus hybridus, Amaranthus lividus, Amaranthus palmeri, Amaranthus rudis, Amaranthus spinosus, Amaranthus thunbergii, Amaranthus viridis |
| 1479 | TTGGTGCAGCTAG AAACATTCTTGA | TOC75 | 9 | Amaranthus chlorostachys, Amaranthus graecizans, Amaranthus hybridus, Amaranthus lividus, Amaranthus palmeri, Amaranthus rudis, Amaranthus spinosus, Amaranthus thunbergii, Amaranthus viridis |
| 1480 | TTGGTACTGAAGA TTCATTCTTTGA | TOC75 | 9 | Amaranthus albus, Amaranthus graecizans, Amaranthus hybridus, Amaranthus lividus, Amaranthus palmeri, Amaranthus rudis, Amaranthus spinosus, Amaranthus thunbergii, Amaranthus viridis |
| 1481 | TTGCTTGCCTGCT TCTATATTAAAG | TOC75 | 9 | Amaranthus albus, Amaranthus graecizans, Amaranthus hybridus, Amaranthus lividus, Amaranthus palmeri, Amaranthus rudis, Amaranthus spinosus, Amaranthus thunbergii, Amaranthus viridis |
| 1482 | TTGCTGAACATGG AAACGATCTTGG | TOC75 | 9 | Amaranthus chlorostachys, Amaranthus graecizans, Amaranthus hybridus, Amaranthus lividus, Amaranthus palmeri, Amaranthus rudis, Amaranthus spinosus, Amaranthus thunbergii, Amaranthus viridis |
| 1483 | TTGCCCATTCTCCT GTAAACTTCAG | TOC75 | 9 | Amaranthus chlorostachys, Amaranthus graecizans, Amaranthus hybridus, Amaranthus lividus, Amaranthus palmeri, Amaranthus rudis, Amaranthus spinosus, Amaranthus thunbergii, Amaranthus viridis |

Example 3. Enhanced Plant Sensitivity to Glyphosate

In this example, growing *Amaranthus palmeri* are treated with a topically applied composition for inducing modulation of a target gene in a plant including (a) an agent for conditioning of a plant to permeation by polynucleotides and (b) polynucleotides including at least one polynucleotide strand including at least one segment of 19-25 contiguous nucleotides or more of the target gene of SEQ ID NO: 1-1263 or SEQ ID NO: 1584-1638. Target genes associated with the chloroplast protein import system include but are not limited to the structural genes that encode for translocon outer membrane (Toc) complex proteins, translocon inner membrance complex proteins (Tic), stroma processing peptidase, and chaperone like proteins.

The following procedure is used for all assays described in this example. Approximately four-week old *Amaranthus palmeri* plants (glyphosate-resistant Palmer amaranth, "R-22") are used in this assay. Plants are treated with 0.5-1.0 percent Silwet L-77 solution freshly made with ddH2O. Two fully expanded leaves per plant (one cotyledon, one true leaf) are treated with the polynucleotide/Silwet L-77 solution. Final concentration for each dsRNA polynucleotide was 25 microM) unless otherwise stated. Twenty microliters of the solution are applied to the top surface of each of the two pre-treated leaves to provide a total of 40 microliters (1-4 nmol polynucleotide) for each plant.

Spray solutions are prepared the same day as spraying. Single oligonucleotide molecules are applied at rates between 0.04 and 0.18 mg/ml in 20 mM potassium phosphate buffer (pH 6.8) are added to spray solutions 15 to 50 minutes before spraying. One-to-two-ml spray solutions were applied using a custom low-dead-volume sprayer ("milli applicator") at 8-30 gpa (gallons per acre) to one-to-four inch tall plants. Treated plants are place in a greenhouse set for either a 26.7/21.1° C. or 29.4/21.1° C. 14/10 hour temperature and supplemental light schedule. The amount of response relative to unsprayed treatments is collected at various time intervals up to 21 days after treatment.

A common spray nozzle used for all applications made with the track sprayer is the Turbo Teejet air induction nozzle (015) nozzle with air pressure set at a minimum of 20 psi (pounds per square inch or 160 kpa). This style nozzle is currently being utilized to lessen shear forces that can damage or otherwise change large macromolecules that can seen with other nozzle styles. The height of the spray nozzle is to

TABLE 4

*A. palmeri* plants treated with TOC75 trigger polynucleotides and glyphosate show enhanced sensitivity to glyphosate, percent growth reduction 7, 14, and 21 DAT

| Plant | Polynucleotide treatment | herbicide | Days after treatment | | |
|---|---|---|---|---|---|
| | | | 7 | 14 | 21 |
| R22 | Untreated control | no | 0 | 0 | 0 |
| R22 | Untreated control | no | 0 | 0 | 0 |
| R22 | Untreated control fb 2X WMAX | 2X WeatherMAX | 0 | 30 | 25 |
| R22 | Untreated control fb 2X WMAX | 2X WeatherMAX | 0 | 30 | 25 |
| R22 | Untreated control fb 2X WMAX | 2X WeatherMAX | 0 | 20 | 0 |
| R22 | Untreated control fb 2X WMAX | 2X WeatherMAX | 0 | 20 | 0 |
| R22 | Formulation control fb 2X WMAX | 2X WeatherMAX | 25 | 50 | 40 |
| R22 | Formulation control fb 2X WMAX | 2X WeatherMAX | 25 | 50 | 30 |
| R22 | Formulation control fb 2X WMAX | 2X WeatherMAX | 25 | 50 | 40 |
| R22 | Formulation control fb 2X WMAX | 2X WeatherMAX | 25 | 40 | 30 |
| R22 | EPSPS target (oligo 1, 3, 4, 5 @ 4 nm/plant) | 2X WeatherMAX | 75 | 80 | 80 |
| R22 | EPSPS target (oligo 1, 3, 4, 5 @ 4 nm/plant) | 2X WeatherMAX | 85 | 90 | 90 |
| R22 | EPSPS target (oligo 1, 3, 4, 5 @ 4 nm/plant) | 2X WeatherMAX | 75 | 90 | 90 |
| R22 | EPSPS target (oligo 1, 3, 4, 5 @ 4 nm/plant) | 2X WeatherMAX | 85 | 90 | 90 |
| R22 | TOC75 Set 1 (oligo 52, 53, 54, 55, 56 @ 4 nm/plant) | 2X WeatherMAX | 50 | 60 | 45 |
| R22 | TOC75 Set 1 (oligo 52, 53, 54, 55, 56 @ 4 nm/plant) | 2X WeatherMAX | 85 | 85 | 70 |
| R22 | TOC75 Set 1 (oligo 52, 53, 54, 55, 56 @ 4 nm/plant) | 2X WeatherMAX | 85 | 85 | 70 |
| R22 | TOC75 Set 1 (oligo 52, 53, 54, 55, 56 @ 4 nm/plant) | 2X WeatherMAX | 75 | 80 | 60 |
| R22 | TOC75 Set 2 (oligo 57, 58, 59, 60, 61 @ 4 nm/plant) | 2X WeatherMAX | 65 | 80 | 70 |
| R22 | TOC75 Set 2 (oligo 57, 58, 59, 60, 61 @ 4 nm/plant) | 2X WeatherMAX | 75 | 80 | 60 |
| R22 | TOC75 Set 2 (oligo 57, 58, 59, 60, 61 @ 4 nm/plant) | 2X WeatherMAX | 75 | 80 | 75 |
| R22 | TOC75 Set 2 (oligo 57, 58, 59, 60, 61 @ 4 nm/plant) | 2X WeatherMAX | 75 | 70 | 60 |
| R22 | TOC75 Set 3 (oligo 62, 63, 64, 65, 66 @ 4 nm/plant) | 2X WeatherMAX | 50 | 50 | 60 |
| R22 | TOC75 Set 3 (oligo 62, 63, 64, 65, 66 @ 4 nm/plant) | 2X WeatherMAX | 25 | 50 | 60 |
| R22 | TOC75 Set 3 (oligo 62, 63, 64, 65, 66 @ 4 nm/plant) | 2X WeatherMAX | 25 | 50 | 40 |
| R22 | TOC75 Set 3 (oligo 62, 63, 64, 65, 66 @ 4 nm/plant) | 2X WeatherMAX | 25 | 40 | 40 |
| R22 | TOC75 Set 4 (oligo 67, 68, 69, 70, 71 @ 4 nm/plant) | 2X WeatherMAX | 10 | 30 | 30 |
| R22 | TOC75 Set 4 (oligo 67, 68, 69, 70, 71 @ 4 nm/plant) | 2X WeatherMAX | 25 | 40 | 30 |
| R22 | TOC75 Set 4 (oligo 67, 68, 69, 70, 71 @ 4 nm/plant) | 2X WeatherMAX | 40 | 60 | 50 |
| R22 | TOC75 Set 4 (oligo 67, 68, 69, 70, 71 @ 4 nm/plant) | 2X WeatherMAX | 25 | 40 | 25 |
| R22 | TOC75 Set 5 (oligo 72, 73, 74, 75, 76 @ 4 nm/plant) | 2X WeatherMAX | 25 | 50 | 40 |
| R22 | TOC75 Set 5 (oligo 72, 73, 74, 75, 76 @ 4 nm/plant) | 2X WeatherMAX | 25 | 50 | 50 |
| R22 | TOC75 Set 5 (oligo 72, 73, 74, 75, 76 @ 4 nm/plant) | 2X WeatherMAX | 25 | 50 | 50 |
| R22 | TOC75 Set 5 (oligo 72, 73, 74, 75, 76 @ 4 nm/plant) | 2X WeatherMAX | 25 | 30 | 25 |
| R22 | TOC75 Set 6 (oligo 77, 78, 79, 80, 81 @ 4 nm/plant) | 2X WeatherMAX | 35 | 50 | 25 |
| R22 | TOC75 Set 6 (oligo 77, 78, 79, 80, 81 @ 4 nm/plant) | 2X WeatherMAX | 25 | 50 | 30 |
| R22 | TOC75 Set 6 (oligo 77, 78, 79, 80, 81 @ 4 nm/plant) | 2X WeatherMAX | 35 | 50 | 30 |
| R22 | TOC75 Set 6 (oligo 77, 78, 79, 80, 81 @ 4 nm/plant) | 2X WeatherMAX | 50 | 60 | 50 |
| R22 | TOC75 Set 7 (oligo 82, 83, 84, 85, 86 @ 4 nm/plant) | 2X WeatherMAX | 25 | 30 | 30 |
| R22 | TOC75 Set 7 (oligo 82, 83, 84, 85, 86 @ 4 nm/plant) | 2X WeatherMAX | 0 | 10 | 30 |
| R22 | TOC75 Set 7 (oligo 82, 83, 84, 85, 86 @ 4 nm/plant) | 2X WeatherMAX | 35 | 40 | 30 |
| R22 | TOC75 Set 7 (oligo 82, 83, 84, 85, 86 @ 4 nm/plant) | 2X WeatherMAX | 10 | 30 | 20 |
| R22 | TOC75 Set 8 (oligo 87, 88, 89, 90, 91 @ 4 nm/plant) | 2X WeatherMAX | 25 | 30 | 25 |
| R22 | TOC75 Set 8 (oligo 87, 88, 89, 90, 91 @ 4 nm/plant) | 2X WeatherMAX | 25 | 20 | 25 |
| R22 | TOC75 Set 8 (oligo 87, 88, 89, 90, 91 @ 4 nm/plant) | 2X WeatherMAX | 25 | 50 | 40 |

TABLE 4-continued

*A. palmeri* plants treated with TOC75 trigger polynucleotides and glyphosate show enhanced sensitivity to glyphosate, percent growth reduction 7, 14, and 21 DAT

| Plant | Polynucleotide treatment | herbicide | Days after treatment | | |
|---|---|---|---|---|---|
| | | | 7 | 14 | 21 |
| R22 | TOC75 Set 8 (oligo 87, 88, 89, 90, 91 @ 4 nm/plant) | 2X WeatherMAX | 35 | 50 | 40 |
| R22 | TOC75 Set 9 (oligo 92, 93, 94, 95, 96 @ 4 nm/plant) | 2X WeatherMAX | 50 | 60 | 40 |
| R22 | TOC75 Set 9 (oligo 92, 93, 94, 95, 96 @ 4 nm/plant) | 2X WeatherMAX | 50 | 60 | 50 |
| R22 | TOC75 Set 9 (oligo 92, 93, 94, 95, 96 @ 4 nm/plant) | 2X WeatherMAX | 75 | 80 | 60 |
| R22 | TOC75 Set 9 (oligo 92, 93, 94, 95, 96 @ 4 nm/plant) | 2X WeatherMAX | 75 | 65 | 50 |
| R22 | TOC75 Set 10 (oligo 97, 98, 99, 100 @ 4 nm/plant) | 2X WeatherMAX | 60 | 65 | 65 |
| R22 | TOC75 Set 10 (oligo 97, 98, 99, 100 @ 4 nm/plant) | 2X WeatherMAX | 60 | 70 | 70 |
| R22 | TOC75 Set 10 (oligo 97, 98, 99, 100 @ 4 nm/plant) | 2X WeatherMAX | 60 | 75 | 70 |
| R22 | TOC75 Set 10 (oligo 97, 98, 99, 100 @ 4 nm/plant) | 2X WeatherMAX | 65 | 80 | 70 |

Example 4. OEP80 Gene and Stroma Processing Peptidase Gene Target Results

*Amaranthus palmeri* plants (R22 glyphosate resistant biotype) were treated following the protocol described in Example 3. Trigger dsRNA polynucleotides shown in Table 5 (SEQ ID NO: 1535-1573, plus strand sequence illustrated) are targeting the *A. palmeri* OEP80 gene coding region (SEQ ID NO: 365). The polynucleotides were topically applied at 8 nmol/plant in a composition comprising 0.5-1.0 percent Silwet L-77 and buffer followed one day later by treatment with 2× WeatherMAX (WMAX). Injury rating of the treated plants was conducted 14 days after the WMAX treatment. The control treatments were buffer alone and 2 rates (4 nmol and 8 nmol) of a trigger polynucleotide (oligo 5.3) targeting the *A. palmeri* EPSPS coding gene sequence. The average baseline level of injury effect of buffer plus WMAX was set at 40 percent for this experiment. The results illustrated in FIG. 1 demonstrated that at least 18 polynucleotides (T25452, T25454, T25455, T25456, T25457, T29847, T29848, T25464, T25465, T25466, T25471, T25472, T25473, T25474, T25475, T25477, T25478 and T29213) were able to enhance the effect of WMAX on this glyphosate resistant biotype. Additionally, 4 regions of the target gene sequence were identified in which the polynucleotides in those regions were particularly effective, these regions are between nucleotide positions 369-701, 1016-1168, 1364-1622 and 1683-1792 of SEQ ID NO: 365.

TABLE 5

Polynucleotide trigger molecules for
*A. palmeri* OEP80

| SEQ ID NO | Oligo test ID | Polynucleotide sequence |
|---|---|---|
| 1535 | T25445 | GTTATCCCTGAGTCGACCCACTAACTCAACTCAGTCCAAAAACCCTTCAATTTC |
| 1536 | T25446 | GTCCAAAAACCCTTCAATTTCCTTCTGTCAATCCCTAAATTCTACTCTC |
| 1537 | T25447 | GTCAATCCCTAAATTCTACTCTCTTACAAGCCAAATTCTCAATTACCCAGTTCATTAATGGC |
| 1538 | T25448 | GCATCAAACTCCACGGAAACCCCGTTAAGTTTCAATCTTCTCCATCACCATTGC |
| 1539 | T25449 | GCTATGCTCTTCAACATTGTCTTTGAACGACTCAACTCAGCCTCCAGC |
| 1540 | T25450 | GCCGGAAGTGGTAGTGTGGTTGAGGTTAGTCAATCGAAATCGGCTTCAGTGAGTCGTAC |
| 1541 | T25451 | GTACTCGAAGGGAGGATGAAGAGAGAGTGTTGATTAGTGAGGTGTTAGTGAGGAGTAAAGATGGAGAAGAATTAGAGAGGAAAGATTTGGAATC |
| 1542 | T25452 | GGAGGCATTAATGGCATTGAAAGCTTGCCGGGCGAATTCAGCTTTGACTGTGC |
| 1543 | T25453 | GAGAGGTTCAGGAGGATGTTCACAGAATTATTGATAGTGGGTATTTTTCTTCATGTATGCCAGTTGCAGTGGATAC |
| 1544 | T25454 | GATACTAGGGATGGTATTAGATTGGTCTTTCAGGTAGAACCAAACCAGGAGTTTAGAGGACTGGTGTGC |
| 1545 | T25455 | GCGAAGGAGCTAATGTTCTCCCTTCCAAGTTTGTAGAGGATTCATTTC |
| 1546 | T25456 | GTGATGGATATGGGAAAGTGGTCAATATCAGGCGTTTGGATGAAGTGATTGATTC |

TABLE 5-continued

Polynucleotide trigger molecules for
*A. palmeri* OEP80

| SEQ ID NO | Oligo test ID | Polynucleotide sequence |
|---|---|---|
| 1547 | T25457 | GATTCTATAAATGGATGGTACATGGAGCGTGGTCTTTTTGGCATGGTTTC |
| 1548 | T25458 | GTTTCTGGTGTTGAGATACTTTCAGGGGGTATACTAAGGTTACAAATTTCTGAAGC |
| 1549 | T25459 | GCTGAGGTCAATGATGTTTCAATCCGCTTCCTTGATCGTAAGACACGTGAGCCAAC |
| 1550 | T25460 | GCCAACTGTTGGGAAGACAAAGCCAGAAACAATACTTCGACAACTTACAACAAAAAAAGGAC |
| 1551 | T25461 | GACAGGTATACAGTTTGAATCAAGGGAAAAGGGATGTTGAGACTGTTTTGAC |
| 1552 | T25462 | GACGATGGGAATCATGGAAGATGTAAGCATTTTTCCCCAGCCTGCTGGAGATAC |
| 1553 | T25463 | GATACAGGTAAAGTTGATTTGGTAATGAATGTGGTTGAGCGTGTGAGTGGTGGTTTC |
| 1554 | T25464 | GTTTCTCGGCTGGTGGTGGTATTTCGAGCGGGATAACGAGCGGACCGC |
| 1555 | T25465 | GCTATCAGGTTTAATTGGAAGCTTTGCATATTCTCACAGGAATCTGTTTGGAAAAAATC |
| 1556 | T25466 | GAAAAAATCAAAAAGTAAATGTCTCTCTTGAAAGAGGCCAAATCGACTCTATCTTCC |
| 1557 | T25467 | GGATAAATTATACAGTCCCATGGATTGAAGGTGATGATAAGCGTACTCAAAGGTC |
| 1558 | T25468 | GTCAATCATTATTCAGAACTCAAGGACTCCGGGTACTTTGGTCCATGGTAATC |
| 1559 | T25469 | GTAATCAACCTGAAAATAGTAACTTAACTATTGGCCGTGTAACAGCTGGC |
| 1560 | T25470 | GCATCGAATTCAGCCGGCCCCTAAGACCCAAATGGAGCGGAACAGCTGGAC |
| 1561 | T25471 | GACTTACGTTTCAGCATGCTGGTGTCCGTGATGAAAAAGGGAACCCCGTC |
| 1562 | T25472 | GTCATAAAAGATTTCTACAACAGCGCTCTTACGGCAAGTGGGAATACTCATGATAATATGC |
| 1563 | T25473 | GCTGCTTGCCAAAGGCGAGTGTGCCTACACGGGTGACTTAGGATCCTCAATGTTAGTC |
| 1564 | T25474 | GTCTTAAGCATGGAACAAGGTCTTCCTATCTATCCTGAGTGGCTGTGTTTTAATC |
| 1565 | T25475 | GTTTTAATCGAGTCAACGCTCGTGCTAGGTCAGGGGTGGACATTGGTCCAGC |
| 1566 | T25476 | GCTAATCTTTTTCTCAGTTTGTCTGGTGGTCATGTGGTCGGTAAATTTCCTCCTCATGAAGC |
| 1567 | T25477 | GTTTGCGATCGGTGGTACAAATAGTGTGAGAGGATATGAAGAAGGTGCCGTTGGC |
| 1568 | T25478 | GCTCAGGCCTTTCATACGTAGTGGGCTGTGGAGAAGTTTCCTTCCCTCTGTATGGTC |
| 1569 | T25479 | GTCCAGTAGATGGCGCTCTTTTTGCTGATTATGGAACGGATCTCGGATCAGGTTC |
| 1570 | T25480 | GTTCATTGGTTCCTGGTGATCCTGCTGGTGCGAGATTAAAACCCGGGAGTGGATAC |
| 1571 | T25481 | GGCTATGGATTTGGTATCCGTGTCGAGTCTCCATTAGGTCCTCTACGGTTAGAGTATGC |
| 1572 | T25482 | GCATTTAACGACAGACAAGCGAGGCGGTTTCATTTTGGCGTAGGTCATCGGAAC |
| 1573 | T29213 | GGATATGAAGAAGGTGCCGTTGGC |

Stroma processing peptidase is a key enzyme in the chloroplast protein import system of plants. *Amaranthus palmeri* plants (R22 glyphosate resistant biotype) were treated following the protocol described in Example 3. Trigger dsRNA polynucleotides shown in Table 6 (SEQ ID NO: 1574-1583, plus strand sequence illustrated) are targeting the *A. palmeri* stroma processing peptidase (SPP, SEQ ID NO: 936) or Toc75 gene coding region (SEQ ID NO: 260). The SPP polynucleotides were topically applied in 2 pools of polynucleotides, oligos 1, 4, 5, and 6, and oligos 2, 7, 8, and 9, at 3 nmol each/plant in a composition comprising 0.1 percent Silwet L-77 and buffer followed one day later by treatment with 2× WeatherMAX (WMAX). Injury rating of the treated plants was conducted 21 days after the WMAX treatment. The control treatments were buffer alone and a pool of 4 nmol each of 4 trigger polynucleotides (oligo 1, 2, 3, and 5) targeting the *A. palmeri* EPSPS coding gene sequence. The average baseline level of injury effect of WMAX treatment was 41 percent for this experiment. The results shown in Table 7 demonstrate that targeting the stroma processing peptidase gene with trigger polynucleotides homologous or complementary to the gene coding sequence enhanced the sensitivity of the plants to the herbicidal effects of glyphosate.

TABLE 6

Sequence of trigger molecules for Toc75 and stroma processing peptidase gene targets

| Oligo no. | SEQ ID NO | Sequence | Gene target |
|---|---|---|---|
| 1 | 1574 | TCAAGAAGTGGGATGTTGATAAAATAAAAA AATTTCATGA | SPP |
| 2 | 1575 | TGAAAGGTGTTCTAGAGGATGACATTCAAA AAGTCGAAGA | SPP |
| 3 | 1576 | GCAaGAAAGCTTTGAGAAaTATAACCTCTc TGGGATtATT | TOC75 |
| 4 | 1577 | CGGAGAAGAGGGTCATTAATAAAAAATGTT CGTTCAAGAT | SPP |
| 5 | 1578 | ATTTAGTCAGACTGGCTTGGAGAATGAGAC AGAGGCTTCCC | SPP |
| 6 | 1579 | ATTAAAGACACTGATGAAAGAGCCTGTGCC TATATTGCTGG | SPP |
| 7 | 1580 | AGAAATATCCCGCTGGTGATGGCGGTGATT TAAAGAAAAAG | SPP |
| 8 | 1581 | TGACATGAGTTTCTTGAAGCAAGAGCTACT TTCATTAGTA | SPP |
| 9 | 1582 | CTGTGGCATCTCCAGAAGACGTCGAAGCTG TAAAGAAAAT | SPP |
| 10 | 1583 | TCTTGAGCTTGCTGCTGAGTTACGGATACC TGTCAAGACCA | TOC75 |

TABLE 7

Stroma processing peptidase and Toc75 results

| Treatment | replications | Percent control 14 DAT | Stdev |
|---|---|---|---|
| Buffer alone | 4 | 0 | 0 |
| EPSPS target (oligo 1, 3, 4, 5 @ 4 nm/plant) | 4 | 97 | 4 |
| Stroma Processing Peptidase 1 (oligo 1, 4, 5, 6 @ 3 nm/plant) | 4 | 64 | 6 |
| Stroma Processing Peptidase 2 (oligo 2, 7, 8, 9 @ 3 nm/plant) | 4 | 65 | 17 |
| TOC75 (oligo 3, 10 @ 3 nm/plant) | 4 | 83 | 12 |
| Buffer + glyphosate | 4 | 41 | 15 |

Example 5. A Method to Control Weeds in a Field

A method to control weeds in a field comprises the use of one or more chloroplast protein import system trigger polynucleotides that can modulate the expression of an endogenous weed gene in one or more target weed plant species. A weed control composition comprising multiple herbicides and multiple polynucleotides can be used in a field environment to control *A. palmeri* plant growth. An analysis of chloroplast protein import system gene sequences from 20 plant species provided a collection of 25-mer polynucleotides (SEQ ID NO: 1264-1483) that can be used in compositions to affect the growth or develop or sensitivity to glyphosate herbicide to control multiple weed species in a field. A composition containing 1 or 2 or 3 or 4 or more of the polynucleotides of SEQ ID NO: 1264-1483 or at least one polynucleotide of at least 19 contiguous polynucleotides and at least 85 percent identical to SEQ ID NO: 1264-1483 that would enable broad activity of the composition against the multiple weed species or variant populations that occur in a field environment.

The method additionally includes creating an agricultural chemical composition that comprises components that include at least one polynucleotide of of at least 19 contiguous polynucleotides and at least 85 percent identical to SEQ ID NO: 1-1263 or SEQ ID NO: 1584-1638 any other effective gene expression modulating polynucleotide essentially identical or essentially complementary to SEQ ID NO:1-1263 or SEQ ID NO: 1584-1638 fragment thereof and a transfer agent that mobilizes the polynucleotide into a plant cell and a glyphosate containing herbicide and optionally a polynucleotide that modulates the expression of an essential gene and optionally a herbicide that has a different mode of action relative to glyphosate. The polynucleotide of the composition includes a dsRNA, ssDNA or dsDNA or a combination thereof. A composition containing a polynucleotide can have a use rate of about 1 to 30 grams or more per acre depending on the size of the polynucleotide and the number of polynucleotides in the composition. The composition may include one or more additional herbicides as needed to provide effective multi-species weed control. For example, a composition comprising an chloroplast protein import system gene trigger polynucleotide, the composition further including a co-herbicide that includes, but not limited to acetochlor, acifluorfen, acifluorfen-sodium, aclonifen, acrolein, alachlor, alloxydim, allyl alcohol, ametryn, amicarbazone, amidosulfuron, aminopyralid, amitrole, ammonium sulfamate, anilofos, asulam, atraton, atrazine, azimsulfuron, BCPC, beflubutamid, benazolin, benfluralin, benfuresate, bensulfuron, bensulfuron-methyl, bensulide, bentazone, benzfendizone, benzobicyclon, benzofenap, bifenox, bilanafos, bispyribac, bispyribac-sodium, borax, bromacil, bromobutide, bromoxynil, butachlor, butafenacil, butamifos, butralin, butroxydim, butylate, cacodylic acid, calcium chlorate, cafenstrole, carbetamide, carfentrazone, carfentrazone-ethyl, CDEA, CEPC, chlorflurenol, chlorflurenol-methyl, chloridazon, chlorimuron, chlorimuron-ethyl, chloroacetic acid, chlorotoluron, chlorpropham, chlorsulfuron, chlorthal, chlorthal-dimethyl, cinidon-ethyl, cinmethylin, cinosulfuron, cisanilide, clethodim, clodinafop, clodinafop-propargyl, clomazone, clomeprop, clopyralid, cloransulam, cloransulam-methyl, CMA, 4-CPB, CPMF, 4-CPP, CPPC, cresol, cumyluron, cyanamide, cyanazine, cycloate, cyclosulfamuron, cycloxydim, cyhalofop, cyhalofop-butyl, 2,4-D, 3,4-DA, daimuron, dalapon, dazomet, 2,4-DB, 3,4-DB, 2,4-DEB, desmedipham, dicamba, dichlobenil, ortho-dichlorobenzene, para-dichlorobenzene, dichlorprop, dichlorprop-P, diclofop, diclofop-methyl, diclosulam, difenzoquat, difenzoquat metilsulfate, diflufenican, diflufenzopyr, dimefuron, dimepiperate, dimethachlor, dimethametryn, dimethenamid, dimethenamid-P, dimethipin, dimethylarsinic acid, dinitramine, dinoterb, diphenamid, diquat, diquat dibromide, dithiopyr, diuron, DNOC, 3,4-DP, DSMA, EBEP, endothal, EPTC, esprocarb, ethalfluralin, ethametsulfuron, ethametsulfuron-methyl, ethofumesate, ethoxyfen, ethoxysulfuron, etobenzanid, fenoxaprop-P, fenoxaprop-P-ethyl, fentrazamide, ferrous sulfate, flamprop-M, flazasulfuron, florasulam, fluazifop, fluazifop-butyl, fluazifop-P, fluazifop-P-butyl, flucarbazone, flucarbazone-sodium, flucetosulfuron, fluchloralin, flufenacet, flufenpyr, flufenpyr-ethyl, flumetsulam, flumiclorac, flumiclorac-pentyl, flumioxazin, fluometuron, fluoroglycofen, fluoroglycofen-ethyl, flupropanate, flupyrsulfuron, flupyrsulfuron-methyl-sodium, flurenol, fluridone, fluorochloridone, fluoroxypyr, flurtamone, fluthiacet, fluthiacet-methyl, fomesafen, foramsulfuron, fosamine, glufosinate, glufosinate-ammonium, halosulfuron, halosulfuron-methyl, haloxyfop, haloxyfop-P, HC-252, hexazinone, imazamethabenz, imazamethabenz-methyl, imazamox, imazapic, imazapyr, imazaquin, imazethapyr, imazosulfuron, indanofan, iodomethane, iodosulfuron, iodosulfuron-methyl-sodium, ioxynil, isoproturon, isouron, isoxaben, isoxachlortole, isoxaflutole, karbutilate, lactofen, lenacil, linuron, MAA, MAMA, MCPA, MCPA-thioethyl, MCPB, mecoprop, mecoprop-P, mefenacet, mefluidide, mesosulfuron, mesosulfuron-methyl, mesotrione, metam, metamifop, metamitron, metazachlor, methabenzthiazuron, methylarsonic acid, methyldymron, methyl isothiocyanate, metobenzuron, metolachlor, S-metolachlor, metosulam, metoxuron, metribuzin, metsulfuron, metsulfuron-methyl, MK-66, molinate, monolinuron, MSMA, naproanilide, napropamide, naptalam, neburon, nicosulfuron, nonanoic acid, norflurazon, oleic acid (fatty acids), orbencarb, orthosulfamuron, oryzalin, oxadiargyl, oxadiazon, oxasulfuron, oxaziclomefone, oxyfluorfen, paraquat, paraquat dichloride, pebulate, pendimethalin, penoxsulam, pentachlorophenol, pentanochlor, pentoxazone, pethoxamid, petrolium oils, phenmedipham, phenmedipham-ethyl, picloram, picolinafen, pinoxaden, piperophos, potassium arsenite, potassium azide, pretilachlor, primisulfuron, primisulfuron-methyl, prodiamine, profluazol, profoxydim, prometon, prometryn, propachlor, propanil, propaquizafop, propazine, propham, propisochlor, propoxycarbazone, propoxycarbazone-sodium, propyzamide, prosulfocarb, prosulfuron, pyraclonil, pyraflufen, pyraflufen-ethyl, pyrazolynate, pyrazosulfuron, pyrazosulfuron-ethyl, pyrazoxyfen, pyribenzoxim, pyributicarb, pyridafol, pyridate, pyriftalid, pyriminobac, pyriminobac-methyl, pyrimisulfan, pyrithiobac, pyrithiobac-sodium, quinclorac, quinmerac, quinoclamine, quizalofop, quizalofop-P, rimsulfuron, sethoxydim, siduron, simazine, simetryn, SMA, sodium arsenite, sodium azide, sodium chlorate, sulcotrione, sulfentrazone, sulfometuron, sulfometuron-methyl, sulfosate, sulfosulfuron, sulfuric acid, tar oils, 2,3,6-TBA, TCA, TCA-sodium, tebuthiuron, tepraloxydim, terbacil, terbumeton, terbuthylazine, terbutryn, thenylchlor, thiazopyr, thifensulfuron, thifensulfuron-methyl, thiobencarb, tiocarbazil, topramezone, tralkoxydim, tri-allate, triasulfuron, triaziflam, tribenuron, tribenuron-methyl, tricamba, triclopyr, trietazine, trifloxysulfuron, trifloxysulfuron-sodium, trifluralin, triflusulfuron, triflusulfuron-methyl, trihydroxytriazine, tritosulfuron, [3-[2-chloro-4-fluoro-5-(-methyl-6-trifluoromethyl-2,4-dioxo-,2,3,4-tetrahydropyrimidin-3-yl)phenoxy]-2-pyridyloxy]acetic acid ethyl ester (CAS RN 353292-3-6), 4-[(4,5-dihydro-3-methoxy-4-methyl-5-oxo)-H-,2,4-triazol-ylcarbonyl-sulfamoyl]-5-methylthiophene-3-carboxylic acid (BAY636), BAY747 (CAS RN 33504-84-2), topramezone (CAS RN 2063-68-8), 4-hydroxy-3-[[2-[(2-methoxyethoxy)methyl]-6-(trifluoro-methyl)-3-pyridi-nyl]carbonyl]-bicyclo[3.2.]oct-3-en-2-one (CAS RN 35200-68-5), and 4-hydroxy-3-[[2-(3-methoxypropyl)-6-(difluoromethyl)-3-pyridinyl]carbon-yl]-bicyclo[3.2.]oct-3-en-2-one.

A field of crop plants in need of weed plant control is treated by spray application of the composition. The composition can be provided as a tank mix, a sequential treatment of components (generally the polynucleotide followed by the herbicide), a simultaneous treatment or mixing of one or more of the components of the composition from separate containers. Treatment of the field can occur as often as needed to provide weed control and the components of the composition can be adjusted to target specific weed species or weed families.

Example 6. Herbicidal Compositions Comprising Pesticidal Agents

A method of controlling weeds and plant pest and pathogens in a field of glyphosate tolerant crop plants is provided, by applying a herbicidal composition having a polynucleotide, an organosilicone surfactant (about 0.1 percent or greater), and a nonpolynucleotide herbicide and a pest control agent. The polynucleotide is essentially identical or essentially complementary to a segment of a gene sequence that is a component of a chloroplast protein import system of one or more of the target weed species. The trigger oligonucleotide is at least 19 nucleotides in length and at least 85 percent identical to a segment of a gene sequence of SEQ ID NO: 1-1263 and 1584-1638 isolated from a weed species. The nonpolynucleotide herbicide is preferably a glyphosate composition and the pest control agent is preferably an insecticide, fungicide, nematocide, bactericide, acaricide, growth regulator, chemosterilant, semiochemical, repellent, attractant, pheromone, feeding stimulant or other biologically active compounds or biological agents, such as, microorganisms.

For example, the admixture comprises a fungicide compound for use on a glyphosate tolerant crop plant to prevent or control plant disease caused by a plant fungal pathogen, The fungicide compound of the admixture may be a systemic or contact fungicide or mixtures of each. More particularly the fungicide compound includes, but is not limited to members of the chemical groups strobilurins, triazoles, chloronitriles, carboxamides and mixtures thereof. The composition may additional have an admixture comprises an insecticidal compound or agent.

The chloroplast protein import system trigger polynucleotides and WeatherMAX® (WMAX) tank mixes with fungicides, insecticides or both are tested for use in soybean. Soybean rust is a significant problem disease in South America and serious concern in the U.S. Testing is conducted to develop a method for use of mixtures of the WMAX formulation and various commercially available fungicides for weed control and soy rust control. The field plots are planted with Roundup Ready® soybeans. All plots receive a post plant application of the EPSPS trigger+WMAX about 3 weeks after planting. The mixtures of trigger+WMAX or trigger+WMAX+fungicide+insecticides are used to treat the plots at the R1 stage of soybean development (first flowering) of treatment. Data is taken for percent weed control at 7 and 21 days after R1 treatment, soybean safety (percent necrosis, chlorosis, growth rate): 5 days after treatment, disease rating, and soybean yield (bushels/Acre). These mixtures and treatments are designed to provide simultaneous weed and pest control of soybean, such as fungal pest control, for example, soybean rust disease; and insect pest control, for example, aphids, armyworms, loopers, beetles, stinkbugs, and leaf hoppers.

Agricultural chemicals are provided in containers suitable for safe storage, transportation and distribution, stability of the chemical compositions, mixing with solvents and instructions for use. A container of a mixture of a trigger oligonucleotide+glyphosate+fungicide compound, or a mixture of a trigger oligonucleotide+glyphosate compound and an insecticide compound, or a trigger oligonucleotide+a glyphosate compound and a fungicide compound and an insecticide compound (for example, lambda-cyhalothrin, Warrier®). The container may further provide instructions on the effective use of the mixture. Containers can be of any material that is suitable for the storage of the chemical mixture. Containers can be of any material that is suitable for the shipment of the chemical mixture. The material can be of cardboard, plastic, metal, or a composite of these materials. The container can have a volume of 0.5 liter, 1 liter, 2 liter, 3-5 liter, 5-10 liter, 10-20 liter, 20-50 liter or more depending upon the need. A tank mix of a trigger oligonucleotide+glyphosate compound and a fungicide compound is provided, methods of application to the crop to achieve an effective dose of each compound are known to those skilled in the art and can be refined and further developed depending on the crop, weather conditions, and application equipment used.

Insecticides, fungicides, nematocides, bactericides, acaricides, growth regulators, chemosterilants, semiochemicals, repellents, attractants, pheromones, feeding stimulants or other biologically active compounds can be added to the trigger oligonucleotide to form a multi-component pesticide giving an even broader spectrum of agricultural protection. Examples of such agricultural protectants with which compounds as described herein can be formulated are: insecticides such as abamectin, acephate, azinphos-methyl, bifenthrin, buprofezin, carbofuran, chlorfenapyr, chlorpyrifos, chlorpyrifos-methyl, cyfluthrin, beta-cyfluthrin, cyhalothrin, lambda-cyhalothrin, deltamethrin, diafenthiuron, diazinon, diflubenzuron, dimethoate, esfenvalerate, fenoxycarb, fenpropathrin, fenvalerate, fipronil, flucythrinate, tau-fluvalinate, fonophos, imidacloprid, isofenphos, malathion, metaldehyde, methamidophos, methidathion, methomyl, methoprene, methoxychlor, methyl 7-chloro-2,5-dihydro-2-[[N-(methoxycarbonyl)-N-[4-(trifluoromethoxy)phenyl]amino]carbonyl]indeno[1,2-e][1,3,4]oxadiazine-4a(3H)-carboxylate (DPX-JW062), monocrotophos, oxamyl, parathion, parathion-methyl, permethrin, phorate, phosalone, phosmet, phosphamidon, pirimicarb, profenofos, rotenone, sulprofos, tebufenozide, tefluthrin, terbufos, tetrachlorvinphos, thiodicarb, tralomethrin, trichlorfon and triflumuron; most preferably a glyphosate compound is formulated with a fungicide compound or combinations of fungicides, such as azoxystrobin, benomyl, blasticidin-S, Bordeaux mixture (tribasic copper sulfate), bromuconazole, captafol, captan, carbendazim, chloroneb, chlorothalonil, copper oxychloride, copper salts, cymoxanil, cyproconazole, cyprodinil (CGA 219417), diclomezine, dicloran, difenoconazole, dimethomorph, diniconazole, diniconazole-M, dodine, edifenphos, epoxiconazole (BAS 480F), famoxadone, fenarimol, fenbuconazole, fenpiclonil, fenpropidin, fenpropimorph, fluazinam, fluquinconazole, flusilazole, flutolanil, flutriafol, folpet, fosetyl-aluminum, furalaxyl, hexaconazole, ipconazole, iprobenfos, iprodione, isoprothiolane, kasugamycin, kresoxim-methyl, mancozeb, maneb, mepronil, metalaxyl, metconazole, S-methyl 7-benzothiazolecarbothioate (CGA 245704), myclobutanil, neo-asozin (ferric methanearsonate), oxadixyl, penconazole, pencycuron, probenazole, prochloraz, propiconazole, pyrifenox, pyroquilon, quinoxyfen, spiroxamine (KWG4168), sulfur, tebuconazole, tetraconazole, thiabendazole, thiophanate-methyl, thiram, triadimefon, triadimenol, tricyclazole, trifloxystrobin, triticonazole, validamycin and vinclozolin; combinations of fungicides are common for example, cyproconazole and azoxystrobin, difenoconazole, and metalaxyl-M, fludioxonil and metalaxyl-M, mancozeb and metalaxyl-M, copper hydroxide and metalaxyl-M, cyprodinil and fludioxonil, cyproconazole and propiconazole; commercially available fungicide formulations for control of Asian soybean rust disease include, but are not limited to Quadris® (Syngenta Corp), Bravo® (Syngenta Corp), Echo 720® (Sipcam Agro Inc), Headline® 2.09EC (BASF Corp), Tilt® 3.6EC (Syngenta Corp), PropiMax™ 3.6 EC (Dow AgroSciences), Bumper® 41.8EC (MakhteshimAgan), Folicur® 3.6F (Bayer CropScience), Laredo® 25EC (Dow AgroSciences), Laredo™ 25EW (Dow AgroSciences), Stratego® 2.08F (Bayer Corp), Domark™ 125SL (Sipcam Agro USA), and Pristine®38% WDG (BASF Corp) these can be combined with glyphosate compositions as described herein to provide enhanced protection from soybean rust disease; nematocides such as aldoxycarb and fenamiphos; bactericides such as streptomycin; acaricides such as amitraz, chinomethionat, chlorobenzilate, cyhexatin, dicofol, dienochlor, etoxazole, fenazaquin, fenbutatin oxide, fenpropathrin, fenpyroximate, hexythiazox, propargite, pyridaben and tebufenpyrad; and biological agents such as *Bacillus thuringiensis, Bacillus thuringiensis* delta endotoxin, baculovirus, and entomopathogenic bacteria, virus and fungi.

SEQUENCE LISTING (1638 sequences)

SEQ ID NO: 1 - DNA, 2313 bp, Abutilon theophrasti
ggctgctcttctgaaagctgcagcaggtgctggttcagatggcgttggctctagggatcggcctgctcattcgggttcctcattgcattcttcgaaagttgctcttgacaatgcattgaagggcactgtaaatgatgaagataggcagaggtttgaaaagttgcaactaataagagtgaagttcttgagacttgtacagagactaggccattctcacaccgatccgatggtggcacaggtgctgttccgtctggcccttgctgcaggtagtcttttcagtcaagaattcacacttgagtcggcaaagagagcggcgatgcagctcgaagcagaaggtaaagatgacttagactttactttgaacattgtggttctcggaaaaactggagtgggaaagagtgcaagcattaattccattttgtgtgagcaaaagtcgagaattgatgcttttgaaccggccacaactgccgtgaaggagattgtcggaacagtttatggagttaagatgagaatctttgatatgcccggtcttcgatctcctgtgacagaagaagctactaatcacaaactattagcatcgatgaagaggtttgtaaggaagttcccacccgatattgttctctatgtcgatcgtttagacgtgcatgacaaagatcttacagattttctattgctaaagtccctcactgattctctcggttcatcgatatggcaaaatgccattgtgacgcttactcatgctgcatctgctcccccagaagggccattcgggaacccctaagtttcgaggtctttgttgctcaaaggtcccatgtgattcatcgagctatcagccaagcagttggcgatctgcgtctaatgaattcgagtatgatgcatccagtggcgcttgttgagaatcatccatcatgtcagagagacgggaatggagaaattttgcttccgaatggccaaagttggaggtcacagttgttactattgtgctattcagtgaaaatcttatcattctttgtcgaagcctcgagaacagtttgataacaagaagctttttggcttccgttttcattccccacctctaccttactttactgtcttcactgctgcaatcccgtcctcatccaaaactacctaacaatgaaggcagtgaggatgttgactggaataccgagttgggagactctacatattccgatgaagaagattttgatgaatatgaccagcttccaccattcaagcctctaaaaaggtctcaggtcgataaacttagcaaagaacagagaaaagcttactacgaggagtatgattatcgcattaagctacttcaaaagaaacaatggagagaggaggtgagaagaatgagggaaatcaagaaaaaagggaaagatggtgatgagaataataatcatggttatgtcggagatgatggaaacacggaggaagcggatccagctactataccggtccctttgcctgacatggtcatcccactttcgtttgatggagacaaccctacttaccggtaccggtttttggattctgcttcgcagcttctcattaggcctgttttggactcgcaggcttgggatcacgatatcgggtatgacggtgttagccttgaaagaagtcttgctatagctggttattttcctggggcatttgttgttcaaatcacaaaggataaaagagaattcaacatccacttggattcctcagtctgttcaaaacatggagagaatggatctacaatggcgggatttgacatccaaaccgtcggaaaacagctcgcttacatcttcaggggtgaaacgaaattcagaaatttcaaaataaaccggacaaccgcaggtttatcagttactttccaaggtgaaaatgtggcaactggacttaagattgaggatcaagttgcgatcggaaaacgcttgcttttggctggaagtgctggggctatgagatcccaaggcgaaacagcatatggagctaacatcgaaatccggctaaaggataaggattttcctgttgagcaaaatcaaaccacatttggattgtctttggtgaaatggaggcgagacacgggtctaatggccaacttacagtctcagttctcgatcggacgttgttcttcgatggcggttcgtgtcggattgaacaacaagcggagtggacaaatcagcgtcaaaacaagcagctcggaccaattacagatagcactgttttgttttgttccaattgcagcctccatctttcggatgatctatcctggatctgatttgggcagttctgcatattagcaattttcattttgaacatcaa

SEQ ID NO: 2 - DNA, 3799 bp, Abutilon theophrasti
ttcgaatgatgattctaagtttgtaactagttcagttagcgaatcatgctttcagataatgaaattcgtaaaactagtgataacgagaatggtgagggggtgattgaaacagcgcccgaggagaggccaattgtggccgacccagatgaattaattcctagtctggggaatgttagtgatgcccctttggttagttctgatagttctaatgtgattttgaaagacggcttgcttgggggtggtgataatggttttagaggaatttataggtgagatggaaaagcttggtattggaagtgttggtaatggggaaaaggtggaaatgggctccattggtggagctgaccaatctgttttatcaatggaatgcggagaggaaggtagaattgggacggttgagaatcatgcgatattaggtggtgaaactaagctggtcaatcctataattgcagaaccagtggttcaagtagatggttcgaaattttccggtggagaggagtttcctgctgaaactggagatgccttaggaattaaggcatctgagattaatgagacagaggtggttccagttgccgggaatccgagcttggagaatggctttaatcagggtagtcatgatgaagaacaacctgttctggatgtccatccagtgtatgatcaacatactgagcctgttggcactgagaggaaagttgatgcttctagtgggagcccgtttggtatagataattccagaaccgagctaaatgatgaggatgtgattatagataggttggaacaagcgtctgctgagaatgtagatggaggggttataggtggaattcaggcaaaggatcgttcggctcaacctacagaaataacggcagctcatgaaacaaaggatttagatagtgattctcaaaacaaaacattggcaaccatggcagtagaagaacctgattcgccgaagtctgtggagcaagcttcagtttctcaagaaattggttttgaaggtgaaatggaagagaagcatcatcagaatgaaggcgttgaaattggaggctcagatactgatggagagtctgaaagcatgttctttgagaattctgaagctgctaagcaattcttggaggagctagaacgaggatctgccgttggttcaaactgggtgctgatacttctcatgatcattctcagaggattgatgatcagattgtcattgaatcagatgaagaagaggataccgatgaagaaggggaggggaaggagttatttgattctgccgctttggcagcccttttgaaagcagcaactggcggtggctctgacggcggtaacattacgataacctctcaagatggaaccaggcttttctctgttgaacgtcctgcaggtttaggatcttcactccaaaatgcaaaatctgcatctcgatcaaacaggcctaatatatttagcccctgctgtgacaagtaggagagactccgacgacaacttgagtgaagaagaaaaaataaaactggaaaagttacagcttataagagtcaaattcttgaggattgttcagaggctcagactttctacagaagattctctagcagcacaggttctttatagactggcacttcttgcagggaggcaaactagtgaactgtttagtgttgattctgcaaagaggacagctctggaacttgaaacagagggtaaagatgatttaagcttctccttaaacatattagtacttgggaagattggggtgggcaagagcgcaacaataaattcaattttcgatgaggtgaagacctcaattcatgcatttgaacctgccactgcagttgtgaaagagattactggaacagtagatggtgttaaactgaggatcattgataccccaggattgaaatcttcagcaatggagcaaggtgccaatcgcaaggtcctagcttctataaaacaattcataaagaagtgtccccctgatgttgtggtctatgttgatcggttggacaccccgacccgggatcttagtgatctgccgatgttaaggtcaatcactaattctcttggctcctctatctggaaaaatgccatagttgcattgactcatgctgcttctgcaccccctgatggaccatctggatcacctatgagttatgagatgtttgttgcccaacgttctaatattgttcagcagtctattggtcaggctgttggtgatctacgcatgatgagtccgagtttgatgaatcctgtttgtcttgttgaaaatcatccatcatgccgtaagaatagagatggccacaaggtgctacctaatggtcaaacttggaggcctcagctagagctgttatgctgttctatcaaagtcttatctgaagcgagttctctctccaaacctcaagatccatttgaccatcggaggctctttggttttcgtgtccgatctcctcctcttccatacttgttatcttcgctgctgcagtctcgtagccatcctaaactcgctgctgatcagggtggtgagaatggcgactctgatattgatatggctgatttatctgattccgatcaagaagaagatgaggatgagtatgaccaactaccaccatttaaacctctaaggaaacaacagcttgccaagcttaacaaggagcaaaggaaggcatatttcgaggagtacgattatcgcgtgaagctcctccagaaaaagcagtggagggaggagttgagaagaatgagagagatgaagaaaggaaagcctgccattgatgaatctggtaacatgggggaagatgttgatcctgaaaccggtggtccagctgccgtacctgttccattaccggacatggtcctgccaccttcattcgatgctcataatccagcgtacaggtaccggttcttggaaccaacttctcagttcttggcgaggccagttctggacacccatggttgggaccatgattgtggctatgatggtgttaacgttgaacatagtctagcaattgccagccagtttcctgctgctgttgcggtgcaactcaccaaggataagaaagagtttaacatccatttggattcttcagtttctgccaaacatggtgaaaatggatcaaccatggctggctttgacatccaaaatgttggaaagcaattagcttatgttataagaggggagaccaaattcaaaaatttcaaaaggaacaaaacagctgcaggcttttctgtcacgtttctaggtgagaatgttgcaactggactcaaactcgaggatcatattgctgttggaaagcggctgatgttaactggtagcactggaacggttagatcaaaaggtgattcagcatacggagccaatctgaaatacagctccgggatgcagattttccaatcggccaggatcaatccactttgggtttgtctctagtcaaatggagaggggacttggctttgggtgcgaattttcagtctcagttttcgttggacggagttcaaaaatagcagttcgtgcagggttgaacaacaagatgagcggacagataactgttcgaacaagcagctcggatcagcttcagattgcactcactgctattcttcctattgtcatggcaatttataaaagcatcaggcctggggttagtgacaagtattcaatgtattagcttgtttatcagatcagattatattggaggaggcttttcattgtatcctttcctccgcaatccttgaataatttgctttaagattacttttgagcatgaactctactgctttgatgagatttccattttgtttcttaataaatgttatttaagcaaggtaa

SEQ ID NO: 3 - DNA, 336 bp, Abutilon theophrasti
taaacatacttgtgcttgggaagattggggtaggcaagagcgcaacaataaattcaatttttggtgaggtgaaaagcccaattcatgcttttgaacctgccactgcagttgtgaaagagattactggaacagtagatggtgttaaactgagggtcattgataccccaggattgaaatcttcagcaatggagcaaggtgccaatcgcaaggtcctagcttctataaaacatttcataaagaagtgtccccctgatgttgtggtctatgttgatcggttggacaccccaacccgggatcttagtgatctgccattgttaaggtcaatcactaattctc

SEQ ID NO: 4 - DNA, 332 bp, Abutilon theophrasti
gattttccaatcggccaggatcaatccactttgggtttgtctctagtcaaatggagaggggacttggctttgggtgcgaattttcagtctcagttttcggttggacggagttcaaaaatagcagttcgtgcagggttgaacaacaagatgagcggacagataactgttcgaacaagcagctcggatcagcttcagattgcactcactgctattcttcctattgtcatggcgatttataaaagcatcaggcctggggttagtgacaagtattcaatgtattagcttgtttatcagatgagattatattggaggcggctttgcattgtatcatc

SEQ ID NO: 5 - DNA, 2455 bp, Abutilon theophrasti
tcgtttgattctgtgcatattgataatctcatagtttttcatctatgtgcatgtctcgtttgattctgtgcatattgataatctcatagtttttcatctatgtgcatgtctagccgtgaagtaacgggattatttgaaatgtaaattattataatataattttattattattatcgtaaaaaagtctgaatatattaaaagaccaaaatatttaaagaaaatcgaaatataattttatattgtatttagcgggtcggaatcgaaatataaccgaatctatacttttttaagttctataaactttatcaattgaactgctcccatcgatcaatacaaagatggatgtttattttattgttttgatattacaccatacgcgacagcaacttccgctgcctaaggccggaaaatcacgtcactgaaatgagcaatcaaattattgttgcttaatctaatttttaggtaattatctagttttaaaatatatattttttaaatagttaaatatactgatatactattcggtcctcatcaatacttcgaacgtaattatcaaactatctgatttgattccgtagatgtaggataatttatccaaacagcttaaacgtatcattgaatgttacctctttagttctctgtatttaattttcgtatttacagttttcgtggtactgttatgacaaagttcagtttttatgcctacaaaattttataatcctgttaaacttcgcctgttacaacaatcgatctcagagtgtatcactcaacccttaatatttcatatattattttaaataatatttcgatatactattcgtcataatatagaaaatacgtgaaacattatcttccgaaagcaaacaaaggtattcagaagcctaattcttgacgttatctttccaaaggctaacccacaaaaagccttatcttttctgggagaattatcgttactcactatctacttgagcctttgcctcatccaattttgaaggttaaacagtgtttatgagctttaacaatttatccaagaaaacgttatactttttttttacagtaataaatatctcttataaagttgaattgtacctaaaattagtaaaaattcaatttttttttaccaaaaaaaactcacatccattattttttttacaatatataaattatttcttaaaaaaatatataaattatattttttaggaatccacactcacacggtgtaaaactatcaattttatagttattggattatgctaatgaatgattcatattaaaactttaaacacctcttaactattttcaatcttcttatttttaagagagaatgatttaatctcaaccatccatttattataatctaatgaccataaaaacgtataaaagcttaacgattttactcaattatattattcaataatttatattgattttgttaattttgaattactgttcacaactgggaaaaaaacactcttaacagattggtacatggaaaataacgaactaaccgcgaattccagtaatgagtaatccaatccgaattttctgtaccacccaaaattcctatcatcatatcctaaaaccctaaactctcaatctcccactcgtctctcacaaccgacctcccatggacgccgagctttctaccccggcaaccacctctcactcgctctctacctctccaggttcttcttccttgtcttcctctgttgtagtttcgaatgatgattctaagtttgtaactagttcagttagcgaatatgctttcaaagataatgaaattcgtaaaactagtgataacgagaatggtgagggggtgattgaaacagcgcccgagaggccaattgtggccgacccagatgaattaattcctagtctggggaatgttagtgatgcccctttggttagttctgatagttcgaatctgattttgaaagacggcttgcttgggggtggtgataaggttttagaggaatttataggtgagatggaaaagcttggtattgaaagtgttgataatggggaaaaggtggaaatgggctccattggtgaaactgaccaatctgttttatcaatggaaagcgaagaggaaggtaaaattgggacggatgagaatcatgcgatcttaggtagtggagctaagctggtcaatcctataattgcaaaaccagtggttgaagtcgatggttcgaaattttacggtggagaggagtttcctgctgatgctacatctttaactggagatgccttaggaattaaggcatctgagattaatgagacagaggtggttccagttgccgggaatccaagcttggagaatggctttaatcagggtagtcatgatgaaaaacaacctgttctggatgtccatcctgtgtacgatcaacatactgaccctgttggtaccgagaggaaagttgatgctgctagcgggagcccgtttggtatagataat

SEQ ID NO: 6 - DNA, 354 bp, Abutilon theophrasti
tgtcggattgaacaacaagcggagtggacaaatcagcgtcaaaacaagcagctcggaccaattacagatagcactgttttgttttgttccaattgcagcctccatctttcggatgatctatcctggatctgatttgggcagttctgcatattagcaattttcattttgaacatcaatggcattaaactttgtttagtttagcaattttaatcttttttttttttttttgcaatctagaagtcttttgaaaactttaacgaaacagaacctacttatatccattcaatggtggtttttgagcaacttttattcattgtataaaggtaaaattccactattagtccctgtattatg

SEQ ID NO: 7 - DNA, 1125 bp, Abutilon theophrasti
gaagcagaaggtaaagatgacttagactttactttgaacattgtggttctcggaaaaactggagtgggaaagagtgcaagcattaattccattttgtgtgagcaaaagtcgagaattgatgcttttgaaccggccacaactgccgtgaaggagattgtcggaacagttgatggagttaagatgagaatctttgatatgcccggtcttcgatctcctgtgacagaagaagctactaatcgcaaactattagcatcgatgaagaggtttgtaaggaagttcccacccgatattgttctctatgtcgatcgtttagacgcgcatgacaaagatcttacagattttctattgctaaagtccctcactgattctctcggttcatcgatatggcaaaatgccattgtgacgcttactcatgctgcatctgctcccccagaagggccattcggggaacccctaagttttgaggtctttgttgctcaaaggtcccatgtgattcatcgagcgatcagccaagcagttggcgatctgcgtctaatgaatccgagtatgatgcatccagtggcgcttgttgagaatcatccatcatgtcagagagacgggaatggagaaattttgcttccgaatggccaaagttggaggtcacagttgttactattgtgctattcagtgaaaatcttatcagaagcaagttctttgtcgaagcctcgagaacagtttgataacaagaagctttttggcttccggcttcattccccgcctctaccttacttactgtcttcactgctgcaatcccgtcctcatccaaaactacctaacaatgaaggcagtgaggatgttgactggaataccgagttgggagactctacatatttcgatgaagaagattttgatgaatatgaccagcttccaccattcaagcctctaaaaagatctcaggtcgataaacttagcaaagaacagagaaaagcttactacgaggagtatgattatcgcattaagctacttcaaaagaaacaatggagagaggaggtgagaagaatgagggaaatcaagaaaaaagggaaagatggtgatgagaataataatcatggttatgtcggagatgatggaaacacggaggaagcg

SEQ ID NO: 8 - DNA, 219 bp, Abutilon theophrasti
acctaatggtcaaacttggaggccacagctagtgctgttatgctgttctatcaaagtcttatctgaagcgagttcactctccaaacctcaagatccatttgaccatcggaaactcttcggttttcgtgtccgatctcctcctcttccatacttgttatcttggctgctgcagtcacgtagccatcctaaactcgctgctgatcagggtggtgagaatgg

SEQ ID NO: 9 - DNA, 1481 bp, Abutilon theophrasti
gggtgttgacaatggttttttggatgattctaacgcaaaccaagtggttgttcctactgtcccaattgctcaattgtcaatggatgattatgatgtgtttgatgaaatgtcgagtgatgatgaaattgtgactggagttgaagatagtgggctttctggggtggttaaggttcctcctggtagtattgaaatctccaaattagatgagggtgttaagccttttgcggatgaaggcctaaatccgggagaagagagggttgaatcgaaggatggaaatggtcatgaaatagagaggagtggttctgttatgtttaatgattccaatcttgattctcaacctgtggtcgattccattgatatgaaagaatcaagtgatgtcgtggaaatagttgaagtttcgactccaacaccaattctagaccaaaacgttaaaccggggttcctttgtgatgatgatgttgtgcaactgatttttgggagctctcaaacgactgaacaagtagtgaatgagatagattcggaagatcgattagagacgggaagtcagcagattgacatagggttggatgaagatgtggaagctgaaatttccaaattggatgagggtgttaagccatctcttgataaaagcattgcaccggaaaatctgggtgaggagaaggtcaaatcaaagcatggaaacgatcatgagatagaggagaatggttctgttatgtttgatgattccaatcatgatgctcaacctgtgctcaaatccgttgatgaatttggtgtgtctgatatgaatgaatcaggtgatgtcatggactcagttgaagtttctgctctgacatccattctagaccaagatggtaaaccacgagtagaagatatagctaagcatgatgatgatgttgtgcagctgagttttggaaccaaacaagtagtgaatgaggtagattcagaatttcgatcagagacagaaagtcagccgattgtcatagactgggatgaagaagttgaagctgagagggaatatgaagcgaaagagctactcggttctgcagcattggctgctctcttggatcctgctgaagatgatgaagaaatggaagctgagagggaatatgaagcaaaagagcttctcgattctgctgcattggctgctcttctgaaagctgcagcaggtgctggttcagatggcgttggccctagggaccggcctgctcatttggaatcctcattgcattcttcgaaagttgctcttgataatgcatctaagggaaatataagtgatgaagataggcggaggtttgaaaagttgcaacttataagagtgaagttcttgagacttgtacagagactaggccattctcacactgacccgatggaggcacaggtgctgttccgtctggcccttgctgcaggtagtcttttcagccaagaattcacccttgaatcggcaaagagagcagcagtgcagctcgaagcagaaggtaaag

SEQ ID NO: 10 - DNA, 1286 bp, Abutilon theophrasti
ccctacttaccggtaccggtttttggattctgcttcgcagcttctcattaggcctgttttggactcgcaggcttgggatcacgatatcgggtatgacggtgttagccttgaaagaagtcttgctatagctggttattttcctggggcatttgctgttcaaatcacaaaggataaaagagaattcaacatccacttggattcctcagtctgttcaaaacatggagagaatggatctacaatggtgggatctgacatccaaaccgtcggaaaacagctcgcttacatcttcaggggcgaaacgaaattcagaaatttcaaaataaaccgaacaaccgcaggtttatcagttactttactaggtgaaaatgtggcgactggacttaagattgaggatcaagttgcgatcggaaaacgcttgcttttggctggaagtgctggggctatgagatcccaaggcaaaacggcatatggagctaacatcgaaatccggctaaaggatgaggattttcctgttgagcaaaatcaaaccacatttggattgtctttggtgaaatggaggcgggatacgggtctaatgaccaacttacagtctcagtacttaacgatatgtgggcgatatttgagacgtattacgactcaactcaaacttggtcgtgtttcattttaattgagataaaagaatgaattcctaaaaagttatagtggaaaaagcttgattaggccgattatcatgatttaattattatactggtttaatcacgataaaagtcttacaagatcccaaacacaataataacgaatcatgtcgactctactttacatggatcaaaagccatatatgcctgtaagaatcctcggctgaaattcaaatatttttcatcactaacttattggagctgagcccccgaattttctaatggctgctgcagcaactcgggttcctctaagtcctcggcgtggatcggtatatcctgttgaaacgcaaaccaattattaccgtccgattcatttctgaataacaacaatgttcggatacaagatgttcgggtagtaaggggatacctgagcctgcagtagctgatgtggttgctggtcttgtgccatcgtgtagggttggggctgtgacattctgtaataaggctctttgagatcgagtttgcatgaagaggtctgaataattcctccttgctcggcaccgggtccccacattttagctataagagtttgatacattacttccattaaaaaaagaccgcgaatcagaagaacaaaaaccaagctcgaaa

SEQ ID NO: 11 - DNA, 1381 bp, Abutilon theophrasti
gttgccgggaatccgagcttggagaatggctttaatcagggtagtcatgatgaagaacaacctgttctggatgtccatccagtgtatgatcaacatactgagcctgttggcactgagaggaaagttgatgcttctagtgggagcccgtttggtatagatatttccagaatcaagctaaatgatgaggatgtgattatagataggttggaacaagcgtctgctgagaatgtagatggaggggttatgggtggaattcaggaaaaggatcgttcggctcaacctacagaaataacggcagctcatgaaacaaaggatttagatagtgattctcaaaacaaaacattggcaaccatggcagtagaagaacctgattcgccgaagcctgtggagcaagcttcagtttctcaagaaattggttttgaaggtgaaatagaagagaagcatcatcagaatgaaggcgttgaaattggaggctcagatactgatggagagtctgaaagcatgttctttgagaattccgaagctgctaagcaattcttggaggagctagaacgaggacctgccgttggttcaaactcgggtgctgatacttctcatgatcattctcagaggattgatgatcagattgtcattgaatcagatgaagaagaggataccgatgaagaaggggaggggaaggagttatttgattctgccgctttggcagcccttttgaaagcagcaactggcggtggcactgacggcggtaacattacgataacctctcaagatggaaccaggcttttctctgttgaacgtcctgcaggtttaggatcttcactccaaaatgcaaaatctgcatctcgatcaaacaggcctaatatatttagccccgctgtgacaagtaggagagactccgacgacaacttgagtgaagaagaaaaaataaaactggaaaagttacagcttataagagtcaaattcttgaggattgttcagaggctcagactttctacagaagattctctagcagcacaggttctttatagactggcacttcttgcagggaggcaaactagtgaactgtttagtgttgattctgcaaagaggacagctctggaacttgaaacagagggtaaagatgatttaagcttctccttaaacatattagtacttgggaagattggggtgggcaagagcgcaacaataaattcaatttttgatgaggtgaagacctcaattcatgcatttgaacctgccactgcagttgtgaaagagattactggaacagtagatggtgttgaactgaggatcattgataccccaggattgaaatcttcagcaatggagcaaggtgccaatcgcaaggtcctagcttctataaaacaattcataaagaagt

SEQ ID NO: 12 - DNA, 305 bp, Abutilon theophrasti
gacatggtcctgccaccttcattcgatgctcataatccagcgtacaggtaccggttcttggaaccaacttctcagttcttggcgaggccagttctggacacccatggttgggaccatgattgtggctatgatggtgttaacgttgaacatagtctagcaattgccagccagtttcctgctgctgttgcggtgcaactcaccaaggataagaaagagtttaacatccatttggattcttcagtttctgccaaacatggtgaaaatggatcaaccatggctggctttgacatccaaaatgttggaaa

SEQ ID NO: 13 - DNA, 1217 bp, Abutilon theophrasti
atcagattatattggaggaggcttttcattgtatcctttcctccgcaatccttgaataatttgctttaagattacttttgagcatgaactctactgctttgatgagatttccattttgtttcttaataaatgttatttaagcaaggtaatttattgcttttataaatatgaaagtttgccttttagcagaggcatcttcacttcagtttggtctttacatgcatatcactgattttccattgcatggtaccacaagtgcggaaacccgaattttggggtgtacctttcttgccttggttactactaataccatctatatcaatcttcttgaatatattcctgctggggtctctggatggaccgtcgtatgtccgattcgggttctcggctttagcggtactcgtatacgtcctataaagcgttttatgtcagttttgatgctgaagcagtgggcacattggttcgaaagaatggtgaaatgtgtagggaatcagtagatagtgaggaccctagtcacaaatgtaaaggactttggctcaccatttttataccctctaaaagatcttttttgtatggttgatggggtggaatcagataaaggaaaattaggagaggaatatataatttaatttaattttatctaattttgtagaaacatgtacagctggtgtgtctttgaaataggctgattagattttgatccttattttgtacattatcatgtgctgatgtttcatcttaaattaaaaaatttcatcttaaattaaaaaatttcacatcaatgaaaacaaaaaagacaaattaagtaaagcggttgaaccctctgaattgtccattccacttgctgtcaatgaaaaatcgaaacaatcaaacaattaaaaatttcaattaaaccgaaactatgatatttatgactaaaaaaatttctataatagtaaatttgtacaagtgaatttatatcctatttgttaagttttttaacggtttgagatgaaaaaatatcacaacatttaatcttgactagtttagtaacttctttatacttaaaaaccactataaaatgcaaacaaaagttaggagtttgtgagtgtactttatccaaaaatatatattaggccaaaatagaacaaactagtgtacgactcgtgctacgcacggcgagttgtcgtccgagttgtgttaattgcacctgtttatatatatacatatacatatac

SEQ ID NO: 14 - DNA, 1542 bp, Alopecurus myosuroides
gaccgtcttgatagtctgagccgtgatctcaatgacttgcctcttctgaaaaccatcactgctgttctgggttcttccatatggttcaatgctattgttgctctcacccatgctgcttctgctcctcctgaaggcctcaatggtgcccctatgacatatgaggtattaatggcgcagcgatcccacattatccagcaatccatcaggcaggctgcaggggatatgcgtctgatgaacccagtagcccttgttgagaaccatccttcttgccggaagaaccgtgatggtcagaaagtgcttccaaatggccaaagttggaggcatcagatgctgctcttgtgctactcttcaaagatattatcagaagccaactcacttttgaagcttcaggatccctctcctgggaagctttttgggttccggttccgctccccaccgcttcctttcctgctatcctccctgttgcagtcgagagctcacccgaaactttcccctgaccagggtggtaatgaaggagattctgatattgatttggacgagtattctgatatagaacaagatgaagatgaggaggaatatgatcagcttcctcccttcaagcctctgaccaaagctcagcttggaaggctcacaaaagagcagaagaatgcatattttgatgagtacgactacagggtcaagcttctgcagaagaaacagtggaaggacgagctccgcaggttgaaggagatgaagaagaggggtaagtctgatatggatgcttatgggtatgctagtatcgcaggagaaaacgatcaggatcctcctccagaaaatgtttcagtccccttacctgacatggtgctgcctccttcatttgattgtgacaacccgacataccggtaccgctttctggaaccaacgtctactgtccttgcaaggcctgttctagatgcgcatgggtgggaccatgactgcggttatgatggagtaagtgtcgaagagtcgctcgctctccttagcaagttcccaggtaccgtggcagttcaggttaccaaggacaagaaggaatttagcatccatttagattcttccatctcagcaaagcatggggaggatgcgtcgtctcttgcgggttttgacatccagactgttgggcggcagcttgcgtatattttccgtggtgagaccaaattcaagagtatcaagaagaacaagactactggaggattctctgtgaccttcttgggtgacattgtggcaactgggctgaaggttgaggaccagctctctgttggcaagaggctggcattagtggcaagcacaggagcaatgcgagctcaaggggacacagcctatggagctaacttggaaatgcggttgaaggacaaagattatccaataggccagtccttgtcgaccttgggcctgtccctaatgaagtggcgccgcgacctcgccctgggggctaacctgcagtcccagttctcggttggaaggggttcaaagatggcggttcgcctgggtctgaacaacaagctgagcgggcagatcaccgtcagg

SEQ ID NO: 15 - DNA, 605 bp, Amaranthus albus
cagcgacaccccagcttatcgttatcggttcttggagccaacgtcacagttcttggctcgtccagtgttggacacccatggttgggaccatgattgcgggtatgatggtgtcaatgtcgagcaaaatataggaatcgcaggacgcttcccagcagcagtaactgtgcaggtaaccaaagataagaaagacttcaacattcacttggattctgcagtctcagccaagcatggagaagatggttccagcttagtcgggtttgacgttcaaacaatcggtaaacagcttgcttatatcataaaaggcgaaaccaaattcaaaaacctgaagaagaacaagacagctggtggaatctcggttacatttctgggagagaatgtagccacaggagtgaaactcgaagatcagatatctttgggcaagaggctcgttttcgtagggtccacaggaaccgttcgttctcagaaagatgctgcatacggagccaatctggaactacgccttaaagatgccgatcatcccattaaccaagaccagtcctcttttgtactatcactcatgaaatggagaggagacttggcaatcggaggaaacgtgcagtcccaga

SEQ ID NO: 16 - DNA, 807 bp, Amaranthus albus
ctggtgaagctttacggtctggagctgccattgttggggaagtagaggaaacaaaagacttagagagcaaagaaactacagttgttgaaaacaatgttattgaagattttgtttcaacattggaggatagtgttgcagaaaaacctgctgtagatgatgaaaccctagtaaaatcaattgaggtaggtgaaattgatacccttgcatctgggtctgatgtagtttcaccagatattggggctccgaaggtaggtttgcccatggcggagatttcagatgatggggatgatgatgaaattgaggatgttagtggagaggaggataatggtgaagttgagtctgaattgagtaggtcatttggtgttaataaggctcctagagttagggtttcgggtgatgatgatgaggagggagagagtgaggacgagatctttgaagaagcaaacgagaagatagagggtgatccattagaggataagactgttgatggtgatgataaagtagatgttgagttggttaatgaggaggatgctgttgtggattccataaatgtggatgttgttgaagcagtaaggtcaggggttgctgttgttcaggtagaagaagaaaagctggactccaatgtcgagtctgcggaaactgttgtaggagataaggatagtgaggtggaatctgaaattcaagtaggggaggaggatacatctgtggttgaagagcctgcgttagatgcgtctgcgtctgttgaaggtagtgaagtgaagttaactgatgagggggattctatcgtggattcaattcgtgtcgatg

SEQ ID NO: 17 - DNA, 1202 bp, Amaranthus albus
gacttggtcagactgcagagcaatccgtagcagcacaagttctctataaactagcaatgttcgcaggtaggacagcgattccgtctttcagtctcgataatgcgaaacagactgcttcgctgcttgaggctgaaggtaatgaagatttagacttttccttgaacatcctggttcttgggaaaactggtgttggcaagagtgccaccatcaattcaatatttggtgaagagaaggtaaaaatcaatgcattcgaacctgaaaccacttctgttaatgtcgttaatggaattgtggatggggtcaaaatcagggtcattgacgcaccaggtctcaaatcttctgcattggagcaaggtttcaaccgtaaagttttagcctcggtcaagaagattactaagaaatattctccagatctcttgctttatgtggataggctggattcacagacaagagatctaaatgatctacccatcttgaggacaatcactagctcgctcggttcttctatctggcggagtgccattctcactctaactcatgcagcatgtgctcctccagatggcccatccggtgccccattgggttacgacgtgtttgtgggacagcgtagtcatattattcaacagtctattggacaagctgttggtgatttgcgttttatgaatctaggtatgatgaatcctgtctcccttgttgagaatcaccctgcatgtcggaaaaacagagaaggagataaggttcttccgaatggtcaggcctggagaccgcagttattgttgctatgctactcgctcaaaatattggctgatgcaagcgtggcctctaagccacaagatcctgtagatcaccggaagctttttggtttccgtgtccgttcacctcctctcccatacttgttatcttcactgttgcagcctcgtacccaccctaaactttcagctgatcagggtggtgaaaatggtgattctgacattgacttggacgacttttccgattctgaccaggaagaagatgaatatgacgaactcccaccattcaagcctttacggaaaactcagcttgctaagcttagcggagagcagaggaaagcgtattttgatgaatatgactatcgagtgaagctgcttcagaagaagcaatggagagaggagctgaagagactgagggagataaagaagaatggaaaattagtttgaatgacc

SEQ ID NO: 18 - DNA, 429 bp, Amaranthus chlorostachys
gctgttgttcatgtagaagaagaaaatctggactctaatgtcgagtctgcggaaactgttgttggagataaggatagtgaggtggaatctgaagttcaagtaggggaggaggatacatctgtggttgaagagcctgcgttggatgcttctgtgtctgttgaaggtagtgaagtgaagttaactgatgagggggattctatcgtggattcaattcttgtcgatgctggtgaagctttacggtctggagctgccgttgttggggaagtagaggaaacaaaagacttagagagcaaagaaactacagacgttgaaaacaatgttattgaagattttgtttcaacattggagggtagtgttgcagaaaaacctgcagcagatgagtctgttaaaggtgttgaagttactggggagaagttaactgatgagggg

SEQ ID NO: 19 - DNA, 4122 bp, Amaranthus graecizans
tgaaaccctagtaaaatcaattgaggtaggtgaaattgatacccttgcatctgggtctgatgtagtttcaccagatattggggctccgaaggtaggtttgcccgtggcggagatttcagatgatggggatgatgatgaaattgaggatgttagtggagaggaggataatggtgaagttgagtctgaattgagtaggtcatttggtgttaataaggctcctagagttagggtttcgggtgatgatgaggaggagggagagagtgaggacgagatatttgaagaagcaaacgagaagatagtgggtgatccattagaggataagactgttggtggtgatgataaagtagatgttgagttggttaatgaggaggatgctgttgtagattccataaatgtggatgttgttgaagcagtaaggtcaggggttgctgttgttcaggtagaagaagaaaagctggactccaatgtcgagtctgtggaaactattgctggagataaggataatgaggtggaatctgaagttcaagtaggggaagaggatacatctgtggttgaagagcctgcgttagatgcgtctgcgtctgttgaaggtagtgaagtgaagttaactgatgagggggattctatcgtggattcaattcgtgtcgatgctggtgaagctttacggtctggagctgccattgttggggaagtagaggaaacaaaagacttagagagcaaagaaactacagatgttgaaaacaatgttattgaagattttgtttcaacattggaggatagtgttgcagaaaaacctgctgtagatgagtctgttgaaggtgctgaagttactggggagaagttaactgatgagaatgttgatgctgttgaagttgttgggtctggagctgctattgttggggaggtagaggaagcaaaagactcagagagtgcagcacctacagaggccgaaaataatgttattgaagaatttgtttcgacagtggaggattctgtagtagaagaacctgctgatgtggattctaaatccttgaaagaagatgaggtgaaggttctaggtgaagaggactctattgtagacgagattaatgttgatgttgttgaagccgtgagatctggtgtagctattgtgggggattctgaagcagcgaaaatggaaaaggaaacagaaccagagggcaaggacgtaggtgcacccgttcgtgcaaattcttcagagattgttgatgttgaagatctctcaaatctggctgaaactcctgtttcagcagagattgatgagaaactgctgaatacaggggaggtcaagttagaaaatgatgaatcaaagcagcatgagtctggtgatggtgtgaaatttgtttcccttggggaccaacagagggttcaggctgatcctgttaatgatactgcttctgataatatcgatcagcatgaagcaaaaccagtagaggggcttgacgatggagattctgatggtgacggtgaacctgtattctttaaggatgggttgtcttccagagcttttgtggaagagttggcatctggtgaacattcagagatgattgatggtcaggttgtcacagacactgaggaagaagctgattctgatgaggaaggagaaggtagacaattgattgattctgctgcattagctgctcttttgaaagctgcggctagtggtaactcggattcaagcactatcactataacatctcaagacggatctcgccttttctctgttgagcgacctgctggtcttggaacatcactccgatctttgagacctgcatcaaattcaagcaattccaacatgtttgctcagcccaatgttatttctgcatctgaggatagcttaagtgaagaagacaaaaagaagactgcataaaatacacgagttgagggtaaaattcctgaggcttattcaaagacttggtcagactgcagagcaatccgtagcagcacaagttctctataaactagcaatgttcgcaggtaggacagcgattccgtctttcagtctcgataatgcgaaacagactgcttcgctgcttgaggctgaaggtaatgaagatttagacttttccttgaacatcctggttcttgggaaaactggtgttggcaagagtgccaccatcaattcaatatttggtgaagagaaggtaaaaatcaatgcattcgaacctgaaaccacttctgttaatgtcgttaatggaattgtggatggggtcaaaatcagggtcattgacgcaccaggtctcaaatcttctgcattggagcaaggtttcaaccgtaaagttttagcctcggtcaagaagattactaagaaatattctccagatctcttgctttatgtggataggctggattcacagacaagagatctaaatgatctacccatcttgaggacaatcactagctcgctcggttcttctatctggcggagtgccattctcactctaactcatgcagcatgtgctcctccagatggcccatccggtgccccattgggttacgacgtgtttgtgggacagcgtagtcatattattcaacagtctattggacaagctgttggtgatttgcgttttatgaatctaggtatgatgaatcctgtctcccttgttgagaatcaccctgcatgtcggaaaaacagagaaggagataaggttcttccgaatggtcaggcctggagaccgcagttattgttgctatgctactcgctcaaaatattggctgatgcaagcgtggcctctaagccacaagatcctgtagatcaccggaagctttttggtttccgtgtccgttcacctcctctcccatacttgttatcttcactgttgcagcctcgtacccaccctaaactttcagctgatcagggtggtgaaaatggtgattctgacattgacttggacgacttttccgattctgaccaggaagaagatgaatatgacgaactcccaccattcaagcctttacggaaaactcagcttgctaagcttagcggagagcagaggaaagcgtattttgatgaatatgactatcgagtgaagctgcttcagaagaagcaatggagagaggagctgaagagactgagggagataaagaagaatggaaaaattagtttgaatgacccaagtgacatgccagaagattatgatgctgagaatggagcccctgctgctgtaccagtgcccttgcccgacatggtattgccaccgtcttttgacagcgacaccccagcttatcgttatcggttcttggagccaacgtcacagttcttggctcgtccagtgttggacacccatggttgggaccatgattgcgggtatgatggtgtcaatgtcgagcaaaatataggaatcgcaggacgcttcccagcagcagtaactgtgcaggtaaccaaagataagaaagacttcaacattcacttggattctgcagtctcagccaagcatggagaagatggttccagcttagtcgggtttgacgttcaaacaatcggtaaacagcttgcttatatcataaaaggcgaaaccaaattcaaaaacctgaagaagaacaagacagctggtggaatctcggttacatttctgggagagaatgtagccacaggagtgaaactcgaagatcagatagctttgggtaaaaggcttgttttagtcgggacgacaggtactgttcgttctcaaaaagatgctgcctacggagccaatttagaactacgtcttaatgacgcagatcatccaattggccaagaccaatcctcttttgtgctatcactcatgaaatggagaggagacttggcaattggagcaaacatgcagtcccagttttctgttgggcgcagttcaaagatggctgttcgtgtttccttgaataacaaacagagtgggcagattactgtgaagacaagcagttcggatcatctggctctttcttttgctggtctcattccaattgctctttccatttatcagaaattgaggcctattgccagtgagaattactctatatactaacgcccatttcgtttttgattcttccttttttccgtaatggtgtcaaaattgtgatgattacttttgtagtttcatgaattacttattatctcaagcataagtt

SEQ ID NO: 20 - DNA, 4018 bp, Amaranthus graecizans
tgaaaccctagtaaaatcaattgaggtaggtgaaattgatacccttgcatctgggtctgatgtagtttcaccagatattggggctccgaaggtaggtttgcccgtggcggagatttcagatgatggggatgatgatgaaattgaggatgttagtggagaggaggataatggtgaagttgagtctgaattgagtaggtcatttggtgttaataaggctcctagagttagggtttcgggtgatgatgaggaggagggagagagtgaggacgagatatttgaagaagcaaacgagaagatagtgggtgatccattagaggataagactgttggtggtgatgataaagtagatgttgagttggttaatgaggaggatgctgttgtagattccataaatgtggatgttgttgaagcagtaaggtcaggggttgctgttgttcaggtagaagaagaaaagctggactccaatgtcgagtctgtggaaactattgctggagataaggataatgaggtggaatctgaagttcaagtaggggaagaggatacatctgtggttgaagagcctgcgttagatgcgtctgcgtctgttgaaggtagtgaagtgaagttaactgatgagggggattctatcgtggattcaattcgtgtcgatgctggtgaagctttacggtctggagctgccattgttggggaagtagaggaaacaaaagacttagagagcaaagaaactacagatgttgaaaacaatgttattgaagattttgtttcaacattggaggatagtgttgcagaaaaacctgctgtagatgagtctgttgaaggtgctgaagttactggggagaagttaactgatgagaatgttgatgctgttgaagttgttgggtctggagctgctattgttggggaggtagaggaagcaaaagactcagagagtgcagcacctacagaggccgaaaataatgttattgaagaatttgtttcgacagtggaggattctgtagtagaagaacctgctgatgtggattctaaatccttgaaagaagatgaggtgaaggttctaggtgaagaggactctattgtagacgagattaatgttgatgttgttgaagccgtgagatctggtgtagctattgtgggggattctgaagcagcgaaaatggaaaaggaaacagaaccagagggcaaggacgtaggtgcacccgttcgtgcaaattcttcagagattgttgatgttgaagatctctcaaatctggctgaaactcctgtttcagcagagattgatgagaaactgctgaatacaggggaggtcaagttagaaaatgatgaatcaaagcagcatgagtctggtgatggtgtgaaatttgtttcccttggggaccaacagagggttcaggctgatcctgttaatgatactgcttctgataatatcgatcagcatgaagcaaaaccagtagaggggcttgacgatggagattctgatggtgacggtgaacctgtattctttaaggatgggttgtcttccagagcttttgtggaagagttggcatctggtgaacattcagagatgattgatggtcaggttgtcacagacactgaggaagaagctgattctgatgaggaaggagaaggtagacaattgattgattctgctgcattagctgctcttttgaaagctgcggctagtggtaactcggattcaagcactatcactataacatctcaagacggatctcgccttttctctgttgagcgacctgctggtcttggaacatcactccgatctttgagacctgcatcaaattcaagcaattccaacatgtttgctcagcccaatgttatttctgcatctgaggatagcttaagtgaagaagacaaaaagaagactgcataaaatacacgagttgagggtaaaattcctgaggcttattcaaagacttggtcagactgcagagcaatccgtagcagcacaagttctctataaactagcaatgttcgcaggtaggacagcgattccgtctttcagtctcgataatgcgaaacagactgcttcgctgcttgaggctgaaggtaatgaagatttagacttttccttgaacatcctggttcttgggaaaactggtgttggcaagagtgccaccatcaattcaatatttggtgaagagaaggtaaaaatcaatgcattcgaacctgaaaccacttctgttaatgtcgttaatggaattgtggatggggtcaaaatcagggtcattgacgcaccaggtctcaaatcttctgcattggagcaaggtttcaaccgtaaagttttagcctcggtcaagaagattactaagaaatattctccagatctcttgctttatgtggataggctggattcacagacaagagatctaaatgatctacccatcttgaggacaatcactagctcgctcggttcttctatctggcggagtgccattctcactctaactcatgcagcatgtgctcctccagatggcccatccggtgccccattgggttacgacgtgtttgtgggacagcgtagtcatattattcaacagtctattggacaagctgttggtgatttgcgttttatgaatctaggtatgatgaatcctgtctcccttgttgagaatcaccctgcatgtcggaaaaacagagaaggagataaggttcttccgaatggtcaggcctggagaccgcagttattgttgctatgctactcgctcaaaatattggctgatgcaagcgtggcctctaagccacaagatcctgtagatcaccggaagctttttggtttccgtgtccgttcacctcctctcccatacttgttatcttcactgttgcagcctcgtacccaccctaaactttcagctgatcagggtggtgaaaatggtgattctgacattgacttggacgacttttccgattctgaccaggaagaagatgaatatgacgaactcccaccattcaagcctttacggaaaactcagcttgctaagcttagcggagagcagaggaaagcgtattttgatgaatatgactatcgagtgaagctgcttcagaagaagcaatggagagaggagctgaagagactgagggagataaagaagaatggaaaaattagtttgaatgacccaagtgacatgccagaagattatgatgctgagaatggagcccctgctgctgtaccagtgcccttgcccgacatggtattgccaccgtcttttgacagcgacaccccagcttatcgttatcggttcttggagccaacgtcacagttcttggctcgtccagtgttggacacccatggttgggaccatgattgcgggtatgatggtgtcaatgtcgagcaaaatataggaatcgcaggacgcttcccagcagcagtaactgtgcaggtaaccaaagataagaaagacttcaacattcacttggattctgcagtctcagccaagcatggagaagatggttccagcttagtcgggtttgacgttcaaacaatcggtaaacagcttgcttatatcataaaaggcgaaaccaaattcaaaaacctgaagaagaacaagacagctggtggaatctcggttacatttctgggagagaatgtagccacaggagtgaaactcgaagatcagatatctttgggcaagaggctcgttttcgtagggtccacaggaaccgttcgttctcagaaagatgctgcatacggagccaatctggaactacgccttaaagatgccgatcatcccattaaccaagaccagtcctcttttgtactatcactcatgaaatggagaggagacttggcaatcggaggaaacgtgcagtcccagatatctgtcgggcgtaatgcaaagatggctgttcgtgttgcgttgaacaacaaacagagtgggcaaataaccgtgaagacgagcacttctgatcatttggctcttgcttatgctggtctagttcctattgctcttgccatttatcagaaattctggcctaatgctagtgagaattaccctatctacta

SEQ ID NO: 21 - DNA, 2265 bp, Amaranthus hybridus
ggtcagactgcagagcaatccgtagcagcacaagttctctataaactagcaatgttcgcaggtaggacagctattccttctttcagtctcgacaatgcgaaacagactgcttcgcagcttgaggctgaagggaacgaagatttagacttttccttgaacatcctggttcttgggaaaactggtgttggcaagagtgccaccattaattcaatatttggtgaagagaaggtaaaaatcaatgcattcgaacctgaaaccacttctgttaatgtcgttaatggaattgtgaatggggtcaaaatcagggtcattgacgcacctggtcttaaatcttctgcattggagcaaggtttcaaccgtaaagttttagcctcagtcaagaagattactaagaaatatcctacagatctcttactttatgtggataggctggattcacagacaagagatctgaatgatctacccatcttgaggacaatcactagctcgctcggttcttctatctggcggagcgccattctcactctaactcatgcagcatgtgctcctccagatggcccatctggtgccccattgggttacgacgtgtttgtgggacagcgtagtcatattattcaacagtctattggacaagctgttggtgatttgcgttttatgaatctaggtatgatgaatccggtctcccttgttgagaatcaccctgcatgtcggacgaacagagaaggagataaggttcttcctaatggtcaggcctggagaccgcagttattgttgctatgctactcgctcaaaatattggctgacgcaagcttggccacgaagccacaagaacctgtagatcaccggaaactttttggtttccgtgtccgttcacctcctctcccatacctgttatcttcactgttgcagcctcgtacccaccctaaactttcagctgatcagggtggtgaaaatggtgattctgacattgacttggatgacttttccgattctgaccaggaagaagatgagtatgacgagctcccaccattcaagcctttacggaaaactcagcttgctaagcttagcggagagcagaggaaagcgtattttgatgaatacgactatcgagtgaagctgcttcagaagaagcagtggagagaggagctgaagagactgaaggagataaagaagaatggaaaaattaacttgaatgacccaagtgacatgccagaagattatgatgctgagaatggagcccctgctgctgtaccagtgcccttgcccgacatggtattgccaccgtcttttgacagcgacactccagcttatcgttatcggttcttggagccaacgtcacaattcttggctcgtccagtgttggacacccatggttgggaccatgattgcgggtatgatggtgtcaatgtcgagcaaaatataggaatcgcaggacgcttcccagcagcagtaactgtgcaggtaaccaaagacaagaaagacttcaacattcacttggattctgcagtctcagccaagcatggtgaaaatggttctagcttagtcgggtttgacattcaaacaatcggtaaacagcttgcttatatcataaaaggcgaaaccaaattcaaaaacctgaagaagaacaagacagctggtggaatctcggttacatttcttggagagaatgtagccacaggagtgaaactcgaagatcagatatcattgggcaagaggctcgttttcgtaggatccacaggaaccgttcgttctcagaaagacgctgcttacggagccaatcttgaactacgccttaaagatgccgatcatcccattaaccaagaccagtcctcttttgtactatcactcatgaaatggagaggagacttggcaatcggaggaaacgtgcagtcccagatatctgtcgggcgtaatgcaaagatggctgttcgtgttgcgttgaacaacaaacagagtgggcagataaccgtgaagacgagcacttctgatcatttggctcttgcatatactggtctaattcctattgctcttgccatttatcagaaattctggcctaatgctagtgagaattactctatctactaaaactcttttcaattttggtttctgttatttatttcccatttgtgtttaaattgtgatgaagacaagactgttgttatttcattagttacttatttgcatcattttgaaataatggcttcgtcccattcataagccttaaattttgttgggtattttctataattgcgggttgtcaatgta

SEQ ID NO: 22 - DNA, 909 bp, Amaranthus hybridus
aagttaactgatgaaggggattctattgtggattcaatgcatgttgatgctggtgaagttgttaggtctggagctgctattgttggggaggtagaagaagcaaaagactcggagagtgcagcacctacagaggccgaaaacaatgttattgaagaatttgtttcgacagtggaggactctgtggtagaagaacctgctgatgtggactctagatccttaaaagaagatgaggtgaaggttcaaggtgaagaggactctattgtagacgagattaatgttgatgttgttgaagccgtgagatctggagtagctgttgtgggggattctggagctgcgaaaatggaaaaggaaacggaaccagagggcaaggacgtaggtgcacccattcatgctaattcttcagagattgttgatgttgaagatctctcaaatctggcagaaactcctgtttcagtagagattgatgagaaaccgacgagtacaggggaggtcaagttagaaaatgatgaatccaagcagcatgagtctggtgatggtgtgaactttgtttctcttggggaccaagagagggttcaggctgatcctgttaatgatactgctgctgataatatcgatcagcatgaagcaaaacaggtagaggggcatgacgatgaagagtctgatggtgacggtgaacctgtattctttaaggatggggtgtcttccagagcttttgtggaagagttggcatctggtgatcattcagagatgattgatggtcaggttgtcacagactctgacgaagaagctgattctgatgaggaaggagaaggtagacaattgattgattctgctgcattagctgctcttttgaaagctgcggctagtggtaactcggattcaaacactatcactataacatctcaagac

SEQ ID NO: 23 - DNA, 4350 bp, Amaranthus lividus
ccttcctcataattcaattcacccaaaacccttgcaaaaccctattatttacactccttccaccattgaaatagttgaatctatggagtctgagtctcaagtggatacgacgtcgcttcttgctaaacaaccatcaggtttagctgactcagatgatgaaactctagaaaaaccaattgaggtaggtgaaattgatacccttgcatctgggtctgatgtagtttcaccaggttttggggctccgaaggtaggtttgcctgtggcgaaggtttcggatgatggggatgatgatgaaattgaggatgttagtggagaggaggataatggtgaagttgagtctgaattgggtattaatacggctcctagagttagggtttcgagtgatgatgatgaggagggtgagagtgaggaggagatctttgaagaagcaaacgagaagatagagggtgatccattagaggataagacttttggtggtgatgataaagtagatgttgagttggttaatgaggaggatgctgttgtggattccattaatgtggatgttgttgaagcagtaaggtcaggggttgctgttgttcatgtagaagaagaaaatctggactctaatgtcgagtctgcggaaactgttgatggagataaggatagtgaggtggaatctgaagttcaagtaggggaggaggatacatctgtggttgaagagcctgcgttggatgcttctgcgtctgttgaaggtagtgaagtgaagttaactgatgagggggattctatcgtggattcaattcttgtcgatgctggtgaagctttacggtctggagctgccgttgttggggaagtagaggaaacaaaagacttagagagcaaagaaactacagacgttgaaaacaatgttattgaagattttgtttcaacattggagggtagtgttgcagaaaaacctgcagcagatgagtctgttaaaggtgttgaagttactggggagaagttaactgatgagggggattctatagttgatgccattaatgttgatgctgttgaagttgttgggtctggagctgctgttggggaggtagaggaagcaaaagactcagagagtatggcaactacagaggtcgaaaacaatgttattgaagaatttgtttcagcactggatagtactgttggagaaaacctgctttggatgagtctgcatctgttgaagatactgagttgaagttaactgatgaaggggattctattgtggattcaatgcatgttgatgctggtgaagtcgttaggtctggagctgctattgttggggaggtagaagaagcaaaagactcggagagtgcagcacctacagaggccgaaaacaatgttattgaagaatttgtttcgacagtggaggactctgtggtagaagaacctgctgatgtggactctagatccttaaaagaagatgaggtgaaggttcaaggtgaagaggactctattgtagacgagattaatgttgatgttgttgaagccgtgagatctggagtagctgttgtgggggattttgtagctgcgaaaatggaaaaggaaacggaaccagaggacaaggacgtaggtgcacccattcatgctaattcttcagagattgttgatgttgaagatctctcaaatctggcagaaactcctgtttcagtagagattgatgagaaaccgacgagtacaggagaggtcaagttagaaaatgatgaatccaagcagcatgagtctggtgatggtgtgaactttgtttctcttggggaccaagagagggttcaggctgatcctgttaatgatactgctgctgataatatcgatcagcatgaagcaaaacaggtagaggggcatgacgatgaagagtctgatggtgacggtgaacctgtattctttaaggatggggtgtcttccagagcctttgtggaagagttggcatctggtgatcattcagagatgattgatggtcaggttgtcacagactctgacgaagaagctgattctgatgaggaaggagaaggtagacaattgattgattctgctgcattagctgctcttttgaaagctgcggctagtggtaactcggattcaaacactatcactataacatctcaagacggatctcgccttttctctgttgagcgacctgctggtcttggaacatcactccgatctatgagacctgcatcaaatgccagcaattccaacatgtttgctcagccgaatgttatttctgcatctgaggatagcttaagtgaagaagagaaaaagaagctgcgtacaatacacgagctgagagtaaaattcctgaggcttattcaaagacttggtcagactgcagagcaatccgtagcagcacaagttctctataaactagcaatgttcgcaggtaggacagctattccttctttcagtcttgacaatgcgaaacagactgcttcgcagcttgaggctgaagggaacgaagatttagacttttccttgaacatcctggttcttgggaaaactggtgttggcaagagtgccaccattaattcaatatttggtgaagagaaggtaaaaatcaatgcattcgaacctgaaaccacttctgttaatgtcgttaatggaattgtgaatggggtcaaaatcagggtcattgacgcacctggtcttaaatcttctgcattggagcaaggtttcaaccgtaaagttttagcctcagtcaagaagattactaagaaatttcctacagatctcttactttatgtggataggctggattcacagacaagagatctgaatgatctacccatcttgaggacaatcactagctcgctcggttcttctatctggcggagcgccattctcactctaactcatgcagcatgtgctcctccagatggcccatctggtgccccattgggttacgacgtgtttgtgggacagcgtagtcatattattcaacagtctattggacaagctgttggtgatttgcgttttatgaatctaggtatgatgaatcccgtctcccttgttgagaatcaccctgcatgtcggacgaacagagaaggagataaggttcttcctaatggtcaggcctggagaccgcagttattgttgctatgctactcgctcaaaatattggctgacgcaagcttggccacgaagccacaagaacctgtagatcaccggaaactttttggtttccgtgtccgttcacctcctctcccatacctgttatcttcactgttgcagcctcgtacccaccctaaactttcagctgatcagggtggtgaaaatggtgattctgacattgacttggatgacttttccgattctgaccaggaagaagatgagtatgacgagctcccaccattcaagcctttacggaaaactcagcttgctaagcttagcggagagcagaggaaagcgtattttgatgaatacgactatcgagtgaagctgcttcagaagaagcagtggagagaggagctgaagagactgaaggagataaagaagaatggaaaaattaacttgaatgacccaagtgacatgccagaagattatgatgctgagaatggagcccctgctgctgtaccagtgcccttgcccgacatggtattgccaccgtcttttgacagcgacactccagcttatcgttatcggttcttggagccaacgtcacaattcttggctcgtccagtattggacacccatggttgggaccatgattgcgggtatgatggtgtcaatgtcgagcaaaatataggaatcgcaggacgcttcccagcagcagtaactgtgcaggtaaccaaagacaagaaagacttcaacattcacttggattctgcagtctcagccaagcatggtgaaaatggttctagcttagtcgggtttgacattcaaacaatcggtaaacagcttgcttatatcataaaaggcgaaaccaaattcaaaaacctgaagaagaacaagacagctggtggaatctcggttacatttctgggagagaatgtagccacaggagtgaaactcgaagatcagatatcattgggcaagaggctcgttttcgtaggatccacaggaaccgttcgttctcagaaagacgctgcttacggagccaatcttgaactacgccttaaagatgccgatcatcccattaaccaagaccagtcctcttttgtactatcactcatgaaatggagaggagacttggcaatcggaggaaacgtgcagtcccagatatctgtcgggcgtaatgcaaagatggctgttcgtgttgcgttgaacaacaaacagagtgggcagataaccgtgaagacaagcacgtccgatcatttggctcttgcttatactggtctaatt

SEQ ID NO: 24 - DNA, 1017 bp, Amaranthus palmeri
agccgactcagatgatgaaaccctagaaaaatcgattgaggtgggtgaaattgatacccttgtatctgggtctgatgtagtttcaccgggtattggggctccgaaggtaggtttgcctgtggcgaaggtttcgatgatggggatgatgatgaaattggggatgttagtggagaggaggataatggtgaagttgagtctgaattgggtattaatacggctcctagagttagggtttcgagtgatgatgatgaggggggagagagtgaggacgagatctttgaagaagcaaacgagaagatagaggttgatgcattagaggataagactgttggtggtgatgataaagtagatgttgagttggttaatgaggaggatgctgttgtggattccattaatgtggatgttgttgaagcagtaaggtcaggggttgctgttgttcatgtagaagaagaaaatctggactctaatgtcgagtctgcggaaactgttgttggagataaggatagtgaggtggaatctgaagttcaagtaggggaggaggatacatctgtggttgaagagcctgcgtggatgcttctgcgtctgttgaaggtagtgaagtgaagttaactgatgagggggattctattgtggattcaattcgtgtcgatgctggtgaagctttacggtctggagctgccgttgttggggaagtagaggaaacaaaagacttagagagcaaagaaactacagacgttgaaaacaatgttattgaagattttgtttcaacattggagggtagtgttgcagaaaaacctgatgcagatgagtctgttgaaggtgttggagttactggggagaagttaactgatgagggggattctatagttgatgccattaatgttgatgctgttgaagttgttgggtctggagctgctgttggggaggtagaggaagcaaaagactcagagagtatagcaactacagaggtcgaaaacaatgttattgaagaatttgtttcaacattggatagtactg

SEQ ID NO: 25 - DNA, 2663 bp, Amaranthus palmeri
gattgatggtcaggttgtcacagactctgacgaagaagctgattctgatgaggaaggagaaggtagacaattgattgattctgctgcattagctgctcttttgaaagctgcggctagtggtaactcggattcaaacactatcactataacatctcaagatggatctcgccttttctctgttgagcgacctgctggtcttggaacatcactccgatctatgagacctgcatcaaatgccagcaattccaacatgtttgctcagcccaatgttatttctgcatctgaggatagcttaagtgaagaagacaaaaagaagctgcgtacaatacacgagctgagagtaaaattcctgaggcttattcaaagacttggtcagactgcagagcaatccgtagcagcacaagttctctataaactagcaatgttcgcaggtaggacagctattccttctttcagtctcgacaatgcgaaacagactgcttcgcagcttgaggctgaaggaaacgaagatttagacttttccttgaacatcctggttcttgggaaaactggtgttggtaagagtgccaccattaattcaatatttggtgaagagaaggtaaaaatcaatgcattcgaacctgaaaccacttctgttaatgtcgttaatggaattgtgaatggggtcaaaatcagggtcattgacgctcccggtcttaaatcttctgtattggagcaaggtttcaaccataaagttttagcctcggtcaagaagattactaagaaatatcctacagatctcttactttatgtggataggctggattcacagacaagagatctgaatgatctacccatcttgaggacaatcactagctcactcggttcttctatctggcggagtgccattctcactctaactcatgcagcatgtgctcctccagatggcccatctggtgccccattgggttacgacgtgtttgtgggacagcgtagtcatattattcaacagtctattggacaagctgttggtgatttgcgttttatgaatctaggtatgatgaatcccgtctcccttgttgagaatcaccttgcatgtcggacaaacagagaaggagataaggttcttcctaatggtcaggcctggagaccgcagttattgttgctatgctactcgctcaaaatattggctgacgcaagcttggccacgaagccacaagaacctgtagatcaccggaagctttttggcttccgtgtccgttcacctcctctcccatacctgttatcttcactgttgcagcctcgtacccaccctaaactttcagctgatcagggtggtgaaaatggtgattctgacattgacttggatgacttttccgattctgaccaggaagaagatgagtatgacgagctcccaccattcaagcctttacggaaaactcagcttgctaagcttagcggagagcagaggaaagcgtattttgatgaatacgactatcgagtgaagctgcttcagaagaagcagtggagagaggagctgaagagactgaaggagataaagaagaatggaaaaattaacttgaatgacccaagtgacatgccagaagattatgatgctgagaatggagcccctgctgctgtaccagtgcccttgcccgacatggtattgccaccgtcttttgactgcgacactccagcttatcgttatcggttcttggagccaacgtcacaattcttggctcgtccagtgttggacacccatggttgggaccatgattgcgggtacgatggtgtcaatgttgagcaaaatataggaatcgcaggacgcttcccagcagcagtaactgtgcaggtaaccaaagacaagaaagacttcaacattcacttggattctgcagtctcagccaagcatggtgaaaatggttctagcttagtcgggtttgacattcaaacaatcggtaaacagcttgcttatatcttaaaaggcgaaaccaaattcaaaaaccttaagaagaacaagacagctggtggaatctcggttacattcctaggagagaatgtagccacaggagtgaaactcgaagatcagatatctctgggtaagaggctcgttttcgtagggtccacaggaaccgttcgttctcagaaagacgctgcatacggagctaatttagaactacgtcttaaagatgccgatcatcccattagccaagaccagtcctctttcgtactatcactcatgaaatggagaggagacttggcaatcggaggaaacgtgcagtcccagatatctgtcgggcgtaatgcaaagatggctgttcgtgctgcgttgaacaacaaacagagtgggcagataaccgtgaagacgagcacttctgatcatttggctcttgcttatactgttctaattcctattgctcttgccatttatcagaaattctggcctactgctattagtgagaattactctatctactaaaactctatttcaattttggtttctgttatttatttcccatttatgtttaaattgtgatgaagactctttttatttcattagttaaatttgcatcattttgaaataatggctttctcccattgataagccttaaattttgttgggtattttctatcattgcgggttctcaatgtattcactattcaatgagtatggaaatagactt

SEQ ID NO: 26 - DNA, 661 bp, Amaranthus palmeri
aggtagaagaagcaaaagactcggagagtgcagcacctacagaggccgaaaacaatgttattgaagaatttgtttcgacagtggaggactctgtggtagaagaacctgctgatgtggactctagatccttaaaagaagatgaggtaaaggttcaaggtgaagaggactctattgtagatgagattaatgttgatgttgttgaagccgtgagatctggagtagctgttgtgggggattctggagcagcgaaaatggaaaaggaaacggaaccagagggcaaggacgtaagtgcacccattcgtgctaattcttcagagattgttgatgttgaagatctctcaaatctggcagaaactcctgcttcagtagagattgatgagaaactgacgagtacaggggaggtcaagttagaaaatgatgaatccaagcagcatgagtctgatgatggtgtgaactttgtttctcttggggaccaagagagggttcaggctgatcctgttaatgatactgctgctgataatatcgatcagcatgaagcaaaacaggtagaggggcatgacgatgaagagtctgatggtgacggtgaacctgtattctttaaggatggggtgtcttccagagcttttgtggaagagttggcatctggtgatcattcagagat

SEQ ID NO: 27 - DNA, 217 bp, Amaranthus palmeri
caattttggtttctgttatttatttcccatttatgtttaaattgtgatgaagactcttgttatttcattagttaaatttgcatcattttgaaataatggctttctcccattgataagccttaaattttgttgggtattttctataattgcgggttctcaatgtattcactattcaatgagtatggaaatagacttttgtttctcattgggatactat

SEQ ID NO: 28 - DNA, 5572 bp, Amaranthus palmeri
ctaaatatatattgctacaactctaaatatacatttgggttggacttagaggtgttcaaaacagacccgatgacccgatagacacccgactatataagcgaacccgatttgacccgacttaaaaagggatctccaattacgtaaaaaccaatgtgaacacaaaacctgattttgaaccaacccgaaacacttgactcgaaattagaggtgttcaaaacagactcgatgacccgatagacacccgactttataacccaacccgatttgacccgatttaaaaatggatctacaattaagtaaaaccaatgtgaacacaaaacctgattttgaaccaacccaaaacacttgatccgaaattaaaggtgttcaaaacagacccgatgacccgatagacacccaactttataaccgaacccgatttgacccgatttaaaaatggatctacaattaagtaaaaaccaatgtgaacacaaaacccgaatttgaatcgacccgaaacacctgaccctgaatctaaccgatgacccgagtgaacacctctacccgaaatcaacccgatgacccgaatgagcacctctagctgcacttttaaaaatcatctttacaaaaaacggtctctcaagaaagcagctgattcgttttttgttacctcttatacttcctatttttgtatttttgctcattggaaaaactaaatatcccgatatgctatatatatagattatgcacaagatggaaggcccaaagtttctttcgagagcttcttaatcctctcaccttatctctgtttcgttctacctgtttccccttatcacttttttctaccttcctcgtaattcaatccacccaaaacccttgaaaaaccctattatttacactccttccaccattgaaatagttgaatctatggagtacgagtctcaagtggatacgacgtcggttttagctaaacaaccatcaggtattcgtgctttaccttctcatgatgatgacgatgatgatgattttgatactgattatgtttttgaaacgaataattcccgtgaaaaattgattgaaaacgatgaaaatgaaatgaattttgctaatagtagtattaatgaaagtagtgatagtagtattagtagtacttttgctagtaataatggaagttttgctaatggtgaggatgaatttgagacaggtttagccgactcagatgatgaaatcctagaaaaatcgattgaggtgggtgaaattgatacccttgtatctgggtctgatgtagtttcaccgggtattggggctccgaaggtaggtttgcctgtggcgaaggtttcggatgatggggatgatgatgaaattggggattttagtggagaggaggataatggtgaagttgagtctgaattgggtattaatacggctcctagagttagggtttcgagtgatgatgatgaggggggagagagtgaggaagaaatctttgaagaagcaaacgagaagatagaggttgatccattagaggataagactgttggtggtgatgataaagtagatgttgagttggttaatgaggaggatgctgttgtggattccattaatgtggatgttgttgaagcagtaaggtcaggggttgctgttgttcatgtagaagaagaaaatctggactctaatgtcgagtctgcggaaactgttgttggagataaggatagtgaggtggaatctgaagttcaagtaggggaggaggatacatctgtggttgaagagcctgcgttggatgcttctgcgtctgttgaaggtagtgaagtgaagttaactgatgagggggattctattgtggattcaattcgtgtcgatgctggtgaagctttacggtcaggagctgccgttgttggggaagtagaggaaacaaaagacttagagagcaaagaaactacagatgttgaaaacaatgttattgaagaatttgtttcaacattggagggtagtattacagaaaaacctgctgccgatgagtctgttgaaggtgttgaagttactggggagaagttaactgatgagggggattctatagttgatgccattaatgttgatgctgttgaagttgttgggtctggagctgctgttggggaggtagaggaagcaaaagactcagagagtatagcaactacagaggtcgaaaacaatgttattgaagaatttgtttcaacactggatagtactgttggagaagaacctgctttggatgagtctgcatctgttgaagatactgaggtagaagaagcaaaagactcggagagtgcagcacctacagaggccgaaaacaatgttattgaagaatttgtttcgacagtggaggactctgtggtagaagaacctgctcatgtggaatctagatccttaaaagaagatgaggtaaaggttcaaggtgaagaggactctattgtagatgagattaatgttgatgttgttgaagccgtgagatctggagtagctgttgtgggggattctggagcagcgaaaatggaaaaggaaacggaaccagagggcaaggacgtaagtgcacccattcgtgctaattcttcagaggtcagtaactcaatattattaatgtgttatcgtgcaaattcgttgtcaacttgccttgagtgcattgaatctgctgcatcattttctttattcttttgcagattgttgatgttgaagatctctcaaatctggcagaaactcctgcttcagtagagattgatgagaaactgacgagtacaggggaggtcaagttagaaaatgatgaatccaagcagcatgagtctgatgatggtgtgaactttgtttctcttggggaccaagagagggttcaggctgatcctgttaatgatactgctgctgataatatcgatcagcatgaagcaaaacaggtagaggggcatgacgatgaagagtctgatggtgacggtgaacctgtattctttaaggatggggtgtcttccagagcttttgtggaagagttggcatctggtgatcattcagagatgattgatggtcaggttgtcacagactctgacgaagaagctgattctgatgaggaaggagaaggtagacaattgattgattctgctgcattagctgctcttttgaaagctgcggctagtggtaactcggattcaaacactatcactataacatctcaagacggatctcgccttttctctgttgagcgacctgctggtcttggaacatcactccgatctatgagacctgcatcaaatgccagcaattccaacatgtttgctcagcccaatgttatttctgcatctgaggatagcttaagtgaagaagacaaaaagaagctgcgtacaatacacgagctgagagtaaaattcctgaggcttattcaaagacttggtcagactgcagagcaatccgtagcagcacaagttctctataaactagcaatgttcgcaggtaggacagctattccttctttcagtctcgacaatgcgaaacagactgcttcgcagcttgaggctgaagggaacgaagatttagacttttccttgaacatcctggttcttgggaaaactggtgttggcaagagtgccaccattaattcaatatttggtgaagagaaggtaaaaatcaatgcattcgaacctgaaaccacttctgttaatgtcgttaatggaattgtgaatggggtcaaaatcagggtcattgacgctcccggtcttaaatcttctgcattggagcaaggtttcaaccgtaaagttttagcctcggtcaagaagattactaagaaatatcctacagatctcttactttatgtggataggctggattcacagacaagagatctgaatgatctacccatcttgaggacaatcactagctcactcggttcttctatctggcggagtgccattctcactctaactcatgcagcatgtgctcctccagatggcccatctggtgccccattgggttacgacgtgtttgtgggacagcgtagtcatattattcaacagtctattggacaagctgttggtgatttgcgttttatgaatctaggtatgatgaatcccgtctcccttgttgagaatcaccctgcatgtcggacaaacagagaaggagataaggttcttcctaatggtcaggcctggagaccgcagttattgttgctatgctactcgctcaaaatattggctgacgcaagcttggccacgaagccacaagaacctgtagatcaccggaagctttttggtttccgtgtccgttcacctcctctcccatacctgttatcttcactgttgcagcctcgtacccaccctaaactttcagctgatcagggtggtgaaaatggtgattctgacattgacttggatgacttttccgattctgaccaggaagaagatgagtatgacgagctcccaccattcaagcctttacggaaaactcagcttgctaagcttagcggagagcagaggaaagcgtattttgatgaatacgactatcgagtgaagctgcttcagaagaagcagtggagagaggagctgaagagactgaaggagataaagaagaatggaaaaattaacttgaatgacccaagtgacatgccagaagattatgatgctgagaatggagcccctgctgctgtaccagtgcccttgcccgacatggtattgccaccgtcttttgactgcgacactccagcttatcgttatcggttcttggagccaacgtcacaattcttggctcgtccagtgttggacacccatggttgggaccatgattgcgggtacgatggtgtcaatgttgagcaaaatataggaatcgcaggacgcttcccagcagcagtaactgtgcaggtaaccaaagacaagaaagacttcaacattcacttggattctgcagtctcagccaagcatggtgaaaatggttctagcttagtcgggtttgacattcaaacaatcggtaaacagcttgcttatatcttaaaaggcgaaaccaaattcaaaaaccttaagaagaacaagacagctggtggaatctcggttacattcctaggagagaatgtagccacaggagtgaaactcgaagatcagatatctctgggtaagaggctcgttttcgtagggtccacaggaaccgttcgttctcagaaagacgctgcatacggagctaatctggaactacgccttaaagatgccgatcatcccattagccaagaccagtcctctttcgtactatcactcatgaaatggagaggagacttggcaatcggaggaaacgtgcagtcccagatatctgtcgggcgtaatgcaaagatggctgttcgtgctgcgttgaacaacaaacagagtgggcagataaccgtgaagacgagcacttctgatcatttgggtcttgcttatactgttctaattcctattgctcttgccatttatcagaaattctggcctactgctattagtgagaattactctatctactaaaactctatttcaattttggtttctgttatttatttcccatttatgtttaaattgtgatgaagactcttgttatttcattagttaaatttgcatcattt

SEQ ID NO: 29 - DNA, 3824 bp, Amaranthus rudis
caatggagggtagtgttgcagaaaaacctgctgtagatgagtctgttgaaggtgttgaagttactggggagaagttaattgatgagggggattctatcgtggattcaaatcgtgttaatgctgatgaagctttacggtctggagctgccattgttggggaagaagaggaaacaaaagacttagagagcaaagaaaatacagacgttgaaaacaatgttattgaagattttgtttcaacattggagggtagtgttgcagaaaaacctgctgtagatgagtctgttgaaggtactggggagaagctaactgatgagggagattctatagtggatgccattaatgttgatgctgttgaagttgttgggtctggagctgctgttggggaggtagaagaagcaaaagactcagagagtatggcaactacagaggtcgaaaacaatgttattgaagaatttgtttcaacattggatagtactgttggagaaaaacctgctttggatgagtctgcatctgttgaagatactgaggtgaagttaactgatgagggggattctattgtggattcgattcatgttgatgcgggtgaagttgttagatctggagctgctattgttggggaggtagaagaagcaaaagacttggagagtgcagcacctacagaggccgaaaacaatgttattgaagaatttgtttcgacaatggaggattctgtggtagacgaacctgctgatgtggactctagatccttaaaagaagatgaggtgaaggttcaaggtgaagaggactcgattgtagacgagattaatgttgatgttgttgaagccgtgagatctggagtagctgttgtgggggattctggagcagcgaaaatggaaaaggaaacggaaccagagggcaaggacgtaggtgcacccattcgcgctaattcttcagagattgttgatgttgaagatctctcaaatctggcagaaactcctgtttcagtagagattgatgagaacctgacgagtacaggagaggtcaagttagaaaatgatgaatccaagcagcatgagtctggtgatggtgtgaactttgtttctcttggggaccaagagagggttcaggctgatcctgttaatgatacggcttctgataatatcgatcagcatgaagcaaaaccagtagaggggcatgatgatgaagagtctgatgatgacggtgaacctgtattctttaaggatggggtgtcttccagagcttttgtggaagagttggcatctggtggtcattcagagatgattgatggtcaggttgtcacagactctgaggaagaagctgattctgatgaggaaggagaaggtagacaattgattgattctgctgcattagctgctcttttgaaagctgcggctagtggtaactcggattcaaacactatcactataacatctcaagacggatctcgccttttctctgttgagcgacctgctggtcttggaacatcactccgatctttgagacccgcatcaaatgcaagcaatcccaacatgtttgctcagcccaatgttatttctgcatctgaggatagcttaagtgaagaagacaaaaagaagctgcgtacaatacacgagttgagagtaaaattcctgaggcttattcaaagacttggtcagactgcagagcaatccgtagcagcacaagtcctctataaactagcaatgttcgctggtaggacagcggttccgtctttcagtctcgataatgcaaaacagactgcttcgcagcttgaggctgaagggaatgaagatttagacttttccttgaacatcctggttcttgggaaaactggtgttggcaagagtgccaccatcaactcaatatttggtgaagagaaggtaaaaatcaatgcattcgaacctgaaaccacgtctgttaatgtcgttaatggaattgtggatggggtcaaaatcagggtcattgacgcacctggtcttaaatcttctgcattggagcaaggtttcaaccgtaaagttttagcctcggtcaagaagattactaagaaatatcctacagatctcttactttatgtggataggctggattcacagacaagagatctgaatgatctacccatcttgaggacaatcactagctcgcttggttcttcaatctggcggagtgccattctcactctaactcacgcagcatgtgctcctcctgatggcccatccggtgccccattaggttacgacgtgtttgtgggacagcgtagtcatattattcaacagtctattggacaagctgttggtgatttgcgttttatgaatctaggtatgatgaatcccgtctcccttgttgagaatcaccctgcatgtcggacgaacagagaaggagataaggttcttcctaatggtcaggcctggagaccgcagttattgttgctatgctactcgctcaaaatattggctgacgcaagcttggccacgaagccacaagaacctgtagatcaccggaagctttttggtttccgtgtccgttcacctcctctcccatacctgttatcttcactgttgcagcctcgtacccaccctaaactttcagctgatcagggtggtgaaaatggtgattctgacattgacttggacgacttttccgattctgaccaggaagaagatgagtatgatgagctcccaccattcaagcctttacggaaaacccagcttgctaagcttagcggagagcagaggaaagcgtattttgatgaatacgactatcgagtgaagctgcttcagaagaagcagtggagagaggagctgaagagactcagggagataaagaagaatggaaaaattaacttgaatgacccaaatgacatgccagaagattatgatgctgagaatggagcccctgctgctgtaccagtgcccttgcccgacatggtattgccaccgtcttttgacagcgacactccagcttatcgttatcggttcttggagccaacgtcccagttcttggctcgtccagtgctggacacccacggttgggaccatgattgcgggtatgatggtgtaaatgtcgagcaaaatataggaatcgcaggacgcttcccagcagcagtaactgtgcaggtaaccaaagacaagaaagacttcaacatccacttggattctgcagtctcagccaagcatggagaaaatggttccagcttagtcggatttgatattcaaacaatcggtaaacagcttgcttatatcataaaaggcgaaaccaaattcaaaaacctgaagaagaacaagacagctggtggaatctcggttacatttctgggagagaatgtagccacaggagtaaaactcgaagatcagatatctttgggtaagaggctcgttttcgtagggtctacaggaaccgttcgttctcagaaagacgctgcatacggagctaatctggaactacgccttaaagatgccgatcatcccattaaccaagatcagtcctcttttgtactatcactcatgaaatggagaggagacttggcaatcggaggaaacgtgcagtcccagatatctgttgggcgtaatgcaaagatggctgttcgtgttgcgttaaacaacaaacagagcgggcagataaccgtgaagacgagcacttctgatcatttggctcttgcttatgctggtctagttcctattgctcttgccatttatcagaaattctggcctagtgctagtgagaattactctatctactaaaactttatttcaattttggtttctgttatttattttccatttatgttcaaattgtgatgaagactcttgttgttttcattagttacttat

SEQ ID NO: 30 - DNA, 713 bp, Amaranthus rudis
gttgagttggttaatgaggaggatgctgttgtggattccattaatgtggatgttgttgaagcagtaaggtcaggagttgctgttgttcatatagaagaagaaaagctggactctaatgtcgagtctgcggaaactgttgttggagataaggatagtgaggtggaatctgaaggtcaagtaggggacgaggatacatctgtggttgaagagcctgcgttgaatgcgtctgcgtctgttgaaggtagtgaagtgaagttaactgatgagggggattctatcgtggattcaattcgtgtcgatgctggtgaagctttacggtctggagctgccgttgttgaggaagtagaggaaacaaaagacttagagagcaaagaaactacagacgttgaaaacaatgttattgaagattttgtttcaacaatggagagtagtgttgaagaaaaacctgctgtagatgagtctgttgaaggtgttgaagttactggggagaagttaattaatgagggggattctattgtggattcaattcgtatcgatgctgatgaagctttacggtctggagctgcccttgttggggaagaagaggaaacaaaagacttagagagcaaagaaactacagacgttgaaaacaatgttattgaagattttgtttcaacattggagggtagtgttgcagaaaaacctgctatagatgagtctgttgaaggtgttga

SEQ ID NO: 31 - DNA, 1948 bp, Amaranthus rudis
catgtagaagaagaaaagctggactgtaatgtcgagtctgcggaaactgttgttggagataaggatagtgaggtggaatctgaagttctagtaggggaggaggatacatctgtggttgaaaagcctgcgttggatgcgtctgcgtctgttgaaggtagtgaagtgaagttaactgatgagggggattctatcgtggattcaattcgtatcgatgctggtgaagctttacggtctggagctgccattgttggggaagtagaggaaacaaaagacttagagagcaaagaaactacagatgttgaaaacaatgttattgaagattttgtttcaacattggaggatagtgttgcagaaaaacctgctgtagatgagtctgttgaaggtgttgaagttactggcgagaagttaactgatgagggggattctatagtggattcaattaatgttgatgctgttgaagttgttgggtctggagctgctgttggggaggtagaagaagcaaaagactcagagagtatggcaactacagaggtcgaaaacaatgttattgaagaatttgtttcaacattggatagtactgttggagaaaaacctgctttggatgagtctgcatctgttgaagatactgaggtgaagttaactgatgagggggattctattgtggattcgattcatgttgatgcgggtgaagttgttaggtctggagctgctattgttggggaggtagaagatgcaaaagacccggagagtgcagcacctacagaggccgaaaacaatgttattgaagaatttgtttcgacaatggaggattctgtggtagacgaacctgctgatgtggactctagatccttaaaagaagatgaggtgaaggttcaaggtgaagaggactcgattgtagacgagattaatgttgatgttgttgaagccgtgagatctggagtagctgttgtgggggattctggagcagcgaaaatggaaaaggaaacggaaccagagggcaaggacgtaggtgcacccattcgcgctaattcttcagaggtcagtaactcagtattgttaatttgttatcgtgtcaaattcgttgccaacttgccatgagtgcattgaatctgctgcatcattttctttattcttttgcagattgttgatgttgaagatctctcaaatctggcagaaactcctgtttcagtagagattgatgagaacctgacgagtacaggggaggtcaagttagaaaatgatgaatccaagcagcatgagtctggtgatggtgtgaactttgtttctcttggggaccaagagagggttcaggctgatcctgttaatgatacggcttctgataatatcgatcagcatgaagcaaaaccagtagaggggcatgacgatgaagagtctgatgatgacggtgaacctgtattctttaaggatggggtgtcttccagagcttttgtggaagagttggcatctggtggtcattcagagatgattgatggtcaggttgtcacagactctgaggaagaagctgattctgatgaggaaggagaaggtagacaattgattgattctgctgcgttagctgctcttttgaaagctgcggctagtggtaactcggattcaaacactatcactataacatctcaagacggatctcgccttttctctgttgagcgacctgctggtcttggaacatcactccgatctttgagacccgcatcaaatgcaagcaatcccaacatgtttgctcagcccaatgttatttctgcatctgaggatagcttaagtgaagaagacaaaaagaagctgcgtacaatacacgagttgagagtaaaattcctgaggcttattcaaagacttggtcagactgcagagcaatccgtagcagcacaagttctctataaactagcaatgttcgcaggtaggacagcgattccgtctttcagtctcgata

SEQ ID NO: 32 - DNA, 3085 bp, Amaranthus rudis
  unsure (1)..(3085): unsure at all n locations
  unsure (1)..(3085): unsure at all n locations
gcagcatgtgctcctcgatggcccatccggtgccccattgggttacgacgtgtttgtgggacagcgtagtcatattattcaacagtctattggacaagctgttggtgatttgcgttttatgaatctaggtatgatgaatcccgtctcccttgttgagaatcaccctgcatgtcggacgaacagagaaggagataaggttcttcctaatggtcaggcctggagaccgcagttattgttgctatgctactcgctcaaaatattggctgacgcaagcttggccacgaagccacaagaacctgtagatcaccggaagctttttggtttccgtgtccgttcacctcctctcccatacctgttatcttcactgttgcagcctcgtacccaccctaaactttcagctgatcagggtggtgaaaatggtgattctgacattgacttggacgacttttccgattctgaccaggaagaagatgagtatgatgagctcccaccattcaagcctttacggaaaactcagcttgctaagcttagcggagagcagaaaaaagcgtattttgatgaatacgactatcgagtgaagctgcttcagaaaaagcagtggagagaggagctgaagagactgagggagataaagaagaatggaaaaattaacttgaatgacccaagtgacatgccagaagattatgatgctgagaatggagcccctgctgctgtaccagtgcccttgcccgacatggtattgccaccgtcttttgacagtgacactccagcttatcgttatcggttcttggagccaacgtcacaattcttggctcgtccagtgttggacacccatggttgggaccatgattgcgggtatgatggtgtcaatgtcgagcaaaatataggaattgcaggacgcttcccagcagcagtaactgtgcaggtaaccaaagacaagaaagacttcaacatccacttggattctgcagtctcagccaagcatggagaaaatggttctagcttagtcggatttgatattcaaacaatcggtaaacagcttgcttatatcattaaaggcgaaaccaaattcaaaaacctgaagaagaacaagacagctggtggaatctcggttacatttctgggagagaatgtagccacaggagtaaaactcgaagatcagatatctttgggtaagaggctcgttttcgtagggtctacaggaaccgttcgttctcagaaagacgctgcatacggagctaatttggaactacgccttaaagatgccgatcatcccattaaccaagaccagtcctctttcgtactatcactcatgaaatggagaggagacttggcaatcggaggaaacgtgcagtcccagatatctgtcgggcgtaacgcaaagatggctgttcgtgttgcgttgaacaacaaacagaatgggcagataaccgtgaagacgagcacatctgatcatttggctcttgcttatgctggtctaattcctattgctcttgccatttatcagaaattctggcctaatgctagtgagaattactctatctactaaaactctatttcaattttggtttctgttatttattttccatttatgttcaaattgtgatgaagactcttgttgtttcattagttacttatttgtatcattttgaaataatggctttgtctcattgataggccttaaattttgttgggtattttctataattgcgggttgttaatgtattcactattcaatgagcattgaaatagacttttgtttatcatcaattatattcttatttcattgtaaatagtacattgagctttgattatatgattgtatcatcatcatcatcatnnnnnnnnnnnnnnnnncatagacaagctatggtcaggatctggggaggnaagatagacgacaactcatacctattaggagagtgcggtctgaggattatatgattggtacaaatttcttctatgatttagtcattaatggaaatactcttttgtgcctctaaattgaagtgatgatttttgtgtactagtagcaaaattaaagggataaaacgagttgatgcttggcgcttgcttattctttataacgtaagcaaaatcctgataaaattgataagtacaattgtgaaggctgtttgctattgaacttgcatactgtttgagaaatggttgttagttggtttgactagttgatttgttagctatttgataagcgtttaggcaagtggttgtttattctttataaagatacctaaattcggataaagttgataagtacaatagtgaaggttgtttgatattgaatctacagactgtttaagaaatagttgatagttggttttgactagttgagttgttagttgttagactagcgttcagataaatcattatagagatatttgataaaaattagttgttggctcttgacagttgattagaaaaataaagtagttaaaacgcctaagcgaataacaagactactcatagtataatgattttttagttttggtgctaaagccgactttatttacaaaatactccacttttttaattgtttgatcagctaaaaatcaaaaatctaataaaattcatttttcaaacatcgtctatgggcgttaaaaacattcttctaatttgtacttgcattaattaccaagaattttgtggtccaagaattttcttctaaatctaatttatgaatttatgatattattattagtgaggcccatgacaaattgattagatcaactatagattcattctaatgcttttatgtacgagagtcttttactccattttattaaatttgtcttatttttatttttggttataattcacaattcacattcctctcatttacccgcaaaataatactttactcactcttcttaaatttctcaccaattgtcaattttcattagatagaaggagtaaattgcttgttagtcgaatatcggattaatttcaaatcgaattaaaatttgatagctttaggatcagaaatacatttacttcatttacttattgtgtgtttaaataaattagatggctaagcctaaaataaaatcaacttatatttgaatca

SEQ ID NO: 33 - DNA, 731 bp, Amaranthus spinosus
tgttgaagttgttgggtctggagctgctgttggggaggtagaggaagcaaaagactcagagagtatagcaactacagaggtcgaaaacaatgttattgaagaatttgtttcaacactggatagtactgttggagaagaacctgctttggatgagtctgcatctgttgaagatactgaggtagaagaagcaaaagactcggagagtgcagcacctacagaggccgaaaacaatgttattgaagaatttgtttcgacagtggaggactctgtggtagaagaacctgctgatgtggactctagatccttaaaagaagatgaggtaaaggttcaaggtgaagaggactctattgtggatgagattaatgttgatgttgttgaagccgtgagatctggagtagctgttgtgggggattctggagcagcgaaaatggaaaaggaaacggaaccagagggcaaggacataggtgcacccattcgtgctaattcttcagagattgttgatgttgaagatctctcaaatctggcagaaactcctgcttcagtagagattgatgagaaactgacgagtacaggggaggtcaagttagaaaatgatgaatccaagcagcatgagtctgatgatggtgtgaactttgtttctcttggggaccaagagagggttcaggctgatcctgttaatgatactgctgctgataatatcgatcagcatgaagcaaaacaggtggaggggc

SEQ ID NO: 34 - DNA, 2641 bp, Amaranthus spinosus
gatggtgacggtgaacctgtattctttaaggatggggtgtcttccagagcttttgtggaagagttggcatctggtgatcattcagagatgattgatggtcaggttgtcacagactctgacgaagaagctgattctgatgaggaaggagaaggtagacaattgattgattctgctgcattagctgctcttttgaaagctgcggctagtggtaactcggattcaaacactatcactataacatctcaagacggatctcgccttttctctgttgagcgacctgctggtctaggaacatcactccgatctatgagacctgcatcaaatgccagcaattccaacatgtttgctcagcccaatgttatttctgcatctgaggatagcttaagtgaagaagacaaaaagaagctgcgtacaatacacgagctgagagtaaaattcctgaggcttattcaaagacttggtcagacttcagagcaatccgtagcagcacaagttctctataaactagcaatgttcgcaggtaggacagctattccttctttcagtctcgacaatgcgaaacagactgcttcgcagcttgaggctgaagggaacgaagatttagacttttccttgaacatcctggttcttgggaaaactggtgttggcaagagtgccaccattaattcaatatttggtgaagagaaggtaaaaatcaatgcattcgaacctgaaaccacttctgttaatgtcgttaatggaattgtgaatggggtcaaaatcagggtcattgacgctcccggtcttaaatcttctgcattggagcaaggtttcaaccgtaaagttttagcctcggtcaagaagattactaagaaatatcctacagatctcttactttatgtggataggctggattcacagacaagagatctgaatgatctacccatcttgaggacaatcactagctcactcggttcttctatctggcggagtgccattctcactctaactcatgcagcatgtgctcctccagatggcccatctggtgccccattgggttacgacgtgtttgtgggacagcgtagtcatattattcaacagtctattggacaagctgttggtgatttgcgatttatgaatctaggtatgatgaatcccgtctcccttgttgagaatcaccctgcatgtcggacaaacagagaaggagataaggttcttcctaatggtcaggcctggagaccgcagttattgttgctatgctactcgctcaaaatattggctgacgcaagcttggccacgaagccacaagaacctgtagatcaccggaagctttttggtttccgtgtccgttcacctcctctcccatacctgttatcttcactgttgcagcctcgtacccaccccaaactttcagctgatcagggtggtgaaaatggtgattctgacattgacttggatgacttttccgattctgaccaggaagaagatgagtatgacgagctcccaccattcaagcctttacggaaaactcagattgctaagcttagcggagagcagaggaaagcgtattttgatgaatacgactatcgagtgaagctgcttcagaagaagcagtggagagaggagctgaagagactgaaggagataaagaagaatggaaaaattaacttgaatgacccaagtgacatgccagaagattatgatgctgagaatggagcccctgctgctgtaccagtgcccttgcccgacatggtattgccaccgtcttttgactgcgacactccagcttatcgttatcggttcttggagccaacgtcacaattcttggctcgtccagtgttggacacccatggttgggaccatgattgcgggtacgatggtgtcaatgttgagcaaaatataggaatcgcaggacgcttcccagcagcagtaactgtgcaggtaaccaaagacaagaaagacttcaacattcacttggattctgcagtctcagccaagcatggtgaaaatggttctagcttagtcgggtttgacattcaaacaatcggtaaacagcttgcttatatcttaaaaggcgaaaccaaattcaaaaccttaagaagaacaagacagctggtggaatctcggttacattcctaggagagaatgtagccacaggagtgaaactcgaagatcagatatctctgggtaagaggctcgttttcgtagggtccacaggaaccgttcgttctcagaaagacgctgcatacggagctaatctggaactacgccttaaagatgccgatcatcccattagccaagaccagtcctctttcgtactatcactcatgaaatggagaggagacttggcaatcggaggaaacgtgcagtcccagatatctgtcgggcgtaatgcaaagatggctgttcgtgctgcattgaacaacaaacagagtgggcagataaccgtgaagacgagcacttctgatcatttggctcttgcttatactgttctaattcctattgctcttgccatttatcagaaattctggcctactgctattagtgagaattactctatctactaaaactctatttcaattttggtttctgttatttatttcccatttatgtttaaattgtgatgaagactcttgttatttcattagttaaatttgcatca

SEQ ID NO: 35 - DNA, 626 bp, Amaranthus thunbergii
tggtattgccaccgtcttttgacagcgacactccagcttatcgttatcggttcttggagccaacgtcacaattcttggctcgtccagtgttggacacccatggttgggaccatgattgcgggtatgatggtgtcaatgtcgagcaaaatataggaatcgcaggacgcttcccagcagcagtaactgtgcaggtaaccaaagacaagaaagacttcaacattcacttggattctgcagtctcagccaagcatggtgaaaatggttctagcttagtcgggtttgacattcaaacaatcggtaaacagcttgcttatatcataaaaggcgaaaccaaattcaaaaacctgaagaagaacaagacagctggtggaatctcggttacatttcttggagagaatgtagccacaggagtgaaactcgaagatcagatatcattgggcaagaggctcgttttcgtaggatccacaggaaccgttcgttctcagaaagacgctgcttacggagccaatcttgaactacgccttaaagatgccgatcatcccattaaccaagaccagtcctcttttgtactatcactcatgaaatggagaggagacttggcaatcggaggaaacgtgcagtcccag

SEQ ID NO: 36 - DNA, 431 bp, Amaranthus thunbergii
ttgctgttgttcatgtagaagaagaaaatctggactctaatgtcgagtctgcggaaactgttgttggagataaggatagtgaggtggaatctgaagttcaagtaggggaggaggatacatctgtggttgaagagcctgcgttggatgcttctgcgtctgttgaaggtagtgaagtgaagttaactgatgagggggattctatcgtggattcaattcttgtcgatgctggtgaagctttacggtctggagctgccgttgttggggaagtaaaggaaacaaaagacttagagagcaaagaaactacagacgttgaaaacaatgttattgaagattttgtttcaacattggagggtagtgttgcagaaaaacctgcagcagatgagtctgttaaaggtgttgaagttactggggagaagttaactgatgagggg

SEQ ID NO: 37 - DNA, 736 bp, Amaranthus thunbergii
gttgaagatctctcaaatctggcagaaactcctgtttcagtagagattgatgagaaaccgacgagtacaggggaggtcaagttagaaattgatgaatccaagcagcatgagtctggtgatggtgtgaactttgtttctcttggggaccaagagagggttcaggctgatcctgttaatgatactgctgctgataatatcgatcagcatgaagcaaaacaggtagaggggcatgacgatgaagagtctgatggtgacggtgaacctgtattctttaaggatggggtgtcttccagagcttttgtggaagagttggcatctggtgatcattcagagatgattgatggtcaggttgtcacagactctgacgaagaagctgattctgatgaggaaggagaaggtagacaattgattgattctgctgcattagctgctcttttgaaagctgcggctagtggtaactcggattcaaacactatcactataacatctcaagacggatctcgccttttctctgttgagcgacctgctggtcttggaacatcactccgatctatgagacctgcatcaaatgccagcaattccaacatgtttgctcagcccaatgttatttctgcatctgaggatagcttaagtgaagaagagaaaaagaagctgcgtacaatacacgagctgagagtaaaattcctgaggcttattcaaagacttggtcagactgcagagcaatccgtagcagcac

SEQ ID NO: 38 - DNA, 789 bp, Amaranthus thunbergii
ttctttcagtctcgacaatgcgaaacagactgcttcgcagcttgaggctgaagggaacgaagatttagacttttccttgaacatcctggttcttgggaaaactggtgttggcaagagtgccaccattaattcaatatttggtgaagagaaggtaaaaatcaatgcattcgaacctgaaaccacttctgttaatgtcgttaatggaattgtgaatggggtcaaaatcagggtcattgacgcacctggtcttaaatcttctgcattggagcaaggtttcaaccgtaaagttttagcctcagtcaagaagattactaagaaatatcctacagatctcttactttatgtggataggctggattcacagacaagagatctgaatgatctacccatcttgaggacaatcactagctcgctcggttcttctatctggcggagcgccattctcactctaactcatgcagcatgtgctcctccagatggcccatctggtgccccattgggttacgacgtgtttgtgggacagcgtagtcatattattcaacagtctattggacaagctgttggtgatttgcgttttatgaatctaggtatgatgaatcccgtctcccttgttgagaatcaccctgcatgtcggacgaacagagaaggagataaggttcttcctaatggtcaggcctggagaccgcagttattgttgctatgctactcgctcaaaatattggctgacgcaagcttggccacgaagccacaagaacctgtagatcaccggaaactttttggtttccgtgt

SEQ ID NO: 39 - DNA, 2133 bp, Amaranthus viridis
  unsure (1)..(2133): unsure at all n locations
  unsure (1)..(2133): unsure at all n locations
ctgcgtacaatacacgagctgagngtaaaattcctgaggcttattcaaagacttggtcagactgcagagcaatccgtagcagcacaagttctctataaactagcaatgttcgcaggtaggacagctattccttctttcagtctcgacaatgcgaaacagactgcttcgcagcttgaggctgaagggaacgaagatttagacttttccttgaacatcctggttcttgggaaaactggtgttggcaagagtgccaccattaattcaatatttggtgaagagaaggtaaaaatcaatgcattcgaacctgaaaccacttctgttaatgtcgttaatggaattgtgaatggggtcaaaatcagggtcattgacgcacctggtcttaaatcttctgcattggagcaaggtttcaaccgtaaagttttagcctcagtcaagaagattactaagaaatatcctacagatctcttactttatgtggataggctggattcacagacaagagatctgaatgatctacccatcttgaggacaatcactagctcgctcggttcttctatctggcggagcgccattctcactctaactcatgcagcatgtgctcctccagatggcccatctggtgccccattgggttacgacgtgtttgtgggacagcgtagtcatattattcaacagtctattggacaagctgttggtgatttgcgttttatgaatctaggtatgatgaatcccgtctcccttgttgagaatcaccctgcatgtcggacgaacagagaaggagataaggttcttcctaatggtcaggcctggagaccgcagttattgttgctatgctactcgctcaaaatattggctgacgcaagcttggccacgaagccacaagaacctgtagatcaccggaaactttttggtttccgtgtccgttcacctcctctcccatacctgttatcttcactgttgcagcctcgtacccaccctaaactttcagctgatcagggtggtgaaaatggtgattctgacattgacttggatgacttttccgattctgaccaggaagaagatgagtatgacgagctcccaccattcaagcctttacggaaaactcagcttgctaagcttagcggagagcagaggaaagcgtattttgatgaatacgactatcgagtgaagctgcttcagaagaagcagtggagagaggagctgaagagactgaaggagataaagaagaatggaaaaattaacttgaatgacccaagtgacatgccagaagattatgatgctgagaatggagcccctgctgctgtaccagtgcccttgcccgacatggtattgccaccgtcttttgacagcgacactccagcttatcgttatcggttcttggagccaacgtcacaattcttggctcgtccagtgttggacacccatggttgggaccatgattgcgggtatgatggtgtcaatgtcgagcaaaatataggaatcgcaggacgcttcccagcagcagtaactgtgcaggtaaccaaagacaagaaagacttcaacattcacttggattctgcagtctcagccaagcatggtgaaaatggttctagcttagtcgggtttgacattcaaacaatcggtaaacagcttgcttatatcataaaaggcgaaaccaaattcaaaaacctgaagaagaacaagacagctggtggaatctcggttacatttcttggagagaatgtagccacaggagtgaaactcgaagatcagatatcattgggcaagaggctcgttttcgtaggatccacaggaaccgttcgttctcagaaagacgctgcttacggagccaatcttgaactacgccttaaagatgccgatcatcccattaaccaagaccagtcctcttttgtactatcactcatgaaatggagaggagacttggcaatcggaggaaacgtgcagtcccagatatctgtcgggcgtaatgcaaagatggctgttcgtgttgcgttgaacaacaaacagagtgggcagataaccgtgaagacgagcacttctgatcatttggctcttgcttatactggtctaattcctattgctcttgccatttatcagaaattctggcctaatgctagtgagaattactctatc

SEQ ID NO: 40 - DNA, 1932 bp, Amaranthus viridis
atgaaattgaggatgttagtggagaggaggataatggtgaagttgagtctgaattgggtattaatacggctcctagagttagggtttcgagtgatgatgatgaggagggtgagagtgaggaggagatctttgaagaagcaaacgagaagatagagggtgatccattagaggataagactgttggtggtgatgataaagtagatgttgagttggttaatgaggaggatgctgttgtggattccattaatgtggatgttgttgaagcagtaaggtcaggggttgctgttgttcatgtagaagaagaaaatctggactctaatgtcgagtctgcggaaactgttgttggagataaggatagtgaggtggaatctgaagttcaagtaggggaggaggatacatctgtggttgaagagcctgcgttggatgcttctgcgtctgttgaaggtagtgaagtgaagttaactgatgagggggattctatcgtggattcaattcttgtcgatgctggtgaagctttacggtctggagctgccgttgttggggaagtaaaggaaacaaaagacttagagagcaaagaaactacagacgttgaaaacaatgttattgaagattttgtttcaacattggagggtagtgttgcagaaaaacctgcagcagatgagtctgttaaaggtgttgaagttactggggagaagttaactgatgagggggattctatagttgatgccattaatgttgatgctgttgaagttgttgggtctggagctgctgttggggaggtagaggaagcaaaagactcagagagtatggcaactacagaggtcgaaaacaatgttattgaagaatttgtttcagcactggatagtactgttggagaaaaacctgctttggatgagtctgcatctgttgaagatactgagttgaagttaactgatgaaggggattctattgtggattcaatgcatgttgatgctggtgaagttgttaggtctggagctgctattgttggggaggtagaagaagcaaaagactcggagagtgcagcacctacagaggccgaaaacaacgttattgaagaatttgtttcgacagtggaggactctgtggtagaagaacctgctgatgtggactctagatccttaaaagaagatgaggtgaaggttcaaggtgaagaggactctattgtagacgagattaatgttgatgttgttgaagccgtgagatctggagtagctgttgtgggggattctggagctgcgaaaatggaaaaggaaacggaaccagagggcaaggacgtaggtgcacccattcatgctaattcttcagagattgttgatgttgaagatctctcaaatctggcagaaactcctgtttcagtagagattgatgagaaaccgacgagtacaggggaggtcaagttagaaaatgatgaatccaagcagcatgagtctggtgatggtgtgaactttgtttctcttggggaccaagagagggttcaggctgatcctgttaatgatactgctgctgataatatcgatcagcatgaagcaaaacaggtagaggggcatgacgatgaagagtctgatggtgacggtgaacctgtattctttaaggatggggtgtcttccagagcttttgtggaagagttggcatctggtgatcattcagagatgattgatggtcaggttgtcacagactctgacgaagaagctgattctgatgaggaaggagaaggtagacaattgattgattctgctgcattagctgctcttttgaaagctgcggctagtggtaactcggattcaaacactatcactataacatctcaagacggatctcgccttttctctgttgagcgacctgctggtcttggaacatcactccgatctatgagacctgcatcaaatgccagcaattccaacatgtttgctc

SEQ ID NO: 41 - DNA, 359 bp, Ambrosia artemisiifolia
agcttatggtgccaacatcgaggtccaaagacgggagctggattacccgatcggtcaagttcagtcaactatcgggttatcgatcataaaatggaggggtgatttggcgttagggttcaacagtttggctcagttctctgctgggcggaattcaaaggtgatggttcgagccgggattaacaacaaaatgagtgggcaaatcacggtgaaaactagcagctcggaatatctttcacttgcacttgcagcagttattccttctgttatatcggcttacaagaagttgcggtcaggtgctggtgatggtgacaaatactctctgtattaaggttagttggttctattgaataatatgctta

SEQ ID NO: 42 - DNA, 3095 bp, Ambrosia artemisiifolia
tagaatcggatgtgaacgttacttctgagggtgatactgttgttgaggttgaaaaacctgagttagaatctgttgatgctgttgtggaagggatagatgttgatttgccggtaccaggagtggcgggagcggcggtggttactaaggttgaagatgaaaaacctgtggtggagtctgttgatgtggaggatgtgaaggtgactactgaaggtgattcggttgtggaagcggtggatgttgatttgccgttacctggagtggctggggtggcggtggttactaagaaggaagaagatggtggtgctgtggcggaaactgatgagtctggttcgtcggagaaggtgagttctgttttggaagaagtggtggataaggaggttgttggagtaactgatagcaagttttcgcctttggatgttgaagatgtagagaaggaggttgattatgcgggtcaagaaaacgagcctgtggtggtcaaggctgctttgaatgatgtggaaaatgtttctgtagctggtttggagggagatgcggctcagtcaacggaagttttgaacaaagctatgcctgtagatgcagattatggtttagaaaacggggcggctgacaaatttgttcttgaagaatctgcagaaaaagatgatgttgaagaacaaggctacacggatggttcccattccgacgatgaggacacagatgaggtagtatttgaaagctcagcagctgctaagcagtttatggaggggttagaaggtggtggtgagagttctcaagatcgttcacaaatggacggtcagatcgtcacggattcagatgaagaggatgatgaagaagacgggaaagagctctttgattcagctgctttagccgcccttttgaaagcagcggctgatggcagttcagaaggtggtaacattacattctcttcagaagatggttcaagacttttcacagttgaacgccctgcaggtttagggtcttctctccaggccatgagagctgccccgagaccaccccgtgccaacatttttaacccttcaagtctaatgagtgctaatgaaacagagcccaatttaagtgaagaagaaaagaagaaattggagaaattacaatccatcagggtgaagtttttaagactcgttcaaagattagggctttcaccagacgaatccgtggctgcacaggttctttacaggctggcacttattgcgggtcgacaaacgggtcaatcttttagtcttgatgctgctaaacgtaaagctgcggagctagaagctgatggaaatactgacctggacttctctgtcaatattttagtcatcggtaaagctggggttggtaaaagtgctacgataaactccatttttggtgaagaaaaaaccccagtcggcgcttttcaaaccgcaactgattcagtaaaggagataactggtgtggtagctggagttactgttcgggtttttgacacacctgggcttcggacctctgtcatggaacaagcgtttaacaggagtgtattgtcatcagctaaaaaattcacaaagaaaaacccaccagatattgttctctatgtagaccgtttggatgcccagacgcgagatcataatgatattccattactgaaaaccattaccagctcgctgggctctgccatttggcgaagtgcgattgttacttttacgcatggtgcgtcggccccaccagaggggtcaaacgggaaccctttgagttatgaaatgtttgtgacccaaaggtcacatgtggttcaacaagctattggtcaagcggttggtgatttgagaatgatgagcccgggtttgatgaacccagtttctttagttgaaaaccaccagtcttgccgtaagaatcgtgaaggtcaaaaggtgcttccgaatggtcaaacctggcgcccacagctacttatgttatgttactcgatgaagattttatcagaagcaaattctttgactaaaccacaagacccgtttgacagccggaagcttttcgggtaccgcatgcggtctccgccactgccgtacatgttgtcttcgatgttacagtctcgggctcacccgaagctagcaacggatcaaggtggtgatgtgggtgattcagagattgacctggcggatttgagtgattctgacaatgaagaagatgaagacgagtatgaccagcttccccctttcaaaccgttgaaaaaatcccaacttgctaagcttagtaaagagcagaaaaaagcttactttgatgaatacgattaccgggtcaagcttttgcagaagaaacaatggaaagaagaactaaaaagaatgaaagattttaaaaagagcggacctgatggtttggctggtcaaaattaccaggaagaagaaggtgaaggagacgcaccagcacctgtggcggtcccgttacctgacatggctttaccaccgtcgtttgatagtgataaccctgcataccgattccgtttcctggagcccacttcgcagtttatggcccgtccggttcttgatacccatggttgggaccatgattgtggttatgatggagtcaatgttgaacaaaccttagccattgccaaccgttttccggctgcaattaccgttcaagtcactaaagataaaaaagacttcagcatcaatatggattcatctatttccactaaacatggagagaacatgtctactctggccggtttcgacattcaaccaatcgggaaacagctggcctacatagtcagaggcgaaaccaagttcaagaatttgaagaaaaacaaaaccgctgcagggatttcagtcacatttctgggagaaaacactgtagctgggtttaagctcgaggatcaaattgcacttgggagacagtactcgatcattgggagtgcaggcacagttcgtttccaatccgattcagcttatggtgccaacatcgaagtccaacgacgggagctggattacccgatcggtcaagttgagtcaaccatcgagttatcgatcataaaatggaggggcgatttggcattagggtactatagtttggctcagttctctgctgggcggaactcaaaagtgatggttcgagccgggattaac

SEQ ID NO: 43 - DNA, 4413 bp, Ambrosia trifida
gagagcagcggctacaaaccatttcattcatgtccttgaacaaaaccttatctcgctccatatctaaatccttatccttcacaactcttattattatcattcataaaccctaactaattatccaattcccttcttttattcctttcaattacacctaccctatccattacagaatcatccatggacatcaaggaagacacgtctctctcaggttcttctgtttccgtttcttccaatacaattgtaactgaatctgttattgatagaaatgatactagtatggatattattaaggatagtagtagtggtttggctttgaatgctgttggtggttctgatgatgaaaacgagggttttgttagtggtcaggatgaggcttttgaaacggttattgataatttagaaaccctacctaatgtagatgaaggtgtaggtgaaggtgtaggtgaaggtgtgtgagacttttttggagccttctgaatttcctaaggttgataatgatgaaattgataatattgggttggttgagaagaaattgagtccgagtccgagttcggttgtgacggaaccgaattcgaatgcggttgtggttgaaagtgaaggagataaggttagtgaaaaaaatgaggaattgaaatctgtagatgaaaaggaggtggttacggttacggatacggatacggatacggaacaggtagaggttgaggttgaggttgaagatgatgaagatgaggatgtgttgttagttggtggctctgatgaaagtaatcctgttgttgaaatacctgttttagaatctgatgtgaacgttagttcgggaggtggttctgttgtcgatgttggtaagcctgttgttgttgaaacggctgagttagagtctgatgttgcgaaagatgtgaaggtgacgtctgaaggtgagtctgttgtggaagggatggatgttgatttgccggtagtggcgggagtggcggtggttactaaggttgaagatgaaaaacctgaggtggaagctgttgatgtggaggatgtgaaggtgacttccgaaggtgatacggttgtggaaactgtagatgttgatttgccgttaccgggagtgggtggggtggcggtggttactaagaaggaagaagatggtggtgctgtggcggaaactgatgagtctggtttgtcggagaaggtgagttctgttttggaagaagtggtggataaggaggttgttggagtaactgatagcaagttttcgcctttggatgttgaagatgtagagaaggaggttgattatgcgggtcaggaaaacgagccagtggtggtcaaggctgctttgaatgatgtggaaaatgtttctgttgctggtttggagggagatgcagctcagtcaacagaagttttgaacaaagctttgcctgaagatgcagattatggtctagaaaacggggcggctgacaaatttgttctagaagaatctgcagaaaaagatgatgttgatgaacaaggctacacggatggttcccattccgacgatggggacacagatgaggtagaatttgaaagctcagcagctgctaagcagtttatagaggggttagaaggtggtggtgagagttctcaagatcgttcacaaatggacggtcagatcgtcacggattcagatgaagaggatgatgaagaagacgggaaagagctctttgattcggctgctttagccgcccttttgaaagcagcggctgatggcagttcagaaggtggcaacattacattctcttcagaagatggttcaagacttttcacagttgaacgccctgcaggtttagggccttcgctccaggccatgagagctgtcccgagaccaccccgtgccagcatttttaacccttcaagtctaatgagtgctaatgaaacagagccgaatttaagtgaagaagaaaagaagaaattggagaagttacaatccatcagggtgaagtttttaagactcgttcaaagattagggctttcaccagatgaatcggtggctgcacaggttctttacaggctggcacttattgcgggtcgacaaacgggtcaatcttttagtcttgatgctgctaaacgtaaagctatggagctagaagctgatggagatactgacctggacttctctgtcaatattttagtcatcggtaaagctggggttggtaaaagtgctacgataaactccatttttggtgaagaaaaaaccccagtcggcgcttttcaaactgcaactggttcggtaaaggagataactggtgtggtaggtggagttactgttcgggtttttgacacacctgggctacgcacctctgtcatggaacaagcgtttaacaggagcgtattgtcctcagctaaaaaattcacaaagaaaaacccaccagatattgttctctatgtagaccgtttggatgcccagacccgagatcataatgatattccattactgaaaaccattaccagctcgctgggctctgccatttggcgaagtgcaattgttacttttacgcatggtgcgtcggccccaccagaggggtcaaacgggaaccctttgagttatgaaatgtttgtgacccaaaggtcacatgtggttcaacaagctattggtcaagcggttggtgatttgagaatgatgagcccgggtttgatgaacccagtttctttagttgaaaaccaccagtcttgccgtaaaaatcgtgaaggtcaaaaggtgcttccgaatggtcaaacctggcgcccacagctgcttatgttatgttactcgataaagattttatcagaagcgaattctttgactaaaccacaagatccgtttgacagccggaagcttttcgggtaccgcatgcggtctccgccactgccgtacatgttgtcttcgatgttacagtctcgggctcatccgaagctagcaacggatcaaggcggtgatgtgggtgattcagagattgacctggtggatttgagcgattctgaccctgaagaagatgaagacgagtatgaccagcttccccctttcaaaccgttgaaaaaatcccaacttgctaagcttagtaaagagcagaaaaatgcttactttgatgaatacgattaccgggtcaagctgttgcagaagaaacaatggaaagaagaactaaaaagaatgaaagaacttaaaaagaaaggacctgatggtttggctggtcaaaattaccaggaagaagaaggtgaaggagacgcaccagcacccgtggcggtcccgttacctgacatggctttaccaccgtcttttgatagtgataaccccgcataccgattccgtttcctggagcccacttcgcagtttatggcccgtccggttcttgatacccatggttgggaccatgattgtggttatgatggagtcaatgttgaacaaaccttagccattgccaaccgttttccggctgcaattaccgttcaagtcactaaagataaaaaagacttcagcatcaatatggattcatctatttccgctaaacacggagagaacatgtctactatggccggtttcgacgttcaaccaatcgggaaacagctggcctacatagtcagaggcgaaaccaagttcaagaatttgaagaaaacaaaaccgctgcagggatttcagtcacatttctgggagaaaacactgtaaccgggtttaagcttgaggatcaaattgcacttgggagacaatactcgatcattgggagtgcaggcacagttcttttccaatccgattcagcttatggtgccaacatcgaggtccaacgacgggagctggattacccgatcggtcaagttcagtcaactatcgggttatcgatcataaaatggaggggcgatttggcgttagggttcaacagtttggctcagttctctgctgggcggaactcaaaagtgatggttcgagccgggattaacaacaaaatgagtgggcaaatcacggtgaaaactagcagctcggaatatctttcacttgcacttgcagcagttattccttctgttatatcggcttacaagaagttgcggtcaggtgctggtgacggtgacaaatactctctgtattaagttctctgcagggggaactctaaagtggcggttcgagccggattataacaataaaatgagtggtcaaatcttggtgaaaactagcagcttagaatatctcacttgcacttgcagcagttattccttatattattttggcttacaaaaaattgcggtctggtgctggttacaaatcctccccatatcaaggttagcacttagcaggcttttgcgttcgggcttatttggtatttttaagattattgtttttggtattatcgaataatatgcttaatgtactttattcagcagttgaaaacttttgtttaattttggtgcaatgagatgaaattacga

SEQ ID NO: 44 - DNA, 1211 bp, Ambrosia trifida
ggcagaagcagccaagaattttcctaagtgatttaactgataataatgtagaagaagacagtcacggtgctgcaacagttcccgttgctgctcaagatatgaatttacctgctacatttgatgcagatagcccgacccatcggtaccgggctcttgagtctgcaaaccaatggctcattagacccgttcttgacccgcatggctgggaccacgatgttggttatgaaggaatcaacgtggaacacttgcttgcactcaaagaaaagatacctgtgtcactttcaggtcagattaccaaagataaaaaagatgctaatctccaaatggaggtatcaagtgcattaaaacatggtaaatcaaattcaaccaccgtagcattcgatatgcagactgttgggaaagagttgtcttatacgttaaggagcgaaactcggttcattaattacagaaaaaacaaagcatcagcggggttttcagcgacttactttggtgattcgttaaccggtggtgtgaaattcgaggacaaattaattattaataaacgcgggcagttggtggtggctggtggagcggttattggtcgtggtgatgttgcttatggcggcagtttggaggctactttaagagataaagattaccctttaggtcggtttttgtcaactattggtctttcggttatggattggcatggtgatctggcacttggatggaatgcgcagtctcagattcctatcggccgatctactaatctgattggccgtgttaatctaaataacaagaattctggacaagttagcgtccgtttgaatagctcagaacagcttcaaatcgcattagtcgccttagttccacttgtcggtaaactattgggtttttttcaaggtcgagattcagcatattaatcacatattttgcgttcccgattgaagaaatttagatgtggtgtatgctgagaagcgtaatcttttgatgatcaacatgtcggccgaatcttgaaataactagcgaaaagaaggcgcaaatgttttgggaaagagtatttaaatgcacaaaaggctgtagtggtagagctagatttgaagcaaaatcaccatgctgctggtaatcctttttatttctttttgtgtttaatttcttctcagtatagagatgttctggttagaattggggcgtacgagtttagttattgtattatacgtatgatgagtatg

SEQ ID NO: 45 - DNA, 296 bp, Ambrosia trifida
caaaaaattgcggtctggtgctggttacaaatcctccccatatcaaggttagcacttagcaggcttttgcgttcgggcttatttggtatttttaagattattgtttttggtattatcgaataatatgcttaatgtactttattcagcagttgaaaacttttgtttaattttggtgcaatgagatgaaattacgagggaatactatctctgtgtgccttttacagttttactatatagaaacttatttttttccattactccagcgggcgacagttaaactgagctcgtgtgggggc

SEQ ID NO: 46 - DNA, 1246 bp, Ambrosia trifida
tctttcaaatcttttgcaatcgagacctcagctgaagttgcctcaggagcagtttggtgatgatgacgacggtgatgacatggatgagtcatctgatgaagaatcatcagaatacgatgaattaccaccgtttaagcggttgactacttcccaattgtcaaagcttagtaaggcacagaagaaatcatattatgatgaattggaatacagagaaaagctctttatgaagaaacagttgcaggaagaaaagaaacaaagaaagatgatgaaaaaaatggcagaagcagccaagaattttccaagtgatttaactgataataatgtagaagaagacagtcacggtgctgcaacagttcccgttgctgctcaagatatgaatttacctgctacatttgatgcagatagcccgacccatcggtaccgggctcttgagtctgctaaccaatggctcattagacccgtgcttgacccgcatggctgggaccatgatgttggttatgaaggaatcaacgtggaacacttgcttgcactcacagaaaagatacctgtgtcactttcaggtcagattaccaaagataaaaaagatgctaatctccaaatggaggtatcaagtgcattaaagcatggaaaatcaaagtcaacaactgtagcattagatatgcagactgttggaaaagaaatgtcctataccttaagaagtgaaacccggttcattaattacagaaaaaacaaagcatcagctggtctttcagctacttacatgggtgactcgttaaccggtggtgttaaatttgaggacaagttaatgattaataaacgaggggagttagtggtggcaggaggagcggttatcagtcgtggtgatgtggcttatggcggcagtttggaggctacattaagagataaagattatcctttgggtcggtttttgtctacaattggtctctcggttatggattggcatggtgatttggcacttggttggaacgcgcagtctcagattcctattggtcggtttactaatttgattggccgtgttaatttaaataataagggttcgggtcaagttagtgttcgtttaaatagctcagaacagattcaaattgcattagctgccttagttccacttgtcagtaagctattggggtattatcaggatcgcgattctgcatattaatcacatatttttgacttgagaatgaagaaagttattttggtttaatgctgcctgctcgggtgcaatctt

SEQ ID NO: 47 - DNA, 239 bp, Ambrosia trifida
gatggagtcaatgttgaacaaactttagccattggcaatcgttttttggttgtaattacagttaaagtcactaaagataaaaaaaagacttcagtatcaatatagattcatctatttccgctaaacacggagagaatatgtctattatggttggtttcgacattcaaccaatcgggaaacagctggcctacatagtcagaggcgaaaccaagttcaagaatttgaagaaaaacaaaacc

SEQ ID NO: 48 - DNA, 1005 bp, Ambrosia trifida
atccgtggctgcaaaggttctttacaggctggcacttattgcgggtcgacaaacgggtcaatcttttagtcttgatgctgctaaacgtaaagctgcagagctagaagctgatggaaatactgacctggacttctctgtcaatattttagtcatcggtaaagctggggttggtaaaagtgctacgataaactccatttttggtgaagaaaaaaccccagtcggcgcttttcaaaccgcaactggttcagtaaaggagataactggtgtggtagctggagttactgttcgggtttttgacacacctgggcttcggacctctgtcatggaacaagcgtttaacaggagtgtattgtcctcagctaaaaaattcacaaagaaaaacccaccagatattgttctctatgtagaccgtttggatgcccagatgcgagatgataatgatattccattactgaaaaccattaccagctcgctgggctctgccatttggcgaagtgcaattgttacttttacgcatggtgcgtcggccccaccagaggggtcaaacgggaaccctttgagttatgaaatgtttgtgacccaaaggtcacatgtggttcaacaagctattggtcaagcggttggtgatttgagaatgatgagcccgggtttgatgaacccagtttctttagttgaaaaccaccagtcttgccgtaaaaatcgtgaaggtcaaaaggtgcttccgaatggtcaaacctggcgcccacagctacttatgttatgttactcgataaagattttatcagaagcgaattctttgactaaaccacaagatccgtttgacagccggaagcttttcgggtaccgcatgcggtctccgccactgccgtacatgttgtcttcgatgttacagtctcgggctcatccgaagctagcaacggatcaaggcggtgatgtgggtgattcagagattgacctggtggatttgagcgattctgaccctgaagaagatgaagacgagtatga

SEQ ID NO: 49 - DNA, 695 bp, Ambrosia trifida
ggaaaatgtttctgttgttggtttggagggagatgcagctcagtcaacagaagttttgaacaaagctttgcctgaagatgcagattatggtctagaaaacggggcggctgacaaatttgttctagaagaatctgcagaaaaagatgatgttgatgaacaaggctacacggatggttcccattccgacgatggggacacagatgaggtagtatttgaaagctcagcagctgctaagcagtttatagaggggttagaaggtggtggtgagagttctcaagatcgttctcaaatggacggtcagatcgtcacggattcagatgaagaggatgatgaagaagacgggaaagagctctttgattcagctgctttagccgcccttttgaaagcagcggctgatggcagttcagaaggtggcaacattacattctcttcagaagatggttcaagacttttcacagttgaacgccctgcaggtttagggccttcgctccaggccatgagagctgtcccgagaccaccccgtgccagcatttttaacccttcaagtctaatgagtgctaatgaaacagagccgaatttaagtgaagaagaaaagaagaaattggagaagttacaatccatcagggtgaagtttttaagactcgttcaaagattagggctttcaccagacgaatccgtggctgcaaaggttcttt

SEQ ID NO: 50 - DNA, 201 bp, Ambrosia trifida
ctgttgatgtggaggatgtgaaggtgacttccgaaggtgatacggttgtggaaactgttgatgttgatttgccgttaccaggagtgggtggggtggcggtggttactaagaaggaagaagatggtggtgctgtggcggaaactgatgagtctggtttgtcggagaaggtgagttctgttttggaagaagtggtggataagg

SEQ ID NO: 51 - DNA, 264 bp, Ambrosia trifida
gtgaaggggataaggttagtgaaaaaaatgaggaattgaaatctgtagatgaaaaggaggtggttacggttacggatacggttacggatacggatacggaacaggttgaggttgaggttgaggttgaagatgatgaagatgaggatgtgttgttagttggtggctctgatgaaagtaatcctgttgttgaaatacctgttttagaatctgatgtgaacgttagttcgggaggtgattctgttgttgatgttggtaagcctgttg

SEQ ID NO: 52 - DNA, 742 bp, Ambrosia trifida
attgggtttttttcaaggtcgagattcagcatattaatcacatattttgcgttcctgattgaagaaatttagatgcggtgtatgctgaggagtgtaatcttttgatgatcaacatgtgagttgcgctttcattcactcgctttatttcaaaaagcctaaatcttgcaactgattaagcccattctccataacgggttccatctttattgaattttagcaatctgtgttatgtgaactattggattaacatggtatagtttcttgcaggtcggccgaatcttgaaataactagcgaaaaaaaggcacaaatgttttgggaaagagtatttaaatgcacaaaaggctgtagtggtagagctagatttgaagcaaaatcaccatgctgctggtaatcctttttattttctttttgtgtttaatttcttctcagtatagagatgttctggttagaattgggggcgcgagtttagttattgtattatacgtatgatgagtatgcgactcacaaaggtcttaatttggttaagtgaacattgactctttttctactttagaaaatctatttggttaataactttatggtgtgagtgtatgttgatgcacataactacataagatgttggataaaatgcgagaaagtcgcgttcttggagcaacatgttgaatttggttacatcatgttaaatttaattatgatatataagacggttatgtaatcaaatacgattgttgttatcttttc

SEQ ID NO: 53 - DNA, 281 bp, Ambrosia trifida
tatcgatcataaaatggaggggcaatttagcattagggtacaatagtttggctcagttctctgctaggcgtaactcaaaagtggtggttcgatccgggattaacaacaacatgagagggcaaatcacggtgaaaactagcagctcggaatatctttcacttgctcttgcagcagttatttcttctgttatatcagcttacaagaagttgttgtaaggtactgatgatgatgacaaatattctctgtattaaggttagttggttctattgaataatatgctt

SEQ ID NO: 54 - DNA, 330 bp, Ambrosia trifida
cgttagttcgggaggtgattatgttgtcgatgttggtaagcctgttgttgttgaaacggctgagttggaatatgatgttgcgaaagatgtgaaggtgacgtctgaaggtgattctgttgtggaagggatggatgttgatttggcgggagtggcggtggttactaaggttgaagatgaaaagcctgaggtggaagctgttgatgtggaggatgtgaaggtgacttccgaaggtgatacggttgtggaaactgtagatgttgatttgccgttaccaggagtgggtggggtggcggtggttactaagaaggaagaagatggtggtgctgtggc

SEQ ID NO: 55 - DNA, 297 bp, Ambrosia trifida
tttctactttataaattgttttccagacaactaaatagttttgctcagttctctgcaggggggaactctaaagtggcggttcgagccggattataacaataaatgagtggtcaaatcttggtgaaaactagcagcttagaatatctcacttgcacttgcagcagttattccttatattattttggcttacaaaaaattgcggtctggtgctggttgcaaatccttcccatatcaaggttagcacttagcaggcttttacgtttgggcttattttgtatttttaagattattgttttt

SEQ ID NO: 56 - DNA, 443 bp, Ambrosia trifida
aaaaaagacttcagcatcaatatagattcatctatttccgctaaacacggagagaatatgtctactatggtcggttttgacattcaaccaatcgggaaacaagtagcctacatagtcagaggcaaaaccaagttcaagaatttgaagaaaaacaaaaccactgcagggatttcagtcacatttctggggaaaacactgtacctgggtttaagctcaaggatcaaattgcacctaggagacagtactcgatcattgggagtgcaggcacagtttggttccaatctgattcagcttatggtgtcgtataactaatttacgcttttaactcttataaaataatatctattttaatagagacgatacgccaatactcagtttggttggaagccctataaccataaatccgatacaactcattaccccatctggcggtctggcacgtt

SEQ ID NO: 57 - DNA, 295 bp, Ambrosia trifida
aagaagatgaagacgagtatgaccagcttccccctttcaaaccgttgaaaaaatcccaacttgctaagcttagtaaagagcagaaaaaattttactttgatgaatacgattaccgggtcaagcttttgaagaagaaacaatggaaagaagaactaaaaagaatgaaagattttaaaaagaacggacctgatggtttggctggtcaaaattaccaggaagaagaaggtgaaggagacgcaccagcacttgtggctttaccaccgtcttttgacagtgataaccccgcataccgatt

SEQ ID NO: 58 - DNA, 605 bp, Ambrosia trifida
ataacctaaataataaaacaaaatgactttcttatgacccattgtcacgctgcctaatcaacacccatagccaaagtctgtcccaaactacgttgtcttaaccgtccgtaaaatcaacccttaaagaaaagcccagtaagaaaagaaaagcccgaaacccaaaagaaacacatatatatgcagacgagagagagagagagagagcagcggagcagaaccatttcattcatgtccttgaacaaaaaccttatctcgctccatatctaaatccttatccttcacaactcttattatcatcattcataaaccctaactaattatccaatcccttcttttcattcctttcaattacacctaccctatccataacagaatcatccatggacatcaaggaagacacgtctctctcaggttcttctgtttctgtttcttccaatacaattgtaactgaatctgttattgatagaaatgatactagtatggatattattaaggatagtagtagtggtttggctttgaatgctattggtggttctgatgatgaaaacgagggttttgttagtggtcaggatgaggcttttgaaacggttattgataatttagaa

SEQ ID NO: 59 - DNA, 222 bp, Ambrosia trifida
tgaaggtgtaggtgaaggtgagacttttttggagccttctgaatttcctaaggttgataatgatgaaattgataatattgggttggttgagaagaaattgagtccgagtccgagttcggttgtgacggaaccgaattcgaatgcggttgtggttgaaagtgaaggagataaggttagtgaaaaaaatgaggaattggaatttgtagatgaaaaggaggcagt

SEQ ID NO: 60 - DNA, 747 bp, Avena fatua
aagcgaggaagctctagctgtacgttccattgaaacaagatgcatacatagttacacacatagtacattgtacatcacatcgtcaaattacagcaggtaggcactggagcattaatcgatcccgttacattcgatcgcccgatggatgtacagaacagccatcgatggacagcgctctagccgatgatctggtcgaggacgccggtgttcttgaggccgagcacgatgccgacgcccaagatgtggccgacggagccgcacgcgagcgtgtcggcgagcgtgaacccggccgggtcgcccgtctgcagcccggactcgcgggcctccagcttcagccccgccgtcgccttccggttcgccgacggcgccagcccgaaccgcccggcgaacagcatcagcgtcgtcgtcgtgatcatgatgaggttggtggatgagccgatgtagtcgcaccggatgccctgggacctcttcctcagcgacggcagcgtcgccatggaccttggggaggagtaggtccggaggccgtggaactgcggcacggaggtcatggcggagagctgggaagccatggccgcgtcggatttcctgtgttccggatactgcgattgctcctcctgaaggcctcaatggtgcccctatgacatatgaggtattaatggcgcagcgatcccacattatccagcaatccatcaggcaggctgcaggggatatgcgtctgatgaaccctgtagcccttgttgagaacca

SEQ ID NO: 61 - DNA, 332 bp, Avena fatua
gtgagggtcagaaagtgcttccaaatggccaaagttggaggcatcagatgcttctcttgtgctactcttcaaagatattatcagaagccaactcacttttgaagcttcaggacccttcacctgggaagctttttgggttccgttccgctccccgccgcttcctttcctgctatcctccctgttacagtcaagagctcacccgaaactttctcctgaccagggtggtaatgaaggagattctgatattgatttggacgagtactctgacattgaacaagatgaagatgaagaggaatatgatcagcttcctccattcaagcctttgaccaaag

SEQ ID NO: 62 - DNA, 533 bp, Chenopodium album
agcacaggtactgttcgttctcagaaagatgctgcttatggagctaatttggaaatacgtctcagagaagaagattatccaattggccaagatcagtcctcatttgtgctgtcactgatgaaatggagaggagacctggcaataggaggaaaccttcagtcccagatttctgttgggcggggttcaaagatggctgttcgtgttgccttgaacaacaaacagagtgggcagatcacagtgaggacaagcagctccgatcatgtagctcttgcatatgctggtctcattccaatcgctcttgccatttatcggaaattcaggcctagtgtcagtgagaattactctatctactaaaatctgcagttcatttttggtttctgtcatttacttttgcaatggtgatcaaattttgattgctttattacttttcgagtcgcttcttttgtcattttcaataaggctttgtttcatcattagtagctctttttttgggatatataccactccctagatatatgcgggttatcaatgta

SEQ ID NO: 63 - DNA, 1162 bp, Chenopodium album
gtccgggaacagtgggtgaaaatactgttgttgaagaatcttcttcgacaaatgaaggtactgctgcagaattacctgatgaaatagactctaaatctgtagaaactggtgaggccaaggttactgatgaaggagatgctgttgttgattcggtgaatgttgatgttgttgaggctgtaagatctggagtagctgttgtgggggattctgacgtgggaacagaaacagacatcaaggaaaggagtgactcggacactgcagaaacaaaggttgacaattctgctgttgaagaacctgcttctgaatctgtaagagaagaacctgctaaaacggattctaaatccatgaaaactgatgaggcaaaggttacagatgaaggagacttggttgttgatgaggatactgttggtatagaacccgtgaaatctggagttgctgttagggaggaccctggagcagccggaacagagatgaaagcggaagttaaggaagtagaagcacctgctggtgaaaacgcgacattggccaatgataatcatgcaaattcatctgagattgttgataattctgacaaaaaggccctcgcaaatgaagcagaaacacctgcatcagaagagattaatgctgaagctgctgaatccaagcagcatgagtctactggtggaatgcaatctgtttctggtggggatcaagagaaggttcagcatgatgatgtagatgatgatgcatctgataagattgatgataaaattgaaactttgatcccggataagggagatgaagctgaggagagattttacataccccaagaggaatatgatgaaggctctgatggtgaaggtgaacctctgttctttaagagtgaaatctcttccagaaattttatggaggagttggcttctggagatcgttcagagatgattgatggacaggttgtcacagactctgaggaagaagctgaatctgacgaggaaggggagggtagagagttgattgattctgctgcattagctgctcttttgaaagcggcaactagttctggttcagatactggtccaatcactataacatctcaggatgggtctcgccttttctctgttgagcgtcctgctggtttgggaacatcactccgttctgtgagacctgcgtctaattcaagcaa

SEQ ID NO: 64 - DNA, 1637 bp, Chenopodium album
ggaaggacgacagttccatccttcagtcttgataacgcaaaacagacagctatgcagcttgaggctgaggggaaagatgatttagacttttccttgaacctgttggttcttgggaaaagtggtgttggcaagagtgccaccatcaattctatatttggtgaagagaaggttaaaattaatgcatttgaacctgaaaccacttctgttaatgaggttagtggagtagtgcatggagtcaagattagggtcattgatgcacctggtcttaaatcttctgcattggagcaggctttcaaccgtaaagtcttagcctcagtcaagaagttcaccaagagatatcctccagatctcacactttatgtggatcggctggattcacagacaagagatctgaatgacctacccatgttgagaacaatctccaacactcttggttcttccatctggcggagtaccattctcacactcactcatgctgcttgtgctcccccagatggtccaactggcacttcaattggctatgaagtgtttgtgggacagcgtagtcatgttatacagcagtctattggtcaagccgttggtgatttgcgttttatgaatctaggcatgatgaaccctgtttcccttgtggagaaccaccctgcatgtcgtaaaaatcgggatgggctaaaggtacttcctaatggccaggcctggagaccacagttaatgttgctgtgctactccttaaaaattttggctgacgctagtctgacctcaaagcctcaagatcctgtagatcaccggaggtttttcaatttccgtacccgttcgcctcctctcccatacttgttaagttcgttgttgcaaccccgtacccaccccaaactttcagctgatcagggtggtgacaatggtgattctgatgttgacttggatgacttatccgattctgatcaggaagaagatgagtatgatcagctcccaccatttaagcctttgaggaaaactcagattgctaagcttagtagagagcagaagaaggcatactttgaagaatatgactaccgagtgaagcttcttcagagaaagcagttgagagaggagctcaaaagaatgagggatatgaagaaaaatggcaaaccaagtgtggatgaatacagtgagatgccagaagattatgatggtgagaatggagctccagctgctgtgccagttcctttacctgacatggttttgccaccttcttttgacagtgacactccagcttatcgatatcgattcttggagcctacttcgcaattcttggcccggccagttttggacacccatggttgggaccatgactgtgggtatgatggtgtcaatgttgagcaaaatcttgggattgcaggacgcttccctgctgcagttactgtgcaggtgactaaggataagaaagactttaatattcacttagattctgcagtttcagcgaaagcatggagaaaatggttctagcttagttggctttgatattcaaaccattggcaagcaacttgcctacatcgtgagaggggaaagcaaatttaaaaacttgaagaagaacaagacagcagctggagtatctgttacatttttgggggagaatgttgccactggggtaaaacttgaagatc

SEQ ID NO: 65 - DNA, 2317 bp, Convolvulus arvensis
tggctgttgacctggctgtatcaaagctaaaagcgttggctgttttgccttcctgcaatgagtgacaaccggtacagaacctgagtagctatggattcatctgaagagaagcccaacctctgaacaagtctcagaaattttactctaattttctgcagttgctcaagcttctttttttcttcttcactcaagttgttctcagattcggaagtatttgaaagagccggagtaaaaagactggaacgattcgatgggggagcagctctcagagaacggagtgatgatcccaaaccagcgggacgttccactgtgaatagcttagatccatcctgagaggtaattgtgatattaccaccattggggtcagcacctgttgcagcttgcaatagagcagctaggggaatgatgatctagacttctctgtgaatatactagttcttggaaagtctggagtgggaaagagcgccaccatcaattctattcttggagaagagatggctccaattaatgcatttgcacctgcaacaactagtgtgaaagaaatctgtggaaatatagatggagtcaagattcgggtctttgatacacctggtctcaagtcctctgctatggaacaggctttcaatcgcagtgtcttgtcaaaagttaaaggcttcacaaagaagaatccaatagatattgtcctctatgtagaccgattagacgcacaaaccagagatcttaatgatctacccctgctgaagactatcacgagcacacttggctcttctatttggaaaagttccattgtcaccctgacacatgcagcttccgcacctcccgaggggccttctggttctcctttgagttatgaggtgtttgttaatcaaaggtcacgtgttgttcagcagtctattggccattctatgggagatctacatatgatgagtccaagtatgacgaatcctgtttctctcgttgaaaaccatcctgcttgtcggaggaatagggagggcaagaggatactaccaaatggccagatttggaaaccacaattactgttgttatgctattcaatgaagattttggccgaagcaagttctctttccaagcctcaagatccatttgaccaccgcaggctatttggtttccgggcccgtgcaccacctcttccatacatgttgtcttcaatgttgcagtctcgtgcacatccaaagctgtctgctgaacagggcggtgataatgttgactctgatattgacttggatgatttttctgattccgaggatcaagaaggagaagatgagtatgaccagcttcctccctttaagcctcttcgaaaagctcaaattgcaactcttagtaacgaacaaaggaaggcgtactttgacgagtatgactatcgagtgaaactcctccagaagaagcagtggagggaagagttaagaagaatgagagagatgaagatgaggggcaagagtgctgctgcacttgactatggcaacaatgacgaagatgcccctgctcccgttgctgttcccttacctgatatggtccttcctccttcctttgacggtgataaccctacatacaggtatcggttcttggagtcaacatctcagtttctagcaaggccagttttggatacacatgggtgggaccatgattgtggttatgaaggtgtcaacattgaacacagtcgagcaatcgcaactcgtttccctgcagcagttactgtccaagtcacaaaagacaagaaagatttcactataagcttagactcttctgtttctgctaagcatggagagaacggatcgagcatggcaggttttgatattcaaaacattggaaagcagcttgcatatattgttcggggcgaaacaaagttcaagaatctgaaaaagaacaagacagctggtggaatatcggttacttttctcggtgaaaatatagtaaccgggcttaagctagaagatcagattactttcggcaaacagtatggtctggttggcagtgcagggatggtgaaatcgaatcaggatacagcgtatggagccaatattgaactgcagagaagggaagccgattacccgattggtcaggttcaatcgaccgttagtatgtctctgattaaatggagaggggatttcgctatgggattcaacggtttggctgaattttctactggtcggaactcaaaggtggctgttcgggcaggactaaacaacaaaatgagcggtcagatctcggtgaggactagcagctcggaccatctctctctcgcactctcagctgtccttccagttgcaattgccatctaccggaagctttaccctgc

SEQ ID NO: 66 - DNA, 571 bp, Convolvulus arvensis
ttggaagctctgaagcagctagacagttcattgaggagttggaaagggagtcgggtcacgttccttcacgtgatgttgagcagaggattgatggccagattgtgacagactcagatgaggaggccgagactgatgaggaaggagaaggaaatcaagtgcttaattcttctgccctagctgctctattgcaagctgcaacaggtgctgaccccaatggtggtaatatcacaattacctctcaggatggatctaagctattcacagtggaacgtcccgctggtttgggatcatcactccgttctctgagagctgctcccccatcgaatcgttccagtctttttactccggctctttcaaatacttccgaatctgagaacaacttgagtgaagaagaaaaaaagaagcttgagcaactgcagaaaattagagtaaaatttctgagacttgttcagaggttgggcttctcttcagatgaatccatagctactcaggttctgtaccggttgtcactcattgcaggaaggcaaaacagccaacgcttttagctttgatacagccaggtcaacagcca

SEQ ID NO: 67 - DNA, 4215 bp, Conyza canadensis
accttatcaaaatccttatccccaaatttctcacacacaaaaacactcataaaccctaatttccatataaaccataaattttacacacacttatagtgtgtgtatttttattgaaatcctattcgatatttttaatggagttgtcaaaagaagacacgtcatcaacgtctcctgtcgcaggcgctgattccgttaacggttccgtggattccggtaaagttgttattaatagtaatttgaatttgaatttgaattctgatgatgaatttgctagtggtgaagaagaagcttttgaaactaattatatagatacagatgataagaatgataatttagatacagatagtagtaagaatgataaggataatttaggtggtggaaatgaaaccctagaatcccgtgttttgagtccgaatgatgatgtcgaaaagacgaaagatgaggtggataaggttagtgagggtgtggtggttggtgtggagacaggtggagatgatgaggatgaggatgaggatgaggaggtgttgttggttggtggtggtgacgataacgagacggttaaggtagaatcggttgagttggaatcgggtggtgggagtgggagtgaagtgcaggtggagagtaaagatgttgaattggaatcgggtgatgatgtgaaactaggggatgaggtagtggaagcgatagatgttgatgtggtagaaccaggagtggcagtggttaagagtaaggaggatgttgagacgggtgaggtggaggaaggtaaggatgttcagaaggtggaagaggattctgttgttgaagctatagatgttgatttggggataccgggaaaggcaggggtggcggtggtgtttagtaataaggaggaagatgtggtgggtggaactgatgagtcgggtttatctgagaagatagacagggttttggaagaggttgtggataaggaggttgtgggagtgacagatgggaagttttcgtctttggatgtggaggaattggtaggggtagatgtagagaagaatgtagagggggaagtcgaaaaagaagttgattacgagggcagagaaaatgggtcggtggttgtgaagacggttttgggtgatgttgaagatgtgcctgtagctgatgcaactcaggtgactgaagctttggagaaatctatacctgatggtataactgaggaaacagaagttttggataaatctccccctgatggttccactgaggcaaaacaagttttagatgaagatgtatctgatgatgcagatgtgaaggcaaagcatatggatgctggtgatgtttctgcaggtgtagacacggaaaacggtccggctgacaaatttgttttggaggaatctgcagaaaaggatgatgataatgaagaaggctacatggatgattctcattcagatgaagaagagacagatggcgtagtttttggaagctcggaagctgccaagcagtttatggaggagttggaaggtgggagttccaatactggtggagagagttcgcaagaccgttcacagatggttgatggtcagatcgttactgattctgacgaagaagatgatgaagaagaagacggtaaagaagaattatttgactcagctgctttagctgcacttttgaaagcagcagccgatggtggatcagaaggtggaaacattacgttttcatctcaagatggttctaggcttttcactgtggaacgccctgcagggttgggttcttcgttccaggccatgagagcaccccaaaggcccgcaacccgttccagtcttttcaatccatcaaatcttatgagtgccggtgaaactgataccattttaactgatgaagaaaggaaaaagcttgagaagttacagtccatgagggtgaagtttttaagacttgtgcacaaattaggcctttcaccagaggactctgtggctgcacaggttctgtacaggctagcactcattgcaggtagacagactggtcaatcttttaatattgatgctgcaaaaaggacagctatggagcttgaagccgctggcagtgacttggacttctccctgaacattttagtcattggtaaagctggggttggcaaaagtgcaaccataaactctatttttggggaagaaaaaaccgtgatcagtgcttttcagcccgctaccaattcagtgaaggagatacgtggtgtggtaaatggagttacagttcgggtttttgattcacctggccttcgaacctctgtaatggagcaagggtttaacaggagtgtattggcatcagcaaagaagttcataaagaaatatccggtagatattgttctttacgtagaccgtctggatgcacagacccgagatcataacgacatccctttgttgaagaccataaccagttcactgggcgcggctatctggcgaaatgcaattgttacttttacacatagcgcgtctgctcctccagagggatcaaatggagtccctttgagttatgagatgtttgtgactcaacgttcccacgtggttcaacaagccattggtcaagctgttggtgatttaagaatgatgagcccaagtttgatgaatccagtgtctcttgttgaaaaccatgagtcatgtcgtaagaatcgagatggtcaaaaggtacttcccaatggtcagacttggagaccccagctacttatgctttgctactcgattaagattttatcagaagcaaattctctgacaaaaccacaagacccatatgacaacaatcgtaggctatttggcttccgtgtgcgctctccacctctgccatacatgttatcttcaatgttacagtctcgtgcacacccgaagctctcgtctgaacagggtggcgatggtggtgattcggatgttgacttggcagatttgacagattctgaccaggaggaagatgaagatgagtatgatcagctcccgccttttaaacctttgaaaaaatctcaacttgcaaagcttagcagagagcaaaagaaagcttactttgatgaatacgattaccgtgtgaagcttctacagaagaaacaatggaaagaagaattgaaaagaatgaaagagatgaaaaagagaggcaaagatgctgtgaatgatcaagtttatcaagaggaagaaggtgaaggagatgcaccagcacctgtggcggttcctttaccagacatggcattaccaccgtcattcgatagcgataaccctgcttaccgatttcgattcttggagcctacttcacagttcttggctcgtcctgtccttgatacccatggttgggaccatgattgtggatatgatggagtcaatcttgaacaaactatcgcaattgccaataagtttcctgcttcagtttctgtccaagtcaccaaagacaagaaagacttcagcattaatttggattcttcggtttctgcaaagcacggggagaatgtttctagtatggccggttttgacattcaaccaattgggaagcagcttgcttacattgttagaggtgaaaccaagttcaagaatttgaagaaaaacaagactgccgcaggaatatcagtcacgtttcttggtgaaaatgtggtcacgggattcaaagtcgaggatcaggttgcactcgggagacaatactcaatcattgggagcgctggcacagttaagtttcaatctgattctgcttatggagccaacatagagatgcagcgtcgggagctcgattacccaattggccaagtccagtcaacatttggattgtctatcataaagtggagaggtgatttggcattgggtttcaatagtctggcccaattctctgctgggcgtaattcaaaggtggcggttcgggccggtatcaacaataagatgagtggtcagatcacaatcaagactagcagttcagaacatctttcacttgcacttgcagcagttattccttcacttatctcagcttacaagaaattgtggcctggcactggtgataagtactctgcctattaagcgtatacactcaatcagtactttatgattattgttttggtttcgttattgtgtttttatcgaataatatgcttagtctactatattcagaaagcaagcagctgaaaacttttgtttacgtaatcattttgtgtaatgaactcggtatgaagatgagatgaaattatgacggaaaaaaaaaagaaaaaaaaacaaaacatgtcggccgcctcggtctcta

SEQ ID NO: 68 - DNA, 16663 bp, Conyza canadensis
  unsure (1)..(16663): unsure at all n locations
  unsure (1)..(16663): unsure at all n locations
aacaccagattgagaagcacgtttaggaaagacacttgctctttcgggcctaccactctccttcactgaggtatctgtttccttggcagctgatccctggtattaaaagataaatgaatcatagttgagacaaaagataagttcaaaatggtattttgtacgagttggttgaaacaaaacacagtttgtcaaaacgaggcaggtaatttgtacaccaaaaatgttaccatgttaatgcacatagtataacatcataagtctccacccttgcgagcatgaaaaactttggtctacaaaccaccccgctaatcagaaatgattttttttttcaaaaattatttggtcgtgaaatatggttaataaaaaaaaaatacgttaatagtaatttagtcttctaaaacaaaacaaaaatatcacagaggtgtaatacacttgagaacttttaaaccatttgaccagtttctttgaagtttaccaacttagaccagttaaaaattaaaaaaaaaataaaaactcgaaattaagcatttaattagtagatgggtcgaaattgcccaattaattaatgatggtagcaaggtaagtgttgcttgatagtaacatagaagacttacaccaggtaataaaagagaatcaactacaagcagtcttgcaccaaaatgttttgcaagagccttcattaatgtttcctggtatatttctgaacctgtattgtaaggatgtgcatgttagagagagatcaaaaacaaagatcaagtaaaacttgggttaacatattgcatcacatacctgctggaccacacaacagtatcctggggcacaaagtaggcagatcggagacatatttcaaaaactcattacgtttcagatgtatgtatgttgaagtaatcagcacactctttgtggtttcactgtaggtttcaataaaatagcaaagcaactcaaattcatactggatgcaataacatagagaaaccaaaacaaaatatccaagaggtaataagaatcgtgaaaaggatgagtagccactgaactaccaaagttgttttcatggcatcatttaacaaagttatttaaaatccaaatgcatccagctatgaagttcgattattccttttaaacataccactgcactaaaaggactacttttctctaggtaagataattatttgatggtcagttcattaaatatatagtcactctacttatctaaaatattagaaagatgatacagaaaaagaaatcaaagagctaaaaaatgattgttaattgcgttttgctaatatatgccctaaattaacaagatttttctcaggatatggaaaaggtaacaagcttcttctcgagaactgaaaaatgcatttttcaagaagaatttcgctaccttttttcaatttccgatgtgcactaaacgcactcttatatgtgcccttagggcacatattaaaataaccgaaagaggggattgttttgttagacttttagatatctaagggataagacttttcaaagaatttcttaaactttggagatgcctacaagataaacgcattatacaatgtatactagcatagatatggataatatactaaaaccttagacaaaaggctctgtaccttttatagatatgttatttcaaaatgcttgatcactactaatataacgaaaactatttcaaactgtatcttaaattctcgatcattctacaaaaagacattatatgcaattactgtcctatgaatcatgaaacttaacagatgtaaatgccaatcatcctagtctcacaaggcaccaagaaatagacatagacctctagtattctctactccgtcaaattcagtcgatatttaatcaacataataaccagatataacttatgtatgtagaaacttgaaattaaatatgtatgattactagatacaagaaatcaagacctaaatatgagataaataaaacgtgagtaagtggttgcaccttaaataatacggaaaatcatcaaatgtaacttcaactgtattgggatcgataattccctggagtaagctatctttatatgcttggcgccgagatgctaacgagatcggcagatcagtatcttttgacaatcctttaatttctctcctctcatcaagaattttcataatatcaagctcagaagttgatgaccccgcaagcatacgcagcagtggtctcaactcatgatttgcaggcgggatgttacccgtttcggcatcagcagaaccaccatcaagattttcattacctttatcacttgttggtggcacatcagcagctacattatcgttaggatcagaaacatccttcatttcagtgtctattacatgagtatcttcacaagcagtaggcacatttggcattccaggttgtaaatctttgcctttacaaagtgggggaagaagggataactctttccggatactagacaaagacgccaatattgaagctcctgcaactgcagatggatctctagatcttgcctcaaactgtaatccttttaatgagccactgtgtgcttctagtatgctcaccgaaggtgccacgtcagcggcaacattatcattagatagctgctgaaatatctgaggagtatgttaagaaaaatgccacatatgtataaacggtaaatacagttgatcaatttgataagaacaaataatggaaacaaatagaagggtcagtcagtttaagcaacgggtcaaagctggccaggttttggttgaaactgagcatgtatcatgcatggcataaccggccaggttgggcagatctgcaaaactcgacatcaatctttcaaccttttgaaatttatcaacttgttgattacaattacaaaaaatacaattataataatcagatataataattgaatcttcgaatgatacaacttaaaagattgtatacattgaagaattgagcatatgactatgcccaactttctgctcgtgtgacccattaagggatcccatttaaaatgagtctctgggtctgacttatttgagattaattcataaaaaataaccgaatcaacccattcataggtaaatggatccaaagcactagctgtaccatgaaacgaagataagtcagaaaacaagctaatgacaaacacttccttaaaggatacataagcatgtcgtcctgaagagctaaaaattaattcatctccagctctaagtggccacgttgaccttttagggcatatcttgccattaaccttaaccgcacccttgccgccggtgatttcaagtaaagtgattgatgcacctccttgctacacaaagaaccagatttatattacgaagagaaattgtaacgaatcactagcaacaatcaactaattaagaaaatagcaagtaaaaatagaatacctgtgactctatgtgcctcaggctacacaatgagtcgctgacggttttatcactaatccacaaatcacattggtgactttgaccaatcgtgaaaatctcacgatccatgacaatatgaggattctggacatcagaatagatatacacacataaataaatttacgaaatatatagcaattttatataattagggtgtcaaacaaccagtttgaaactttctgcaacaaaactgatacaaaaaggtaggattcaacaccatcagaaataaaaatcataactttaataggcaaaaacacctctaaaaactatctcttgcactatctgcttctctggcactatcacacctccaaaaaccccctaatttgacaaatgtcgaaaacttgtactctttatcacattttttgcatcatgttggttactaactgcaactattaagactataattagcatgcacacatccaaagactatgtcttgcactgctgtttcttgctcccacttatcagattctaaatttttcgtgttccatgaccacttgatagcgaaaacccactcgatcacattcttatatctatttcaattccactaacagtactaattctctactaacttagccaaagcaaaaggttgaaacttgaaaggcctggcctacctgagggcactgggaaagaagcttcccccaagccactccaatattagatttcagctgtcgtttcttcgtccgtttcgaaccatttgccgcgtttgtcttcgttttcgtcttcttctccacatccatcaaagactcccctacaaattcaatccaaccaacaaaaaaaaaaatcacaaacaacaaaaaactaaaaaagatccaaactttttccaaaattcaaccaaaaaataaaaaaatttccactttaatcacatacctaatgacataggcgaaaccaatggctgaccattgccttccacgtcagcaaccggagacttttccggcaaatctacaccattcacttccttattcggatcagacgaccggacctccggttcttgtgaatcacacccaccaccacctgaatctttaacgaccaccgtcgccgtctcaattggctccgccggcgttccggtagtcgacgacgacgcagcttctgccgcctataaccaccgatcacaatcaaacatcatcaattaggtcaagattattaatttcccatcatcaatttcaaaactttcaaaccctgattaaaaaacccaaaaaaattatagatatatatacatatatatatataaagataataccttggatcttttgccggaaggaattggggaagaagaaagggtgcgtttggatgaagatgagctccggcgagtttccaccatcgtcaaattatctccggcgattggaattttggtagaagaaaaagaggggagaatacggtgacaaaactgtaaatatatatacaggaaacaaaaccaacgaaatgagatataatatgtaatttaatcaaataaaatttattatctatatctataatatattataaagccctacaaaattgtatgggtgttcttaaannnnnnnnnnnnnnnnnnnnnnnnnnnnnnnnnnntactttcgataaatttttaaatccgnnnnnnnagcccgtacggctaaagcatttgactatcatacactatgacatatcaactcctataacctatcatactatatgacctaggtatcaccccaccatctcaccgacgcaacgcgcgggtacttgctctcgtttaaataatactcgtattatagaaatgaaaaagataccaagactatttatttaagaaaagtgatattgctacaataaattttagccatttacaacaaatcctgcataatacagttgtatattgtgtaatatagtttgtacttttgttgtagatgactaaattttgttataaatatcagtgttgtaaaactcggcagggaaatcaggatcggaatcgagggttaaaaggatcgagttggctggaatcgggtcaaaactcggtcaacgacttggtcgcttgtaaaactcggtcaaactcgcctggatcagtcaaaaatcgggtggatcggtcaagaatcggccggatcgggtcaaaactcgggtcaactttggtcaaaaaatttttttttgaaaaaaagaaaagaaaatgttaaattggtttaagtttataattctaatgaatgaagcttgaactttgaagaattatattaaagtttttaaacaattatgttttaagtttgaagtttattctatataattttaaaaaatataaatcttctttataaaaacctgatccgaattctccctgattccgatccgagtttttaaaaactcgtgactcccccattcgccaatccgatcccgagtcacgagtttccaaactttgataaaaatcactccccaaagaggattatatttttatttgattttgattttttttttatatataagataattagcttttgagatcgagataaatacataaaatataggataagtagtatcaaataagtataagtattagtcgtagtactttttagatttatattctatagtcgtgaatattgacgtcgatacataaatttataatatgataaattataaaaataacgaattttgtaggcctataaaccggatagaaaatctaatattgacacatgaccgatcaaaagtaatgaatagaattcatgtatattaacataaaaaaaaattttaaaatgcatcaacattaaattttgtaaaatatattaaaactatcaaattaattaatcatatatatcattatatattgaatattaagtaataatataaatataaataataggtatggaaaagggtgtaaataggaatattaggggtggttgttaagaggcagaaaggaacaatatttcgggttgaatgaatttatgtgttcttgtgtatggagtaggtaggtaaagaggattttatgcttgcattaaggtaatttggtacgaggacttatattgattcgtcaaggtttttaaataccaataatgagtcaagacatttcagggcgcgtttgattcacataatgtttttggaataaacgaaatctgatggaatgaaatttgacggaatgtttttcattttttaaagattttaagtgagagacaatgagattcatttcctcatccccatgaaatgaagattccatcaaatgaatgaatgttgacattccaacggaatgatattccttcatcattgagcaacactaaggaatggaattcaattccaatttcatcaaattctatcagaatctgcaaaccaaacgcgatctcagtgtttgaagaattaaggcaatattgggaaatgattaatactcctaaaagaatagcctaaaaatcattttaactatttgatgaagacatgtgacaaaatcaggaggcaagattaagaaagagaattagtgaatatcacttgtcacctatttatggttttaggttttatagttttaagaggatttttaggctaatttttatgagaatttatcactttcctttgtaataatatttgaaaatcttgaagacttaggtttaaatattggtataatcaaaacgtccttaataatggagccggaatttttctcaaaataagtttcctccaaaattgaaagtaaatatattaaaaataagtttcctccaaaattgaaattaaatatattaaaaaacgttaaacataaagctaccgtttcataaataaaaagatatttgttatagtgtttatttttgtttcatgttgtcaatcatcgtataaacattaaataattacccatttcactaacaacatataaatgctttaaaatattaaaaggtttaaaatattaaaagggactagaatatatggatgtcacacctgatgtcactgacttatgtaaaaaaccatttacattctatttataaaaaatatatggtcaaatcattacagtatttattatacaataaatattaaaatattaatatatgaaaagattctatgttaaaaatataaataaattaaaagttctacttctaatacaattttcaaaaatattaaatacataaccaacctgtgagcattgtgaaattattttccccaatacaacgtcaatactaaaatttgatttcgtaacacttcgatcgcctacaaatcaagatttaaccatagaaaactacattataataataataaattttttaacatatatgtttagttcaatgttagtgcaactaacctgaaatcaacgattggtctttcacttgaggcttttcatgaatatcacttgtaacctacaatcaccaaagtaaataaatatctaaatgcaatcaatatcttgcacatagtaatatgatacaacacgaatgatgtacttttattaacaaacatgtttcacaaatcacaatatattatatatgtattgagctttataggttcatgcacatacatgatcatcaggtatatcgatctttcaaattattaccgactttttaccttagatcgtttgtgtgtacgggttggcgacgaacttggtgacgatagtgtgcgtttggatggagatgatgaagaatgatgtcttgtttccaccattgtcaatttgtttccgtcgaattaggaattcacttgcagaagataaaaagaaacatatatgaaaatatttgtctaagccatgttttagaaaagtaatactaatagatagtagatatagtatttgacttactttatgacttttttggataaaatattcttgagtcggttaaagttaataataattgatcattttcgttaagtataataaataaactagttatgtttctttcgttatctttcattttatcttataaggtttaaatcaaatgctaactaacttaaaagcccaaggtttaatgggttcatccattttactttcgaactagtccatcatcatgggttttcaatatattaaatgggcctggtttagacttcaaaaaacttgatttcattctttttcttccacctatcaattaccgtccaaaaggcaccattttggtgtacccaatgtcgattgtcgtttgattgtgtcaccaatgagatttatagcttcgagcatataaaatgaagaaaaacttttaattttttattttattttatcatataattaatccatcatcttcagtctactaaaagatcatattttccaatgaattttttttcttattactatacaagaaaaaaccttttgatcaaaaagatgaggattataaatctactcatgaaaaactattcaatccaataacatgaatcttaaatttacaaagattttttctttaaaaaaaagttttccttcgacccactagagatgtttaaaagaaaatcttttcttcagaaaaaaaaaacctttgaagattgatgttattgatttaaattatttatttgagaattgcaagattggtctccgtagtttgtttattatagcaatagggatctctttttaagttcacgagcaatggggtccttattttgattttatttttttttgcaagattagtccatttttaacaaaaccattggagggtgtcgtcaaatatgcatgtggctagatatcattgtttcgcaacacatagaccattcttgcaacttttaaataaataaattattcggcaaccctaaaataaaaatcataaaaactattcgacgacacaaaataaaaatcttggctccgccattgattatacgagtatcgtacgagtattagtctcgtaacactgatgtgtatcttttcaatctaaaaagataatgaccgctatataattactattaccaaattaacatcagttgttagtaaaaataattacataaaatgtagaatattggagggataaaggccattaaactggaaccaagcatttgaaaacaaaatgtggaaaacccaatcatcgatgttatcttttttggccacttcgatataaacttttttctgacttccaaattcttccataaactaaccatctaaccatattgtttgaaaatagacattcaaaacttctctgcaaatattattatcaagcataaactagtgtatgtaaatgttgaaacttacacttaaaaaatatggatagtaaataaattcgcaaatttgttaaatatgtggtcatatatattgaaaagtcgagctataaggataaattcaattaggtagagagaatgttagatgaaattaaggcaaacacttttattagaacagactaaatgtcattgatactaaataaggtgactttggcttaagtttgatgtaatttttttctacttttatttgttttggatgtaaaattttgggttatattttttgtattcctctaacgcggacccggttaaaacaatatatgctagacctttcactgtcaaatcacagtaaaaaatttatagcaaaatttactataaaaaaaaaaataaataaaaatacaccaaaccaaaaagcccatcaaacaaaacccaacccccacgactctcacccccaaacaaaactttttttttttttttttttttaactctctcctcatttccagcggctgcaaaatatatatatataacatttttcactatcatctactcttcaaaaaaacaaaatataaaccttatcaaaatccttatccccaaatttctcacacacaaaaacactcataaaccctaatttccatataaaccataaattttacacacacttatagtgtgtgtatttttattgaaatcctattcgatatttttaatggagttgtcaaaagaagacacgtcatcaacgtctcctgtcgcaggcgctgattccgttaacggttccgtggattccggtaaagttgttattaatagtaatttgaatttgaatttgaattctgatgatgaatttgctagtggtgaagaagaagcttttgaaactaattatatagatacagatgataagaatgataatttagatacagatagtagtaagaatgataaggataatttaggtggtggaaatgaaaccctagaatcccgtgttttgagtccgaatgatgatgtcgaaaagacgaaagatgaggtggataaggttagtgagggtgtggtggttggtgtggagacaggtggagatgatgaggatgaggatgaggatgaggaggtgttgttggttggtggtggtgacgataacgagacggttaaggtagaatcggttgagttggaatcgggtggtgggagtgggagtgaagtgcaggtggagagtaaagatgttgaattggaatcgggtgatgatgtgaaactaggggatgaggtagtggaagcgatagatgttgatgtggtagaaccaggagtggcagtggttaagagtaaggaggatgttgagacgggtgaggtggaggaaggtaaggatgttcagaaggtggaagaggattctgttgttgaagctatagatgttgatttggggataccgggaaaggcaggggtggcggtggtgtttagtaataaggaggaagatgtggtgggtggaactgatgagtcgggtttatctgagaagatagacagggttttggaagaggttgtggataaggaggttgtgggagtgacagatgggaagttttcgtctttggatgtggaggaattggtaggggtagatgtagagaagaatgtagagggggaagtcgaaaaagaagttgattacgagggcagagaaaatgggtcggtggttgtgaagacggttttgggtgatgttgaagatgtgcctgtagctgatgcaactcaggtgactgaagctttggagaaatctatacctgatggtataactgaggaaacagaagttttggataaatctccccctgatggttccactgaggcaaaacaagttttagatgaagatgtatctgatgatgcagatgtgaaggcaaagcatatggatgctggtgatgtttctgcaggtgtagacacggaaaacggtccggctgacaaatttgttttggaggaatctgcagaaaaggatgatgataatgaagaaggctacatggatgattctcattcagatgaagaagagacagatggcgtagtttttggaagctcggaagctgccaagcagtttatggaggagttggaaggtgggagttccaatactggtggagagagttcgcaagaccgttcacagatggttgatggtcagatcgttactgattctgacgaagaagatgatgaagaagaagacggtaaagaagaattatttgactcagctgctttagctgcacttttgaaagcagcagccgatggtggatcagaaggtggaaacattacgttttcatctcaagatggttctaggcttttcactgtggaacgccctgcagggttgggttcttcgttccaggccatgagagcaccccaaaggcccgcaacccgttccagtcttttcaatccatcaaatcttatgagtgccggtgaaactgataccattttaactgatgaagaaaggaaaaagcttgagaagttacagtccatgagggtgaagtttttaagacttgtgcacaaattaggcctttcaccagaggactctgtggctgcacaggttctgtacaggctagcactcattgcaggtagacagactggtcaatcttttaatattgatgctgcaaaaaggacagctatggagcttgaagccgctggcagtgacttggacttctccctgaacattttagtcattggtaaagctggggttggcaaaagtgcaaccataaactctatttttggggaagaaaaaaccgtgatcagtgcttttcagcccgctaccaattcagtgaaggagatacgtggtgtggtaaatggagttacagttcgggtttttgattcacctggccttcgaacctctgtaatggagcaagggtttaacaggagtgtattggcatcagcaaagaagttcataaagaaatatccggtagatattgttctttacgtagaccgtctggatgcacagacccgagatcataacgacatccctttgttgaagaccataaccagttcactgggcgcggctatctggcgaaatgcaattgttacttttacacatagcgcgtctgctcctccagagggatcaaatggagtccctttgagttatgagatgtttgtgactcaacgttcccacgtggttcaacaagccattggtcaagctgttggtgatttaagaatgatgagcccaagtttgatgaatccagtgtctcttgttgaaaaccatgagtcatgtcgtaagaatcgagatggtcaaaaggtacttcccaatggtcagacttggagaccccagctacttatgctttgctactcgattaagattttatcagaagcaaattctctgacaaaaccacaagacccatatgacaacaatcgtaggctatttggcttccgtgtgcgctctccacctctgccatacatgttatcttcaatgttacagtctcgtgcacacccgaagctctcgtctgaacagggtggcgatggtggtgattcggatgttgacttggcagatttgacagattctgaccaggaggaagatgaagatgagtatgatcagctcccgccttttaaacctttgaaaaaatctcaacttgcaaagcttagcagagagcaaaagaaagcttactttgatgaatacgattaccgtgtgaagcttctacagaagaaacaatggaaagaagaattgaaaagaatgaaagagatgaaaaagagaggcaaagatgctgtgaatgatcaagtttatcaagaggaagaaggtgaaggagatgcaccagcacctgtggcggttcctttaccagacatggcattaccaccgtcattcgatagcgataaccctgcttaccgatttcgattcttggagcctacttcacagttcttggctcgtcctgtccttgatacccatggttgggaccatgattgtggatatgatggagtcaatcttgaacaaactatcgcaattgccaataagtttcctgcttcagtttctgtccaagtcaccaaagacaagaaagacttcagcattaatttggattcttcggtttctgcaaagcacggggagaatgtttctagtatggccggttttgacattcaaccaattgggaagcagcttgcttacattgttagaggtgaaaccaagttcaagaatttgaagaaaaacaagactgccgcaggaatatcagtcacgtttcttggtgaaaatgtggtcacgggattcaaagtcgaggatcaggttgcactcgggagacaatactcaatcattgggagcgctggcacagttaagtttcaatctgattctgcttatggagccaacatagagatgcagcgtcgggagctcgattacccaattggccaagtccagtcaacatttggattgtctatcataaagtggagaggtgatttggcattgggtttcaatagtctggcccaattctctgctgggcgtaattcaaaggtggcggttcgggccggtatcaacaataagatgagtggtcagatcacaatcaagactagcagttcagaacatctttcacttgcacttgcagcagttattccttcacttatctcagcttacaagaaattgtggcctggcactggtgataagtactctgcctattaagcgtatacactcaatcagtactttatgattattgttttggtttcgttattgtgtttttatcgaataatatgcttagtctactatattcagaaagcaagcagctgaaaacttttgtttacgtaatcattttgtgtaatgaactcggtatgaagatgagatgaaattatgacggaatatagtaattttgcttttgattactcacggtttcctcagtttccaatatagtatacaattaggattgatagacgcttgattgcttgccgatttgcatgtcttctatgcataggctcataatatcaatttgtaatgatgtttgcgtctctaaacagcctatggggttgtcaaaactagaccatagctttagagtacagacagtttcagtttgcattggtagtttcggtgtgggttacttgaatggtctgcagtcttaccggctaggggcgtgcactttttggttcatggtttagctatgcaagttcgtttcctggccttgtcctggttatgggaattacattacattacactactgattgtaactcaatagtgtcggtttgctccactatcaatagtcactagtatgatgactggtcagatctcatcaactctagcatcttggaacgtctgatgtattatagcaaaccaataaggttgagtagcttatttagtgacagttatctgatgattctgcatcacattgtcctttactccttccaaacaccatatgtttcttgtttggtatttcatatatcctttttatttctttcgatcaagtatggcatgcttgctgtactttattaagaaagcaagcaaacgaaaactttcttttcctttgtgtaatttctaaagatgagatgaaattaagagggaacagcataaatttagtttggttacgcgtggttttcttcttctgttgatatataaatggtgttcaaagtcaacacttgaatcagactcacattagtcgagtttgcatgtgtctgtgttctttactcttttttattaaacaaggagacgtaatttataatttatttttagttattgactgataagtgagaatatgtcaattacataactaaaattacgtgttggtgtctatggaaagcacggaatgacaagaggttcaacaacgtggaggttagcccggtgaagatcactcaaagcattaaagtgctcgggtacctttggttcaagaacagagcaaagcaatataggcttagttgggtagaatgagtaaactttagcatactggaaatttgtttgatacattataattaattaggtcgcgaggactgtgaatacctttcaaaaaaaaaacataactaaaattacatagttaaatatttttccaaaatattgcacacgcttttaatctaacaaatacggtgcttttgaagcttaatttatttaggaatgtatgtaactagtgctaatatggatcgaccatattcatcaatactatgtgattatagatacggagtaattttatttttttttgtgagtttttaaattttttttttttaatcttttaccatttgagtaaaaaaattaagaaaacaaataataaccattggagatccttgtgggtataaatttcacttttttaccacaaatactggccctccaagaaagaacaaaaaaatggggctgtgaagaggtaaaagataaaagccctaacatcatcattgactcaactaaaagtcaacaatcttcaaaagtgcaggacatcgccctaaatttgttggattttttcatagtaagtcatatatcaatttaatttgttattaacaataatacttaaccagattttagacacgtgtcaaatacgcgtattttacaacattatcaatataaggattaatatttagaagaaaaaaaacttacacggtaaatgtaaaaatatatacttaaaaaagaattaggatatttaaacatgtgttgatttattatattttttttaacgacaaatttagctcaacgacatgccttttcatatacccaactccaattccagaggaaactcattatgtattgtcatgttgatttaattattattgagaaattgattattgtgattaatcaattgattagttgagtatttgtttattatcttaactagattattatcccgcgtaatacgcgagagaatatatatttaattaatgacatattatggtttcataatattgtaaattgacaaatatagatataagatgtagaaaacggattaattagtatcataatgcaaaagatgtaaattattatcatgttaaaatgagctaatttataaataaacaaactttcattgaaaactatcgcaaatacattcaaagttaaaatatgtctaatatagagagagaaaaaaagacataaaatttcatgattttatgtttttataaacaattagtaaaacttaaaattttagtattaagtgacagtttgaaattcaagatgatatttgtttaactgactataattaagaactgaatatagatttgacttcttttttaagtcatgtaactatattagtcatgttttacgatctttcacgtaatttaatgtttatatacatacacacataaagaaaaattaacaaaataaaaaatagtttttatataaattatcaaagcatcatagcaatatctacgcattacacttacatttgatattt

SEQ ID NO: 69 - DNA, 10522 bp, Cyperus esculentus
ataatattaagatttgtatttgttttagggtcaagacaaaaaaattgttcatgaaaatacaagaaagtaaaaaaaaattctattaaataagcaaagcaaagcaagaccttatctctctgcattctccaaatcaacccaatctgtggtcatctttctcccctttcttcttctctactctactactaaaccctcggataagactcttcttcttattacttctcaaaacccctccctctctctctctcgctgagccttatcgctttcttcttcttcttcttcttctcatgagcagctctaaccaaaccctagtcgccgaggacgagaacaaacccaaggcggttgagtcggagccggtgccggtacccaccgagcaaaacctaggcggtaataccgaggagggggtggttgaggaggaggagaaagggggtaactttggtacccaattgggtgaagtggaaaaggaaaatactgagacccaattaggggaagatgggaattccggtggcaaattggatgatgatgatgaaaagagtgaggggaagcaattggagggaggggtaatttctagtgatcgggtaggtgacggggaagcagttggggtgcaaggagaggaggagggaggtgagggggttggggctcagggggaggaggaggaggagacggcttctggtggtaaggatggtgtcgcggtggcggcggcggcgactgaagagaacaaggtgcaagaggaggtgaaggaagaagaaggagaaggaggagaagtggctgtttctgaggtgaaagaggatggtaagaccgaaggagttgttgaagagcttgataagccggaagtcgttgtaagtcctcctgttgagagtgttcctgaggatgttaccggttcggatacctttgttgccaatggtgtcgaggatagcggggtttcaggtgaagaaagtggtgtgctagagggtggttccgagaacctgattagagaaactgaggctgagaatgaaaatgtaccgaccggattaaacgagtcggaggaaccaagtattaaaaatgagggtaaaaatgatgatgtagttgtgaaaggggatgagtcggaggaaccaagtaccgaaaatgagggtaaaagtgatgatatagtagtgaaaggggatgaattggaggaaccaagtaccgaaaatgagggtaaaagtgatgatgtagtagtgaaaggggatgagtcggaggaaccaagtaccgatgtcgagggtaaaaatgatgatgtagtagtgaaaggggatgaggtggaggaagcgagggaggccgaggatggggataactatgaagcggtgttgaccggagatgagctggaggaggatgagatagaggatccggacttgcagccagctcgtgttgctattctggagaaaacggaggctgaggagattatgagagaaattgaggaagccaatgctggtattatatttattttatttcatttttttattatttttgattgaaagcggttcgactgtctgtttcattatatgaaaaaatatattgcaaagtgtcgctcatgcatatcggtcaagctaagctcattgtataactaattaacagaaaactaccctcatcaaaacttaaggattttgactcaatttagtaatccagtactggtttctttcagcatagaactgatgattaattaagcctggcttcctttcagcttaatagttaatgcacatcattgtcagatcctgttttgaactcgaaccctataactaaaaaaagttggcatccaaactaacagtagatataaagcagcaacacaaatcaagtcttctgcactgatacagcatcagagaaagcacaatttagatgcattaccacaaactcatggtcttatatacaaacacaaacacatgtttcactctctctttttcactttggttgcttcaatgcaggtatggatgggcaacttggatcagattctgatgaagagatggaagaaggcatagaatttgaggatgatgatgaggaggacagagaagacgaagcggatagagaaaactttgattcagcacttgctgcaattctcaaagctgccactggcggtgatggtaattttgtgattagcccgcaagatgatagtaccggttcaggtactggctcacgaatcttcaaaattgaccgcccagctggactaggaccgtcagctcctgctttgcggccccgtcctactgggacaacaccggcaaggccaagctctcagttggcagccattccttctgagacggggacagtggaggaaatgtcagaagaggagaaagcactgcatgaaaaaattgaaagtattcgagttaaatttcttcggcttgtgcacaggtcaggccactcacccgaggatacagttgctaggcaggtactgcatcggctcagcctggctgagggtttcaggcgtggtcgcatggctggtgctggtattggtatcggtacatccatcgaagcagcatggaagaaggctctccaacttgaggctattactggtgctggtacagatgacctcaagttctcagtgaatattttggtcttgggtaaagctggggttggcaagtctgccacaattaattcaatcttcaactctgaagtcgctagtaccgacccatttgcacctgcaagcacatccgtgcgtgaatttactcgcatggttgatggtataaaattccatgtaattgacaccccaggcctgaaaacctctatcatggaccagaatgcaaaccgcaaaattttagcaagggttaaaagcatcactaaaaggtgtccaccagacattgtattgtatgtggacagaattgatacacagactcgagatttgaatgacttgccactcctgcgtaccattacaagtgtactgggctcttcgatatggtttaatgccatagtcgctctgacacatgcgggcctggctccaccagaaggccctaacggatctcctctgacctatgagtcatttgtggcccaacgttcacatgtggtacaactagcagtacggcaaggagccggtgacatgaggcttatgaaccctgttgcactggttgaaaaccaccagtcatgtaggcgcaacagagatggccacaaaattcttccgaatgggcaatcctggcgccaacagttgttattgctctgctactcctccaagattctgtcagaggcaaatgaacttctgaagttacaggacaacagctccagttcagctgctagtaaattatttggatttcggttcaggtcccctccattgccatttttgctttcatcgctcctgcaaactcgggctcacccaaaacttgcaaatgaccaaggtggtgatattaatggggactcagatgtagagctggacgatttctctgactatgaagaggatgatgaggatgagtatgaccagttgccaccgtttaagcctcttaggaagtcacaaattgcaaagttgtcaaaagatcagaggaaagcatattttgaggagtacgagtaccgagtcaaacttctgcagaagaagcaatggagagaggaggtacgcagaatgaaagagatgaaaaggaggaaggagatggatactggtccgacagctgggtttgagcctggggatgattatgaccaggataatgctcctgcctcagttcaggtacccttgcctgacatggtactgcccccttcctttgatggtgatgcacctacttaccgttaccggtttctggaaccaaccagcgggtttttggcccggcctgtcttggacacacatgggtgggaccatgattgcggctatgatggtgtcagtttagaagaaacgctagctctggccagtaagtttccagccaatgtatcagcacagatcaccaaggacaaaaaagaatttagcattcacctggagtcagctatatcttccaagcatggtgataatgggtcgagccttgctgggtttgacattcaaactattggccgtcagcttgggtatattatacgaggtgagacaaaattcaagaacttaaagagaaacaagaccacaggtgggatcacagtcacctttttaggtgacattgttgctacaggggcaaagttggaagatcaactttcacttggtaagaggttaaccctggtagcttctactggtggagtccgtgcacagggggatattgcctatggtgcaaatctggaggccagattgagggataaggattacccgattgggcaggctttgactactctgggtctctctctgatgaaatggcgtggcgatctagcactgggtgcaaatttgcagtcgcaaattcctgttggtactgggtcaaaggtggcattgcgggtggggttgaacaataagctcagcggtcagatttcagtgcgcaccagcacttctgatcattttcagatagcattcctggctctggtacctgtggtttcttcaatcatccgaactcttcgtagcggtggtggtgagtcttttgcctactagagggtaccaattaagagctgtttgccgagtactttccaatttgaagaactggtaccagtagttttggttttttttgatctggtttatggcgaatgcgtgttttatttttggaaggagaggaataatggtttcagtgtaggagtttaattttgatattattctatttagaattggaactcaattaaatttgaagtgccattgtgatattattttagtcagctgtttcactgattatgttggatgtggttcatttaattttaataatggttataatgataaattttgttggatatgaaggtcagacctaaactgtttcatatcttactttcttgttggaacttttcaatttggagcaattgaatattagttttgatttgcatctgaaaagtgtaacagtagtaactttttattgtttactttgcatatgttacacaacatctaatctgtgtatgaatttaatcatcatccaccagaactcacacgttgcccaaagggctgaaattattatatctaagagtacagggccgaaagttcaagaagaaataaatatgggcctcaaattttaatggactgagatattaatgtacgttaacgttaacggtggtgatcaatctaagtaaacaattaacggttgagatttttttttttttgagaaaagaacttttatatcaaaaaatccaatttcctttaaaacatcaagacacaactccagaagataatttatctattcacaattccaactgtttttcatcagtacttggaactccaaaagtcatcaacatgaacattaaagatgtctgagaaaaaagaagaaaaaattactacagagagcatctcagaaggaaaaacaaatgaaaaaaaaaaaaggaactgtagagaatggatctaatccaacaaaagaaacataaaatgcaatcaccagcaagaacacaagttgatcaatttaacaggatttttgtactgattcctctgataaatcttatgcaatttcaacatgctcataaagcttgccagtacttgaatatgaacatcattcttatcaaacacttttgatgcatcaaatagattaagaaaaaagaacaaatattacaagaaacatacaccattgtattaattttcaaattgaacacttttccacagagaaattacacaaaatatcaaaagaatttacaactttctcctgagaaactcattcctgaaatcaaccaaattaagaacaaaatcctcttccaaatcaaacaatgccaaccaacatctttacacaaacaaaaagtaatcaattacacctttattcaagaatgaagatcaagaagggccgaagcagcgtcgaattcacgagtagcaacgtccccgcgggactcgaacgacgcggggttcttcttcggcacggtgacagtccgcacgttatgtatcctctcattcgtataccgctccaaaggtacatccattggtagcctgatcctcctgaagaacttgccacggggacgctccaacatatgccacttggcagccttgctgtcgtcgcgcctgtcatatatggtgcattccccgctgaattcgaggaagatgtcgtcgtcgcctgtgacgtttagggcattcactttcaccgccggttcctccttccccggataatcgaacgtgaagacgtgtgcgacaggtgtctccttccagtcgacgagaacacggtacgggtttaagacattgcttgtgtcgctgccggtcgacatttcggagtcaggtttcttcaacacagtgacagtcagcacgccgtacttcatggcagcctccaacgctgccagattggcattgtcaggtagcctgaacctcctcatgaacttgccacgggcgcgctcgaccacacgccatgtcgtgccattctcctccttcttttctacaacgcgctccccagtgatctcaaggaagacatcatctactgctcttactttcacatccgcttcgttcatcccggggaaatcgcccacgatgacgtgtgcctcgggggtttctcgccagtcgacgcgcacaaagaaggggttggaggcggcattgcttgagctgcttgccgacattttgtcggcttgtttgtgtgtttgatgaagtgcagtttgctggtgtatttatacctttctatagggaatcaggtgatcaatgagtgaggatcaagaattaagcaagaagttcaagaactttctagaaacttggctctgttggtgctttgcagtaagcagtagagaaacatcttgcacatcctgcgtccattgaaaacccgtccatatacacgtccatagacctgtacggaatgtaacaggtatataccgaaatgtaacatatacgttccgaaatgtaacatatgaacactatagatgacttttctatggatgctaggtatcgctcgttacaaggtttttttgcagtaagcactccctgtacctgtacctgtacaataaggttccagactactaatttcctttccaatataacagctagcagtttgttaaggtttgcaattttgggcttaagaagttgttatttgtatttttgggctcgagaagttgatacttgtagttttgggcttggtaagttgttattctaaacttcccctgttgttatttgtagtacttttgggcttgttatttctatttttttgggttcaaattcagttgtagtagaagactgtcctattttgatcacaagaaagaacccgacccaacccgagaaacccacccgacccgacccgacatttttcagaaagtcaaactgattcgactcgacctggcccgagatcaaatagcatccaatccaactcaaatcaacataggatccaaaaaaaaagtagatattaaaattgatccgacccgacctgagatattcgagaagttcaaactaacccaacccacacacccaccagatttgtcacctctaaaagaaaccataatgtgctcttctagctaattcccaccttggcttcttattatgttcctctacagaaacagaaatagtaacaaaaaaagaagcttatgatatgaaattactaccaagtcactgagttgtttttttttattttttaatgttcagcagtctatatattctataactaaattaacggagaacagattcttcttaaaactaaaaaagccgtgaccagagttatgtttcaatagaatagtattagaattagtatctcacacattaaaagtaccaacaaatcaaacacaatggcacattaactggcacttattgtcacaatttatttgaagcatgtagccactcttgtttcaaccagcactgatcaccaaacatgccgtctcgaatcggatcgatttccctgtcgtgtcagcctatatggggaagaggccgtttccggcacgtttgcgcctgctgtaccagtgtgtaccagttcatctgtctcaactctcaagctacatttgatcttttgttttgctacttctgttcatctatgataagatttttttgatgtttactgtttgcagaattggaactgatggaagaacaatgttttcctcttttggaagaaaaataattaattaattggtggatcccgctgttctatataaaagtcacacataaaagcatattttatcttattttgttatcatttgtatcctcatatatatattgtgctacaaaatcaaacatgtcaaattaaggtcaatattcaaaattataaaatgaattgtgaaaatgccagttaattctatgctcatcagttagctgaacagattaagagagagaaagaaaagaaatgaaaagctaaattgtacagaatgaacctaatccaacaaaaagaaacacaaatacaatcaacaacaagaaataagtggaattaatgtctcaaattaattacaggaatcttccattcattcctctgctaaattaatcatggttatcaaattgccagcacttgaatatgaacattgtattctatagaaaccacactgtataggatgaattgatcatagttttacctttctttctttcagttctttctttttctttttcactcagtagaaataaccttttatctaatgaaaaaagtaagcaaacgcttcttcaaaaaaaaaagaatataaacacattgtatcaaacacttttgatgcatcaaatagataagagaagaacaaatattacaagaaacatatatcattttattaattttcaatttgagcacttttccagtcagaaactataatacatcaaccaaagatcactagcttctaaatttctaaattccaaagtcaaaaaaacatcccaattcaacacaactagttcacattttcttgcaaacacactgcacttacatctctactcaagattacacctttaatggaattaactacagaagaacaccaaaaaaaaaaaaacatcaaaaaggagttgcataatctctccactgagaacttcacaaatctaaccaaagaacaaaaaaatcttctttcaaattcaaaaatgccaacacaaagcaattacaccttcattcaagaatcggaatcaagaatccgttaattgcgccaacatatcagtgacgaaaaatccttcgcgatcagaagaaccctcggaagattcgacgacctgatcatcggttttcttcggcacagtgacagtcagcacgccgtcctccacaacaggctcaagctcccccagattggcattctcaggcagcttcaacctcctcacaaacttgccacgggcgcactcggtcatatgccacgtgctattctccccctcctccgcttctacgacgcgctcccctctgatctcgaggaagccgtcatcgaaagtctccacttccacatcgtctccatccactccggggatatcggccttgatgatgtgtgccacgggggtctcctgccagtcgacacggacaatgtaggggttggaggaggcgttgctcgaggtgctgcccgacattttgtcggctaatttgtctgattggaaagtgatcagagtatcagacaaactgacaaaatggggctttgtgaggaggaacagctttgttgggttgttttgttgtttgatgaagtgactggtgcttcttgctttgctggtgtatttatacctttctgtagggacagaaaaggatcaagaatcaatcaagaagttcaagaactttctagaaacttcgcttgttaattagtactttgcagtaactagtaagcagtgagtactcggaagtacaataaggtttggaacttcagtttcctttccaataacggtctcatggtttgttaagttttgcaattttgggcttgagaagttgttatttgtatttttgggcttgagaaggtgttatagggttgagctggaactgggcttcatagttcagttttgatgtaagggcattaaaaaaaaggcaaaaaaaatgcaaatttcaagacaatagttttcagatggattatccataaaggaaatagcagagttttatcttctattgaaaaacatctttgcgtctatggaaaaaccgtccatctatttataaacatgtacggaatgtaacaaatacatctcgaaatataacctatggacactatggattgttattctatggacgttaggtattactccagttaaccatcaaatttaggaatgtatgcaagcaaaccctttaaatgccaaaatatacaatatcaaaggaatgacaggtttcctgtggcaccctcatctactgagggcatgcactgaatgagttctttttttcgttttgcaaccttttacttacatatgttctttcattttatttttttctttgcttacaattagttttaacaaaatgactttcatatttttttcctttttccttttaacaaaaagaaacatacttgaatttaattttctgctgttttcatcctattaactagtaagttcaattcctattttcttgtatttttaccaatatttctatggtgcatttccctgtattgcacaagaattttgatttaaataacataatcatatgatgagggaattaaacagatccacaggggaagattgaaatcatttgcattcaccagctggaaagcataaaataaa

SEQ ID NO: 70 - DNA, 546 bp, Digitaria sanguinalis
ggatcatctgatgggaatatcacagttgcttctcaagatggttccagaatattcaccatggaccgacctgctggtctgggttcaacagcgccatctctgaggcctactgctcctcgacaacctgccaggtcaaacctattcaaccccttggagcttgcagttacagctgatcctactgaagagatgactgaggaagagaagaagttgcatgacaaagttgagttgattcgcgtcaagtttttgcgtttggtttacaggctgggagctactcctgaagaaacagtcgctgcacaagtgttgtaccgtttgagccttgctgagggtatccgacaaggaaggcagaccaaccgagctttcagccttgataatgcacggaggaaggccttacttcttgaagcagagggaaaagaggatctggacttctcatgcaatatacttgttctaggaaagattggagttggcaaaagtgcaactatcaattctatttttggtgtaagagaagaccaaaactgatgcctttagctcagcaaccaccaaggtgacggg

SEQ ID NO: 71 - DNA, 929 bp, Digitaria sanguinalis
ggctcacaaaggagcagaagaatgcttattttgatgagtatgactacagggtcaagcttctccagaagaaacaatggaaggatgagatccgcaggctaaaggagatgaagaagaggggggaaagttatatggatgatgattatgggtatgccaatatcactggtgaggatcaggacccgccgtccagagaatgtatcagttcccttacctgacatggtgctgcctccttcatttgattgtgacaatcccacataccggtaccgctttttggagccaacttcaactgtcctagcaaggcctgttttagacgcgcatgggtgggatcatgactgtggttatgatggagtaagtgttgaagagacactagctatccttagcaggttcccagcaaatgtagcagttcaggtcaccaaggacaagaaggaattcagcatccatttagactcttccattgcagcaaagcatggggataatgcctcatcgcttgctggttttgatatccagactgttgggcggcagcttgcgtatattctccgtggtgagaccaaaatcaagaatatcaagaagaacaagaccaccggagggttctcagtaactttcctgggtgacattgtggctactggactgaaggtcgaggaccagctctcccttgggaagaggctgtcactagttgctagcactggtctgatgaaagcccaaggggacactgcatatggagctaacttggaggcacgcctgaaagacaaagactacccgattggccagtccctgtcaacattgggtctttctctgatgaagtggcgtcgggacctcgctctgggtgctaacttacagtcacagttctccatcggaaggggctcaaagatggcggttcgacttggtctgaacaacaagctgagtgggcaaatcaccatcaggacaagcacctc

SEQ ID NO: 72 - DNA, 917 bp, Digitaria sanguinalis
gaagcttttgcagaagaaacaatggaaagaagaactaaaaagaatgaaagaacttaaaaagaaaggacctgatggtttggctggtcaaaattaccaggaagaagaaggtgaaggagatgcaccagcacccgtggcagtcccgttacccgacatggcattaccaccgtcttttgatggtgataaccctgcataccgattccgattcctggagcccacttcgcagtttatggcccgtccggttcttgatacccatggttgggaccatgattgtggttatgatggtgtcaatgttgaacacaccttagccattgccaaccgttttccggctgcagttacagttcaagtcactaaagataaaaaagacttcagcatcaatatggattcatcagtttcagctaaacatggggagaacatgtctactatggccggttttgacattcaaccaattgggaaacagctggcttacatagtcagaggcgaaaccaagttcaagaatttgaagaaaaacaaaaccgctgcagggatttcagtcacatttttgggagaaaacactgtagccgggtttaaattggaggatcaaattgcatttgggagacaatactcaatcatcgggagtgcaggcacagttcggttccaatctgattcagcttatggagccaacatcgaggtccaacgacgggagctggattacccaattggtcaagttcagtcaacaatcgggttatcgatcataaaatggaggggcgatttggcgttagggttcaacagtttggctcaattctctgctgggcggaactcaaaagtgatggttcgagccgggattaacaataaaatgagtgggcaaatcacggtgaaaactagcagctcagaatatctttcacttgcacttgcagcagttattccttctgttatatcgg

SEQ ID NO: 73 - DNA, 580 bp, Digitaria sanguinalis
  unsure (1)..(580): unsure at all n locations
  unsure (1)..(580): unsure at all n locations
acgcatggtgcgtcagccccaccagaggggtcaaacgggacccctttgagttatgaaatgtttgtgacccaacggtcacatgtggttcaacaagccattggtcaagcggttggtgatttgagaatgatgagcccgggtttgatgaacccagtttctttggttgaaaaccaccagtcttgccgtaagaatcgtgaaggtcaaaaggtgcttccaaatggtcaaacctggcgcccccagctgcttatgttgtgttactcgatgaagattttatcagaggcgaattctttgactaaaccacaagacccgtttgacagccggaagctttttgggttccgcgtgcggtctccgccactgccatacatgttgtcttcgatgttacagtctcgggctcacccaaagctagcaacggaacagggtggtgatgtgggtgattcagagattgacctggcagatttgagtgattctgaccatgaaggagatgaagatgagtatgaccagctccccccgttnaaaccgttgaaaaaatctcaacttgctaagcttagtaaagagcagaaaaagcttactttgatgaatacga

SEQ ID NO: 74 - DNA, 521 bp, Digitaria sanguinalis
gattttggtctagataacggggcggctgacaaatttgttctagaagaatctgcagaaaaagatgatgttgatgaacaaggctacacagatggttcccattcagacgaagaggacacagatgaggtaatatttgaaagttcagcagctgctaagcagtttattgaggggttagaaggtggtggtggtgagagttctcaagatcgttcacaaatggacggtcagattgtcacggattcagatgaagaggatgatgaagaagacgggaaagagctctttgattcagcagctttagccgcccttctgaaagcagcggctgatggcagttcagaaggcggcaacattacattctcttcagaagatggttcaagacttttcacagttgaacgccctgcagggttagggtcttcgctccaggccatgagagccgccccaagaccaccccgtgccaacatttttaacccttcaagtctaatgagtgctaatgaaacagatctcaatttaagtgaagaagaaaagaagaa

SEQ ID NO: 75 - DNA, 2449 bp, Digitaria sanguinalis
atgctgaagacgaggctgctgccagtgaagccccgaaagaatcaactaacatggacgctgatcttgaagacgaggccaccaagcctcagccagccaacgaggagagtccagtggtaagtgagcgtacttaatctgattttgttgcttttatagtgttaatgcgagtggtgatgtaaacaaatttcaatgtgcaccaatctaggttgtgagtgatggaagtgcagaggagcctgctcctgcatctgcagacagtgttattgatggtagcctggagaaagagcagagtgctgaagttcaggcttctgccagtgaagctgtggaagacgttggtgctaagaaactcacagaggttgaaaatggtgctgctgctccagagttggctccagaatttgctgatgagactgaaggtgctactgaggttgctgatcatgaagaggaggctggtgacaccggcataattgaggcggaggctgtggtagatgatgaggacggggtcggtaatgagattgatgaggatgatgatggggcaaattctgacacaagtcctgcacgggttgctatcttagagagctctgaagctgcaaagcagatcatgaaggagcttgcagaaggatcctctactggtagtgtgtctggctctagagacttcactgaaagcatggatgggcagattatgcttgatgattcagaggatgatgaggacgatgatgatggggatgagaagggatttgattctgctgccctggctgcccttctgaaagcggcaactggtggagcgtcagatgggaatatcacagttgcttcccaagatggttccagaatattcaccatggaccgacctgctggtctgggttcaacagcgccatctctgaggcctactgctcctcgacaacctgccaggtcaaacccattcaaccccttggagcttgcggttacagctgatcctactgaagagatgactgaggaagagaagaagttgcacgacaaagttgagttgattcgcatcaagtttttgcgtttggtttacaggctgggagctactcctgaagaaacagtagctgcacaagtgttgtaccgtttgagccttgctgagggtatccgacatggaaggcagaccaaccgagctttcagccttgataatgcacggaggaaggccttacttcttgaagcagagggaaaagaggatctggacttctcatgcaacatacttgttctaggaaagattggagttggcaaaagtgcaactatcaattctattttcggtgaagagaagaccaaaactgatgcctttagctcagcaaccaccaaggtgcgggaaattgttggtaatgtggatggtgtcaagattagaatcattgatacaccaggccttcgacctaatgtgatggaccaagggtctaacagaaaggttctttctgctgtccagaaatatacgaagaaatgtcccccagatattgttctatatgtcgatcgtctggatagtctgagccgtgatctcaatgatttgcctcttctgaaaaccatcactgctgttcttggttcatccatatggttcaacgccattgttgcgctcacacatgctgcctctgctcctcctgaaggcctcaatggtgctcccatgacatatgaggtcttgatggctcaaaggtcccacatcatccagcaatccatcaggcaggctgcaggagatatgcgtttgatgaacccagtagcccttgttgagaaccatccttcttgcaggagaaaccgtgagggccagaaagtgcttccaaatggccaaagctggaggcatcagatgctgcttttgtgctactcctcaaagatattatcagaggccaactcacttctgaagcttcaggaccctaatcctggaaagctttttggattccgtttccgctccccgcctcttcccttcctgttgtcctcactcttgcagtcaagagcccaccccaaactttctgctgagcagggtgggaatgaaggtgattctgatattgaattggatgattattctgatgtggaacaagatgatgaagaagaagaatatgatgaccttccgcccttcaagcccttgaccaaagctcagcttgcgaggctcacaaaggagcagaagaatgcttattttgatgagtatgactacagggtcaagcttctccagaagaaacaatggaaggatgagatccgcaggttaaaggagatgaagaagagagggaaaagttatatggatgatgattatgggtatgccaatatcactggtgagaatgatcaggaccctcctccagagaatgtatcagttcccttacctgacatggtgctgcctccttcatttgattgtgacaatcccacataccggtaccgctttttggagccaacttcaactgtcctagcaaggcctgttttagatgcacatgggtgggatcatgactgtggttatgatggagtaagtgtt

SEQ ID NO: 76 - DNA, 457 bp, Digitaria sanguinalis
ctgggtgacattgtggcaactggactgaaggttgaggaccagctctcccttgggaagaggctgtcactagttgctagcactggtctgatgaaagcccaaggggacactgcatatggagctaacttggaggcacgcctgaaagacaaagactacccgattggccagtctctgtcaacattgggtctttctctgatgaagtggcgtcgggacctcgctctgggtgctaacttgcagtcacagttttccatcggaaggggctcaaagatggcagttcgacttggtttgaacaataagctgagtgggcaaatcaccatcaggacaagcacctcagagcaggttcaaattgctcttatgggtctcgtgccgattctagcttccatctaccggagcttccggcccagtgaaccatcgtttgcttattagcatatcaggaagagttttggactacttattagat

SEQ ID NO: 77 - DNA, 1857 bp, Echinochloa colona
atgttgaagatgaggctaccaagcctgggtcagctaatgaggcaagtcccatggttctgggtgatgtgagtgtggaggagcctgctcctgcaagtgcagaaagtgtgattgaggatagcactgagatggagcagaatgctgaagatcaggctgctgccagtgaaggtgtggaagatgttggtgccgagaatcccagtgaggttggaaatgttgctgctgctagtgctgatggcatcttgactcgagagttggatccagaaccaagcaatgaaaacaatggtgctgattttactgaaggtgctactgtggttgctgatcgtaaagaggaagaagctggtgacagtgacataattgaggctgaggctgtggctgtggcagatgatgatgatggagttggtactgaggctgatggcgacgatgatggggtgaactctgacacgagtcctgcacgggttgcaatattagagagctctgaagctgcgaagcagatcatgaaggagcttgcggaaggatcctccggtggtagtgtgtctggctcaagagacttcactaatagcatggatgggcagattatgcttgatgattctgaggatgatgatggggatgaggatgaggatgaggatgagaagggatttgattctgctaccctggcagcccttctgaaagcggcggctggtggatcgtcagaggggaatatcacagttgcttcccaagatggttctagaatattcaccatggaccgacctgctggtttgggttcatcagccccttctctgaggcctactgctcctcgccagcctgtccggtcaaacttattcaacccctcggagctagcagttaccgctgatcctactgaagagatgactgaggaagagaagaagttgcatgacaaggttgagttgattcgggtgaagtttctgcgtctggtttacaggttgggagctactcctgaagaaacagtagcagcacaagttttgtaccgtttgagccttgctgagggtatccgacatggaaggcagaccaacagagctttcagccttgataatgcacggaggaaagccttaattcttgaagcagagggaaaagaggatctgaacttctcatgcaacatacttgttctagggaagaccggagttggcaaaagtgcaactatcaattctatttttggtgaagagaagaccagaaccgatgcctttagctcagcaaccagcagcgtgcgggaaattgttggtgacgtggatggtgtcaagattagaatcattgatacaccaggtcttcgacccaatgtcatggaccaaggatcaaacagaaagattctttctgctgtcaagaaatataccaagaaatgccctccagatattgttctatatgtggatcgtctggatagtctgagccgtgatctcaatgatttgcctctgctgaaaacaattactgctgttcttggttcatccatatggttcaatgccattgttgcgctcacacatgctgcctctgctcctcctgaaggcctcaatggtgctgccatgacatatgaggtcttgatggctcagagatcacatatcatccagcaatccatcaggcaggctgcaggagatatgcgcttgatgaacccagtagcccttgtcgagaaccatccttcttgcaggagaaatcgtgagggccagaaagtgcttccaaatggacaaagctggaggcatcagttgctgcttttatgctactcctcaaagatattatctgaagccaactcacttctgaagcttcaggaccctaatcctggaaagctttttgggttccgtttccgctccccgccccttcccttcttgctgtcctcactcctgcagtcaagagcccacccca

SEQ ID NO: 78 - DNA, 1078 bp, Echinochloa colona
tgctgagcagggaggcaatgaaggtgattctgatattgaattggatgactattctgatgtggagcaagatgatgacgaagaagaatatgatcagcttccacccttcaagcccttgacaaaagctcagcttgcgaggctcacaaaggagcagaagaatgcttactttgatgagtatgactacagggtcaagcttctccagaagaaacaatggaaggatgagatccgtaggttaaaggagatgaagaagaggggaaaatctgatctagatgattatggttatgctaatatgactggtgagaatgatcaggaccctcctcctgagaatgtatcagttcctttacctgacatggtgctgcctccttcatttgattgtgacaatcccacatatcggtaccgctttctggaaccaacttcaactgtcctagcaaggcctgttttagatgcacatgggtgggatcatgactgtggttatgatggagtaagtgtagaagagacactagctcttcttaacaggttcccagcaaatgtagcagttcaggtcactaaggacaagaaggaattcagcatccatttagactcttccatcgcagcaaagcatggggataatgcctcgtcacttgctggttttgacatccagacagttgggcggcaacttgcatatattctccgtggtgagaccaaaattaagaatatcaagaagaacaagaccaccggaggattctcagtaactttcctgggtgacattgtggcaactggactgaaggtcgaggaccagctctcccttgggaaaaggctgtcgctagttgccagcactggtgcgatgagagcccaaggggacactgcatatggagctaacttggaggcacgcctgaaagataaagactacccaattggccagtccctgtcaaccttgggtctttctctgatgaagtggcgtcgggaccttgctctgggtgctaacttgcagtcacaattctccatcggaaggggctcgaagatggcggttcgacttggtctcaacaacaagctgagtgggcagatcacagtcaggacaagcacatcagagcaggttcagatt

SEQ ID NO: 79 - DNA, 4882 bp, Echinochloa crus-galli
ctatgctgaacaggacatccttagaggcatggccggtgaggacattcttcaatgcgtccgccgtcaaggggaagtgcccgctgcccgtgactgcttctcccaagcgcaggaaagggatgatcaagctcagctcaataggagtggcggccaaatttagaaccataacagtaacagcattgcaacggcttcccaacattgctacagcaacaccgccaagaataacagtggtcccacatattggaaagattccaatggtgattccaagggcagcagagaaggccagttgcttgggttctgctccccttctgataacctgcagcacgggatcaaaaatcttgttctggagccatggcaggacgccagtcctggtaagaaaagaccccatttgattaagctggggcatcccctattccccttctccttgtgggggttcacgttcagctgaggggtgggagcaggcgagcggcagcgccagaaatgggggaaatggttcgaatcgaaagcactccaccccgcagcaacaaccagcaatggatcgcaaaggagagatcggcggagcacgcctccggcgatgggcggacgggagagggaagagaaccccgctccggcggcggcgggggcggaggccgaggaggagccgccaagaaagtcgaggcgccggtggccatcaccaccgacgccgccccagtcgcgccgcccctggaggacgagaaatcgaccccagcggcggccgaggaggagcctcgggaatcttattttgaggagaagaaggtcgaggagggtcgggggagaaagatggggacgaggatgaggggagattggagaagagaggtgagggctttgggggtccggaggcggagaacggcgaggcagaggataccggagggggtggtgacggcggggaggtgggagaggcggaggaggatggtgaaggtggaagctcgggagctgcggaggccgagaaggacgttggcagcggggaagctgtggcggcacccgcgccagccgcggagtccaagccggagaccagcgagttggggaaggacgatgcttctttgccttcccctgatgagccggaaggtggtgaggagaagagtgaattgccggaggagcagcaggaggaagaaggtgcctcggtggaggccaaggttgcggatgatgtggaatcggcagtggccgaggaggttaagccagaaccagaagatgagaagggtgaggaggtagattctgagagcagagacggcgccgaatttggtgatgagaaggaggttggggtctctgctgggagcatggaggtgacccaaccagaggataaggttgcccctgttgctgaagctaatggtgaattaggggccgagaaggaagccagtgatgacgccgcggctctgggagatggagaagccctggaagagtcatctaacaaggatgctgatcttgaagatgaggctgtcaagcctgagcctgccagtgaagcgagtccagtggttgtggatgatgggagcgtggaggtggccgaaccagaggataaggttgcccctgctcctgaggctaatggtgaattaggtgatgagaaggaagccagtgacgacgtggtggctctgggaggtgaagaagccctggaagaatcaactaacaaggatgctgatgttgaagatgaggctaccaagcctgagtcagctaatgaggcaagtcccatggttctgggtgatgtgagtgtggaggagcctgctcctgcaagtgcagaaagtgtgattgaggatagcactgagatgagcagaatgctgaagatcaggctgctgccagtgaaggtgtggaagatgttggtgccgagaatcccagtgaggttggaaatgttgctgctgctagtgctgatggcatcttgactcgagagttggatccagaaccaagcaatgaaaacaatggtgctgattttactgaaggtgctactgtggttgctgatcgtaaagaggaagaagctggtgacagtggcataattgaggttgaggctgtggctgtggcagatgatgatgatggagttggtactgaggctgatggcgacgatgatggggtgaactctgacacgagtcctgcacgggttgcaatattagagagctctgaagctgcgaagcagatcatgaaggagcttgcggaaggatcctccggtggtagtgtgtctggctcaagagacttcactaatagcatggatgggcagattatgcttgatgattctgaggatgatgatggggatgagatgaggatgaggatgagaagggatttgattctgctaccctggcagcccttctgaaagcggcggctggtggatcgtcagaggggaatatcacagttgcttcccaagatggttctagaatattcaccatggaccgacctgctggtttgggttcatcagccccttctctgaggcctactgctcctcgccagcctgcccggtcaaacttattcaacccctcggagctagcagttaccgctgatcctactgaagagatgactgaggaagagaagaagttgcatgacaaggttgagttgattcgggtgaagtttctgcgtctggtttacaggttgggagctactcctgaagaaacagtagcagcacaagttttgtaccgtttgagccttgctgagggtatccgacatggaaggcagaccaacagagctttcagccttgataatgcacggaggaaagccttaattcttgaagcagagggaaaagaggatctgaacttctcatgcaacatacttgttctagggaagaccggagttggcaaaagtgcaactatcaattctatttttggtgaagagaagaccagaaccgatgcctttagctcagcaaccagcagcgtgcgggaaattgttggtgacgtggatggtgtcaagattagaatcattgatacaccaggccttcgacccaatgtcatggaccaaggatcaaacagaaagattctttctgctgtcaagaaatataccaagaaatgccctccagatattgttctatatgtggatcgtctggatagtctgagccgtgatctcaatgatttgcctctgctgaaaacaattaccgctgttcttggttcatccatatggttcaatgccattgttgcgctcacacatgctgcttctgctcctcctgaaggcctcaatggtgctgccatgacatatgaggtcttgatggctcagagatcacatatcatccagcaatccatcaggcaggccgcaggagatatgcgcttgatgaacccagtagcccttgtcgagaaccatccttcttgcaggagaaatcgtgagggccagaaagtgcttccaaatggacaaagctggaggcatcagttgctgcttttatgctactcctcaaagatattatctgaagccaactcacttctgaagcttcaggaccctaatcctggaaagctttttgggttccgtttccgctccccgccccttcccttcttgctgtcctcactcctgcagtcaagagcccaccccaaactttctgctgagcagggtggcaatgaaggtgattctgatattgaattggatgactattctgatgtggagcaagatgatgacgaagaagaatatgatcagcttccacccttcaagcccttgacaaaagctcagcttgcgaggctcacaaaggagcagaagaatgcttactttgatgagtatgactacagggtcaagcttctccagaagaaacaatggaaggatgagatccgtaggttaaaggagatgaagaagaggggaaaatctgatctggatgattatggttatgctaatatgattggtgacaacgatcaggaccctcctcctgagaatgtatcagttcctttacctgacatggtgctgcctccttcatttgattgtgacaatcccacatatcggtaccgctttctggaaccaacttcaactgtcctagcaaggcctgttttagatgcgcatgggtgggatcatgactgtggttatgatggagtaagtgtagaagagacactagctcttcttaacaggttcccagcaaatgtagcagttcaggtcactaaggacaagaaggaattcagcatccatttagactcttccatcgcagcaaagcatggggataatgcctcgtcacttgctggttttgacatccagacagttgggcggcaacttgcatatattctccgtggtgagaccaaaattaagaatatcaagaagaacaagaccaccggaggattctcagtaactttcctgggtgacattgtggcaactggactgaaggtcgaggaccagctctcccttgggaagaggctgtcgctagttgccagcactggtgcgatgagagcccaaggggacactgcatatggagctaacttggaggcacgcctgaaagataaagactacccaattggccagtccctgtcaaccttgggtctttctctgatgaagtggcgtcgggaccttgctctgggtgctaacttacagtcacaattctccatcggaaggggctcaaagatggcggttcgacttggcctcaacaacaagctgagtgggcagatcacagtcaggacaagcacatcagagcaggttcagattgcacttctgggtctcgtgccagttgcagcttccatctaccggagcttccggcccagtgaaccgtcatttgcttattagcctgtcaggaagagtcactagtctacttatttgatcaccatatcgtttctcttggcaattttcctttccatatgaaccatatttccttccatttcagtttactcttttagtcggcagatcgttcctatcataattttgtctgaagaaaggttgtgagatttatctggaactatagctgaataatgtcaagggatctatattatccttgtggttattaatc

SEQ ID NO: 80 - DNA, 1261 bp, Euphorbia heterophylla
atccgattctgataatgaagatgaagaggacgagtatgatcagctccctccattcaagcctctcaggaaagctcagcttgctaagcttagcagggaacagaaggaagcctactttgccgagtatgattaccgggtcaagcttctccagaaaaagcaatggagagaagagctcaagagaatgaaagagatgaagaacaaagggaaggtcacagaagatgaatctgctttaaacggtgaagatgattcggaaaatggagctccagctgctgtgccggttcctttacccgatatggctcttccaccttcgtttgacggggataatccagcttataggtaccggttcctcgaaccaacttcacaattcctggctcgaccggttcttgacacccatggttgggaccatgactgtgggtacgatggtgtgaatctcgaacacactctagccgtagctaaccagtttccagcggcagttgcagttcaacttacgaaggacaaaaaggaattcagcgtccatttggattcttcagttgcagcaaagcatggggagaatgcatccagtatggtcgggttcgatatccaaaatgtggggaagcagcttgcttatgtcctcagaggggagacgaaattcaagaactttaggatgaacaaaacagctgctgggatgtctgtcacattcttgggccagaatgtagccactggcttcaaactcgaggaccagattggacttgggaagcggctgacattggtcgggagtactgggaccgtccgatctcaaggtgattcggcatatggagcaaatctggaggttcggctgaaggacgctgattatccgatcgggcaggaccagtcctctttgggattgtcgttggtgaagtggagaggagacctggcgctgggagccaaccttcagtcgcagatatcgttgggtcgaagctataaggtagcagttcgtgctgggctgaacaacaagatgagtgggcagattacggttcgaactagtagctccgagcagtttcagattgcactcgtgggtcttcttccaattgcattgtcaatctacaaaagtcttcaacctggggttagtgagagcaattactcactgtactaaatttcgttatcaatttttctgttcatttttttggttatgccaatgtttagcgccataagactagatgatacgttgagtttgtggttttattttcgaataaatgctggaatttttatatgattttgaagtcgaccgcccttataagttttacgg

SEQ ID NO: 81 - DNA, 722 bp, Euphorbia heterophylla
ccaccggtggtggtggtggtggtggctcggagggtggcacagtcaccttgacctctcaagatggatccaggctcttctcggtggagcgacctgcgggtctaggatccggacttcggcctgtaaaacctgcagcacgggcagctcgtcctagtcttttcggttcttcaaatctcacagctggaggagagtcagaaagcaaattgagcgaggaagataaactgaagctggaaaagttgcagcagttaagggttaagtttctgaggcttgttcaccgactgggtcaatcgccagaagaatctatggttaatcaagtcctctatcgtttagcccttgttgctgggaggcaaaccagccagctatttagtcttgatgctgcaaagaaaactgcgctggagctcgaagaacagggtaaagatgacatggacttttccttgaacatactggttcttgggaaaacaggggtaggaaagagtgctacaattaactcgatttttggtgaggagaagtccccaatccatgcgtttgaacctgccacaaattcggtccaggaattaactggcatggtagacgggatcaagataagggtaattgattgtcctggtctgaagtcttctggttcggaacaggggtcaaaccgaagaattctagcatcagtcaagaaatttatgaagaaatgccctcagatattgtcctctatgtcgataggcttgacactcgtacca

SEQ ID NO: 82 - DNA, 500 bp, Euphorbia heterophylla
cctttgctgaaatctatcactagtaatctcggttcgtcgatttggcgaaatgctgtagttactctgacccatgctgcttcagcaccaccagatggtccctctggttcccctctgagttatgaggtgttcgtggctcaacgatcccatgttgttcaacaatccattggccaagctgtcggtgatctgcggctgatgaacccgagtttgatgaatcctgtatcacttgtagagaatcacccctcttgtcgtaagaacagagaagggcaaaaggtgctcccgaatggccaaacttggaggcctcagttgcttctactatgctattccatgaagattttggccgaagcaagttccatctcgaaacctcaagatccattcgatcaccgaaaactcttcggtctacgttctcgatcgcctccctgccataccttttgtcttggttgttgcagtctcgccacaccctaaactctccactgaccaaggaggtgactctgttgactccg

SEQ ID NO: 83 - DNA, 7841 bp, Euphorbia heterophylla
  unsure (1)..(7841): unsure at all n locations
  unsure (1)..(7841): unsure at all n locations
atttaagatattattaaatttcaaatttcattatccatgaaaataatttaaatcttaaaatataaaaataaaaataaaattccagtctcaaataaaaatgaccaaattgagtccaagcatacttaaaaaaatatctcaactctcaaacaaaaactccttttcaaatttcgaataaaatccagtttcaagactttgattttttttgtttactttcaaaaactactttacttgatcatataaataactcatcaataattgtgaaaaattacaaccaatcaatcattcaaaacaacgtgcaatccttccacaaatataacaacgaaatctttttacagaaaaagtattatttactgttgttttaaattaatatttttctaaacagctaaaactcaaccaattgaaaacctgtatattgtaagagttactgtattatatgagtttttttatattagaccagatattctaaagtggaaaaatgccatccgattaaaattatgacacatgtgtccactatagtgccacacatgtaatgaccttaacgggcgacacttttccaccttgaaatacccaatctcatataaaatttctctagttcaagaaatcaagtatttcatataattggaggaggattacacatcatcaaaacgaaaacttatttcaaatcttaatcttaatgttctctttagcctaaggccgcattgttttaatttctaaaaactaaaccgaaacaaagttgactgaactgaaatgagttataaaacttattgtgtcataaatttatactatacacaataaaacgaaactgaagtacatttaattcaatataatataatttaaatcacttcaatttaatgcaactcaaacttcaattttcagcttaaaaatttcttatattagctttatgacgtcacacgagtaacaagaaatccactgaaaacgtaacagcgaaataaattgaaagggccgagatgcaaatgaaggcccattaaaggggctgcggcccacaaatctagtttgttgaaggcagaagaatcccaatacacaatacaaatacaaatttcgccttatctctccgctttatcttgctctggctctcttcttctacaatcccttcccccattttcttatccccaaacccccaatccccttctctatcactcttcttcctattctttccgccatggattccaacacctctgcacctcaagcggcggcgcctctctccaactcatcaggttctccttcctcctcttcttcatcttcatcttcttcttcatcatcttcgcatgattctgctattcgtaattcagttttgatgtctgaaactagtactgaaattaatagtaatgttaatattcgcggtgtagatttcgtgagtggtgttgaggtgtttgaaaccgagacggagaggcctgaaactccggagaaacctatttttgaccccgaggaatttccgcctcttaaaagagtggagccggtgtccaaagcatcgtccccgcatgaagatgatgatgaaaaagtttccaaaccctccgagtttggggagggttcagtggttgtggatgagggtaagggtttggttgagggtttagtggagagaaatggaattggagagggtgttgtgaaattgagcgaggaagtggaaaatagtaagttggacggggagataactgaggttaagagtggtaatggtgttgaagagagtgaaattctgggaaatggcaataaaaaaccagacgctgttgggaaagatgagatggagaaaactgatactgtgagttttgctactgaaggagataaggttgtggaggcggtaccaattgagaaactagacactgttgccttagaattggggaaagatgattcggagaaaactgatagtgtgaatttaactagtgaaggagataaggttgtggaggccacatcaattgaaaaactagacaacgatgctttagaattggggaaagatgagaaaactgatataactagtgaaggagataaggttgtggaggccgcaccaattgaaaaaccggacactgatgctttagaattggggaaagatgatgttgagaaaaatgacagtgtggattttaccagtgaaggagataaggttgtggaggccgtgcctgttactcttgtagggtcaggagtggttgttgttggggatgaggagattaaggatactggccttatagaaaaggaggctttgattgatgatgttgtgcctctagatactggtaatgcttttagtaagattagcaatgatgtggagaaaacacctaatcttgatgctgaatatgaagagtttcttgaagctgtgaatgaccctaagggaacacttccagtagctgattgtaatggagaaaagcatgatgatttgggagatggaggggatgaagatgtttcacaaactatagtgacctctgttactgatgctatagaagatgaggtttcaggtgatatagctgctcaatcaagggccatttctagtatggagcttgaagtagaagatgaagatgaagaaaacgatctactaggtggagaagatgagaatgaaggatcgttatctgatggtgaggatgatagtctgcttttcggaaactcggaagctgccaagcaattcttggaagagttacagctagcatcaactgctgagtcacaatctggtgctctggcgtccattgataattcagagagaatcgatggtcaaattgtgaccgactctgatgaggatgacactgatgaggaaggagaggggaggcagctgtttgattctgctgctttggctgctctcttgaaagcagccaccggtggtggtggtggtggtggctcggagggtggcacagtcaccttgacctctcaagatggatccaggctcttctcggtggagcgacctgcgggtctaggatccggacttcggcctgtaaaacctgcagcacgggcagctcgtcctagtcttttcggttcttcaaatctcacagctggaggagagtcagaaagcaaattgagcgaggaagataaactgaagctggaaaagttgcagcagttaagggttaagtttctgaggcttgttcaccgactgggtcaatcgccagaagaatctatggttaatcaagtcctctatcgtttagcccttgttgctgggaggcaaaccagccagctatttagtcttgatgctgcaaagaaaactgcgctggagctcgaagaacagggtaaagatgacatggacttttccttgaacatactggttcttgggaaaacaggggtaggaaagagtgctacaattaactcgatttttggtgaggagaagtccccaatccatgcgtttgaacctgccacaaattcggtccaggaattaactggcatggtagacgggatcaagataagggtaattgattgtcctggtctgaagtcttctggttcggaacaggggtcaaaccgaagaattctagcatcagtcaagaaatttatgaagaaatgccctccagatattgtcctctatgtcgataggcttgacactcgtaccagggatttgaacgacctgcctttgctgaaatctatcactagtaatctcggttcgtcgatttggcgaaatgctgtagttactctgacccatgctgcttcagcaccaccagatggtccctctggttcccctctgagttatgaggtgttcgtggctcaacgatcccatgttgttcaacaatccattggccaagctgtcggtgatctgcggctgatgaacccgagtttgatgaatcctgtatcacttgtagagaatcacccctcttgtcgtaagaacagagaagggcaaaaggtgctcccgaatggccaaacttggaggcctcagttgcttctactatgctattccatgaagattttggccgaagcaagttccatctcgaaacctcaagatccattcgatcaccgaaaactcttcggtctacgttctcgatcgcctcccctgccataccttttgtcttggttgttgcagtctcgcccacaccctaaactctccactgaccaaggaggtgactctgttgactccgatgttgacctggccgatttatccgattctgataatgaagatgaagaggacgagtatgatcagctccctccattcaagcctctcaggaaagctcagcttgctaagcttagcagggaacagaaggaagcctactttgccgagtatgattaccgggtcaagcttctccagaaaaagcaatggagagaagagctcaagagaatgaaagagatgaagaacaaagggaaggtcacagaagatgaatctgctttaaacggtgaagatgattcggaaaatggagctccagctgctgtgccggttcctttacccgatatggctcttccaccttcgtttgacggggataatccagcttataggtaccggttcctcgaaccaacttcacaattcctggctcgaccggttcttgacacccatggttgggaccatgactgtgggtacgatggtgtgaatctcgaacacactctagccgtagctaaccagtttccagcggcagttgcagttcaacttacgaaggacaaaaaggaattcagcgtccatttggattcttcagttgcagcaaagcatggggagaatgcatccagtatggtcgggttcgatatccaaaatgtggggaagcagcttgcttatgtcctcagaggggagacgaaattcaagaactttaggatgaacaaaacagctgctgggatgtctgtcacattcttgggccagaatgtagccactggcttcaaactcgaggaccagattggacttgggaagcggctgacattggtcgggagtactgggaccgtccgatctcaaggtgattcggcatatggagcaaatctggaggttcggctgaaggacgctgattatccgatcgggcaggaccagtcctctttgggattgtcgttggtgaagtggagaggagacctggcgctgggagccaaccttcagtcgcagatatcgttgggtcgaagctataaggtagcagttcgtgctgggctgaacaacaagatgagtgggcagattacggttcgaactagtagctccgagcagtttcagattgcactcgtgggtcttcttccaattgcattgtcaatctacaaaagtcttcaacctggggttagtgagagcaattactcactgtactaaatttcgttatcaatttttctgttcattttttttggttatgccaatgtttagcgccataagactagatgatacgttgagtttgtggttttattttcgaataaatgctggaatttttatatgattttgaagtcgaccgcccttataagttttcggtattattgcgtgatgaaatgcactaaatatgagaatcttacaatttcatgattttttttttgtattgttattgttgtgtgctggtagtagctacagaaattaaactgctgcaaaacatctttgacttgataagtcttaagaaattgttttgagctggttagatttgttaaatggaatatgatagggcggtgtatactagatattccgtgtcgagacgtttgtgtaatgtgctatttgtgatccaactggttgatttcgaagatgatgctagagtttcatgatgtcaatcccaacaggctactttatatggtagtacaaattgttctgtcacagaaaaaatggtctcatcatagcaaacaaataaatcattactttctgctacaaaaagtaaatgaacaatgatcatgttattgcaaaatctatagtgatcagtacatcatttacattggccaaaaataatagagcgtatttttctggggtgagtgacacgagagggagtgaacggaaagctgggcacacgtggcaaaggggggttgggaagaagaaattaatagagcaaatacagaaatctattattgatgaatgattaaattggtccctgaatatcaagtttgattttgggtttctgaactgtattcattttttctaactagagtacaataattagattcaaattgaattgaaaataagaaattatcaactggttaatcaaaccaaaatgatcatagatgaattaaacctcagcactaggagatactattgggaaatttatgatattttgatgtggatatcgaaactgctcagtcaaagaattactgctgttacttaaaggctagagtaattttatttgttaacatcacgttttaaataattgtatccagcccaaaagatttcaaaattcttttaattaaaacaattccaaccattttctcgtgttcttgttcctcgtatatcattttatagaatttacatgtttttattctaatcatctttctcatttttcattcactaaattaaattaactataagtgataatattttattatgaatattattattattattattttattattaatatattaatttgtttacattatttatattctacccaattaaaagaacaattaaaaaaagtaaataattatgatctcttcaagttttgtactaatagactagtatcttcttatgttttttcaatacaattaatacctccttatgttttgcttccattaaactgctacatccttatgttaaaattctttatttttacatccaaattactaatatttagacaaaattaccctttcattcattattcatttatcttatcttcaaattggacttgctattttgctgtgatgtgcctaaaggagaggtgaattggggatttatcaagaaattgaagttatagtgattttttagaagatgcttataaaatgctacatacggaagtccatcacttgaatcactagaaataagtcgggtttgatcagtttgtcatcgcttcaaaatccttgaaaatgttaatcttaaacacaactgaagttttgtgatagaaatttcatgtccaaaccttgaggaactaaaactaaataatttgaaccataaagcttcgatattgatgacactagatattcttgagtgggtttgagtgggttagaaatgtgaagaagctaagattactggagcttcattttatagaggtaatttaaaaagaaatcatttcgttttttcgttcttagcggtaagataggacattatataaaacaccaaattctttatgttagtaattttaattgaacacttgtatttccattgacaaaagacaagtaaattttcaagacactattaagttttgacattgaattacagcaacatctttctgatttccattacttatgtttgaaagctgaaagtctaatgaactgcaatttgcaaatggccgactttttattacgataacttttacaagtaatctgttagaattgaatttacaaatatgtttcatgtaaagaaaataagataaatgaataaataatggaagggtaagtttggccaaatatttataatttgaatgggaaaatatagaattttaacgaaagtatgtattaatagttggtggaaacaaaacacatgaaagtgttaattatattaaaaaaatatagagaaatattaatctattactgcaaatttcggagagattataattatttaaccattaataaaatggttttgttcctttttcactttaaatgtcacttatagtatattattgctaatgtgtacacatcaatatcattatggttgacaattatctccacaacagtagatatatttgcaactagggctgtaaatgagtcaaattattcgtgagctgctcgatgttcggctcagtcaaagctcgttcgagctaggttcattaatgtttgtgaacaaaatttcaaactcgttannnnnnnnnnnnnnnnnntgaacaaggggatactcggctcgaaagctcgtgaacaagctc

SEQ ID NO: 84 - DNA, 1783 bp, Festuca arundinacea
gacgccgggagcattgatgatggcgttgtgggcattgtggatgctaccgaggggaatgctggagagcagcctgagcaggaggttgctgaattggctcccggattgaaatctacagaagaagaagaatatgctggtcttgaatttctcaaacccaatgctacagaagcagaaggtactggtcctcaacttggcaattctgactctgatgcaaaagataacatgcccgagcatgaacttgccacacatgctgaagatgccagtcctgagcatgttgccacaattgagcttgcggaggttcataccaatgttgatagcccacatctgtatgctgatggtcagagtaaggtaggccaggaaactcatggtgattatgaagcttctgacgatcctgcgtccgcaccaacctttgggactggcaatgctcaggaatttcttggaaaggaaactgaggacaatgagcctgcttccaagggcacacgctttggtttggatgattcagacgagggccagttgagtgatgattatgaagaggaggagttgagtggaaaggatattgagctgtttgattatgaagctttagctgagcttctgagggcggccaacacatcacctgcacaaggcaaggccaaggtctttccatttgaaaattccgagtccgtgcaaccttctcctaccgtggtcagcgttcctaggacaagcgtggcttctgctcctgcgccggatatggttactgacccggagagtgcgatgactgatgaggagaggaagttgtacgcaaaggtggacatggcacgcatcaagtatttatgtcttgtgcatagattagggtatgacaccgaacatcgggtgcctatacaagtgttgtatcggcttagtcttgttgaaggcttcaggcgcataaggatggcagaccattcctcggagcttgagaatgcctggaacagggctttgcagcttgaggcggagggaatagataacttggaattctcctgcaatgtgttggtccttgggaagacaggggtggggaagagtgcaaccataaactccatctttggcgagaataggtcaaatacgaatgcttttctgcctgcaacatgtaccgtgaaggagattgctggagttgttggtggtgttaaatttcgtgttattgacactccaggacttgggactacagttatggatgaaaaatcaaataggaaagtgctcaagtctgttaagaagtacatgaagaaatgcccgcctgacatcgttttgtatgtcgatcggatcgatacggaacggcagggtgcaaacgacctatccctaatgcgatgtatgaccagtgtgctaagcctatcaatatggcagaaagtcattatcactcttactcactcagcagcagatcctcctgaaggacccagtggctccccaatgaactatgagatggccgtgaaccatcggactcgtgcgctgcagcaaagcatccggcagactactaatgacgcacggatggagaatccagtggctcttgtggagaaccatcacctttgtgagaggaatacggagggtgaaaaggtgcttcctgatggccttatttggaggcgtctgctcctcctcctatgttactcattgaagacggttgctgagattgatagtctttcaacccgccgtgctgcttctgcaagcctctttggtgtccgtcttcagattcctccacttccttactttttgtcatctttgttgcaatctagagagcaccccaggcatgcaagcgaacagaagcttgaaagcgtggactcaaatg

SEQ ID NO: 85 - DNA, 1476 bp, Festuca arundinacea
tgggtccaagtcaacaaggacaagagagaattcagcattaatttggagtcctcaatatcagctaagcatagcgagtatgcttcaacccttgcaggctttgacatacaagccatgatggaccagcatgcttacactctcagaggggaaaccaaattcaagaatgccaagaaaaatgccactactggaggtttgtccatgacttcagtgggtaacaccatggtgactggagcgaagtttgaagacaagttttcagttggtaattggttaacactgatagcaaacgctggtgctgtgtccatgaaaggtgatactgcatacggactgaatatggaagcgaacctgcttgaaaaagactatcccatgggtcaaggtcttgcaactctgggtgcatccctggtaaggtggcataaagaatggactatggctgcaaacatggattcccagttctctgtcggaaggacttcaaacatggcagttcatgttgatatgaacaacaaactaactggacgagtgagcatcaaggccaacagttcagaacatccgaagattgctctactaggtatcttttcggtggcaatgtatctgtggaacaggatgcatccttgtgcagatcctgattatgagtagcaccggttagtagttagcactgtagttttgatttcctaacatttttattatgttacttgtccctcttgttccagtttgtagttctattaaactgcagcttcttctgttacttatatctatttgttttcacatagctgtaaaatttatgaacatgtatgtgctaaataacactgagtacatgcccacgtttttgttgctcatgctggcgataccagttctggttatgctaaatagtcctgttatgtattcatgaaaagttggccatgtcgtcgtggtcgtgtaactatcttcctgttaagataccagctctggttatgctttggttctgtagcctttcattcattgtctaccagattatcccacatatatgcttaccaagaccgcacagattataccacatatatgacgaatttatgcgtggaagtaggcagtccagtcttatttatgcaatgggctagaatcccttccaaaaatacaagggcaacctagccatgcccatgacttgtcctggaggcaatttcaggtcaatgacgcgttgccgcgtatacctgaaattgactgcattgacggttgtgtgaggatttctctcgctggcatttcatgggcgctatggttggtgggtgagtgaagtgggtgcattgacctgttgcattttcctaccctccctcttccgaccctctccctctgacaagcagtggcgacacatgggcctcaaccagaagccagcacagctgagcaggcatactcagagaggaggtaacgctggcagaatattgctggaggtgacagatggatcaagctatctgaaatgttaaggtaaacatagcgcagatgctattagaaatcaaa

SEQ ID NO: 86 - DNA, 902 bp, Festuca arundinacea
gaccagggtggtaatgaaggagattctgatattgatttggatgagtattctgatatagaacaagatgaagatgaagaggaatatgatcagcttcctcccttcaagcctttgaccaaatctcagcttgcaaggctctcaaaagagcagaagaatgcttattttgatgagtatgactacagggtcaaacttctgcagaagaaacagtggaaggacgagctccgcaggttgaaggagatgaagaagaggggcaagtctgatatggactcttatgggtatgctagtattgcaggagaaaacgatcaggatcctcctccagaaaatgtttcagtccccttacctgacatggtgctgcctccttcatttgattgtgacaatccgacataccggtaccgctttctggaaccaacctctactgtccttgctaggcctgttttagatgcgcatgggtgggatcatgactgcggttatgatggagtaagtgttgaagagtcactcgctctccttagcaagttcccaggtactgtggcagttcaggttaccaaggacaagaaggaatttagcatccatctagattcttccatctcagcaaagcatggagaggatgcgtcgtcccttgctggttttgacatccagactgttgggcggcagcttgcgtatattcttcgtggtgagaccaaattcaagagtatcaagaagaacaagactactggaggattctctgtgactttcttgggtgacattgtggcaactgggctgaagattgaggaccagctctctgttggtaagaggctggcattagtggcaagtacaggagcaatgcgagctcaaggggatactgcttatggagctaacttggaaatgcgcttgaaggacaaagactatccaattggccagtccttgtc

SEQ ID NO: 87 - DNA, 3756 bp, Ipomoea hederacea
agtagtggggatactgtttctaaggatgagtttgtaaatcctgtgagtgaagggggggcagagggaaacaatgtgaaaagtcaggaagtggaggaagataagtcagttgaggcttcgagtgtcgagacttcaactaatgttttggaggatactactgagaaggttgtgcctgctcctgaggttttggtgaatgatgatgttgagaatcttaacaatgttggggccttggagggtgagaagattgttgacggtgatggagctttgttggatgaagaattgaggagtagaaaagaacccgagggctctggttctagtgttgacaatggtttccccaattcaactggcattaatgagttgaatggaagtgctagtgaggttcaaccagatgagaagtttaatgagtttgtgaatccttcaagtgaaggggactctgtcgtgcataacgacaaggtggaggaagttaatttgaacggcgaagagggcgacacaattgtggaagccgtaaatgttaatctttcagaggaaggggttgttattgttggggaagaaagaaaggatgtggaaaagcaggaggaggtcccagttgtcgagggtgtggcatcaatcaatggaactgatgaaatgaagcaacttatcgaagatgtgactggtatgacagtaagtgaagtagatgacctgatgactaaatctgaagcgtgtcttaatactgaaactgttaaaccaaaagttaccaatcttgatgtgtctgagcattttggcgaaaatataaatgatactagaagtacagaactagagaagcagccagataaagaaacagatactatacacagtaatggcgggcttattagcattcagagtgacatggaagatgaggtttccagagttgatgagcaaggctcaaaagttgatgcccgggaaataccaggaggtgaagatgacaccaattatcagataaatggagatggggacctagaagaaggcgtaatttctgatcaggaatcagatggtatggttttcggaagctctgaagcagccagacagttcattgaggagttggaaagggagtcgggtcacgttcctcattcaggaggtgaggcttcacgtgatattgagcagaggattgatggacagattgtgacagactcagacgaggaggtagacacagatgaggaaggggacgggaatcaaatgcttaattcctctgccttagccgctttgttgaaagctgcaacgggtgctgaccctaatggtggaagtatcacaataacctctcaggacggatctaggctattctcagtggagcgtcctgctggtttgggatcatcactccgttctctgagagctgctcccccatcaaaccgttccaatctttttactcccacactttcaaatagctctgaatctgagagcaacttgactgaagaagaaaagaagaagcttgagaagctgcagaacatcagagtaaaattttttaggattgttcacaggttgggcttctcctcagatgaatccatagctacccaggttctgtacaggctgtcactcattgcaggaaagcaaaacagccaagtctttagcttagatacggccaggtcaacagctctgcagcttgaaaccgaggggaaagatgatctagacttttccgtgaatatactagttcttggaaagtctggagtgggaaagagtgccacgataaattctattcttggagaagagatggctccaattaatgcatttgcacctgcgactaccagtgtgaaagaaatatgtgcaagtgtagatggagtcaagattcgggtctttgacacacctggtctgaagtcctctgctatggaacaggcttacaaccgcagtgtcttggcaacggttaaaaagttcacaaagaagaatccagtagatattgtcctctatgtagatcgattggatgcacaaaccagagatcttaatgatctaccgctactgaagactatcacgagctcccttggctctgctatctggcgaagttccattgtcaccctgacacatgcagcttctgcacctcccgaggggcctactggttctcctttgagttatgaggtgtttgttaatcaaagatcacgtgttgttcagcagtccatcgggcatgctatgggagatctacatatgatgagtccaagtatgatgaatcccgtttctctcgttgaaaaccatcctgcttgtcgaaggaatagggaggggaagaggatactacctaatggccagatttggaagccacagttacagttgctatgctattcaatgaagatcttggctgaagcgaattctctttccaagcctcaagatccatttgaccaccgtaggctatttggtcttcgtgcccgctcaccgcctcttccatacatgttgtcttcaatgttacaatcacgtgcccatcctaagctatctgctgaacagggcggtgataatgtcgattccgatattgacttggatgatttgtctgattctgatcaagaaggagaagacgagtatgacgagcttcctccctttaagcctctccggaaagctcaaattgcgaatctcagtaaagaacaaaagagggcatactttgatgagtatgactatcgagtgaaactcctccagaagaagcaatggagagaagagttgaggagaatgagagagatgaaaacccgaggcaagagtgctgctgcacttgaatatgacaacaatgacgaagatgccccagctcccgtggccgttccgttacctgatatggtcctccctccttcctttgatggcgataatcctacattcaggtaccgattcttggagtcaacatcacagtttctagcgaggccagttctagatacacatggctgggaccatgattgtgggtatgaaggtgtcaacgttgaacacagtcgagcatttgcaaatcgtttccctgcagcaatcactgtccaagtcaataaagacaagaaagatttcactataagtttagactcttctgtttctgctaaacacggagagaatggatcaagcatggcaggttttgacattcaaaacattggaaagcagctcgcatatattgttcggggtgaaacaaagttcaagaatttgaaaaagaacaagacatctggtggagtatctgttacgttcctcggtgaaaatatagtaactgggcttaaggtcgaagatcagatcacttttggcaggcagtatggtctggttggcagtgcgggcgtggtcaaatcgaagcaggatacagcctatggagccaatattgaactgcagagaagggaagcggattacccaattggtcaggttcaatctacggttagtatgtctctgattaaatggagaggggattttgcaatgggattcaacggtttggctgaattctctactggccgtaattcaaaggtggctgttcgggcaggactgaacaacaaactcagtggccagatctcggtgaggactagcagctcagacaatctctctcttgcactcgcaggcatccttcctgtcgcagttgccatctaccggaagctttatcccggtgctgctgagaattactcaatctactagatcccgcttcattggtactcgttagtttacattagtgttttcctctttacaaataattgctttatcttcatttaatctaggactgctgagcagctgctcctactaagttaagattatttgtcataataagtacttatgagtcaagacaatcatcatacttttcgctgctcctcttgatgattatatccattt

SEQ ID NO: 88 - DNA, 9158 bp, Kochia scoparia
gcaaaaaacccatcaattaaaaaatgaccctttaaagtttcgaattctctcatgtcaagaagagcaacaacagaacaaacccaaaacttcgattaacagaagagaagtggttttgagaagcagtgagcttgctacacttggagctatattccatttcaggttgttcgtttttattaacttcataaatcccacctttttttttagaatgattgattacaagtaaaattagctcaaattggattcaagtaatctttaattgattttttttttctttctgttttggggttgtgaaattgaacagtggaacaaaaccaagttatttgggagtgcaaaagaacccaccttcattggctttgtgtccagctactaacaactgcctttccacttctgaaagttcatctgatctcaaccattatgcacctccttggtaatttttaacttgttttcttttactttctgcaattttcagattgtacttttgaattggatttaatttgcatatataatagcttcaatgctgaatggtgattggagtgttgctggctttttcattggcttttggctgtattttcgttttcgagtagatgaaaaatatgtttggcaaatgacttatagttgaaggaaaatggagtttacatggctgttacacattgtctcaatgatcaatgtagcttgtttgatttcaacaatctgtaattggaactcttacaactgattttcatgattgcagttagatgtataaaatgtataatgcaaactgtttaactgtcaaacaaatgtataatgtatgaaacaggattggatggtccattctgaatggatgatcaggattcaggaaagcttaaatgggttgaaagagggttttgtttggacttaaagctttttatagcctatgtcttagttaggaatggagaagtagaagtgaagaggtcctgaggttatgagaattgagaaatccgatcccttttgaacaagttgcccgaggttttacattaggtcttgctctagataagaatcctaattgattttagtttccatgtataatatcctcaacggtgattgaattgttgctggcctattcatcaaatttcgattgctctttcgtggtcgaagtaacaaaaaatgtgtttcgtaaacgattttatagttaaaggaaaacgggttttactagctgtgtcgcttaggtaagattgagttaggctagcttgtttgatttcaacacattgtaactctgtaattgggactctttacaatttatttatgtgattataatgcaaatgtatcagacaggaatggatggtccatcctcctaaatggatggtttggaaagctcacgaggatcgaagagggggttgtttggattttaagcttttcataccctagggcttaagcccttaatcaggaaaaggggaaggagaaatgaagaaggtctaacatgatgagagtttgagaaatttgatcacttttgaacaagtttcctgaggtcttacattaggtctcagtcttgatatgaatcacgattctaaatgctgatgggaattgtgacaatatgcaacacaggaactacaatcctgaaggagggagtaggggcaaaaaacctgttagtaaagaagtagcgatgcaggagcttcttgaagttgtaagtttcttttacaaaacactattgattacagagtactttccgtatttgtgtttttctgtgaaattaagcagtatatgttagaactgcagcttcaatcaacaaagccagacaatttcactcccaagatcacggagaagaaagatgattatgtgcgtgtggaatatgaaagtcccataatgggggtaagtttttgagcacaaaatgaacaaattatgccactcgatttgagcatgagaaactaatgttgacttgcataatgtgtgtgtagtttgttgatgatgttgagttttggtttccgccggggaagaagtccattgtagagtatcgttctgcatctcgattggggaattttgatttcgatgtaaaccggaaaagaatcaaggtcaggatacaatctaccttagttgcatattttgttcatctgatttctacttcagggaaaaatagattcaatcaaattctccttccgatatcaagattagagcggttctaaatgtatggttgttcatggttttatgcagacactgaggcaagagctggagaagaaaggatgggcttcagagaaaacttattaatcgtagttcctcaactcacattgtgtccatttcactcctccataaggaataacaattaaaatggaatagggaagtgcattctaattgttacaactacatctaattgtagcttcctcttttgtgttgtacttggaatatttttctcaatcatgttttccgattttgcatgtcaaggaataataaatgttgattcttctggaaaacatgtgttttggctgaaatccttgactatctgtagaattccagcgacagcaatttcaaaagtttcttcaattatattgaatttattgcgcgcaggatatatataacctggcctctctgatagctaccacaacatcctgagaaatctgtagcttaacctcttcaacacttgtagcctcactttatattcactgcacctgtattgtggtatgtaaaccaaatacctgaaaaatgccacaagttttggggaagaaaagagtgatataccaaaccaatgaggcacaaaatttgaatgcatttgcccttgcgtttgaatctgcaggagttcaccaaaaagaatctgacattgtaaatgctttgatctgattagggttgttgcaatttaatgaatcacagggcatatatcttaccagttgctacgatttatttgaagctttctaccagactgattagatcccctgtattgaggtaaaatgagggcgtatggcccctgcaaacgcaaacagatgagctatttcaggttttcagcccttttaccagactgattagatcccctgtattcaaggggtggagtaaagtcaggtatggaactgaataaggacgcgattcaagtactagcattgttgcttctacgatttttgacttcgccttgagattgccacccccaaacaggattaatgtaggttggattctgaaaatccaagtccagttccagtatgcactggtgaatagcaattagcatgccaatatcccgctgatgacagagttgatgatgtgcgaaaggaacagcttttcccaccattttcgacacacggggagtgaattgaactgttttgagggtgtttcacattaatacatcatgttgctcaatccctatctctagtaaaatttatcaacattttacaaatctctgcctcggagatcatgaacttcaactcttcaagggagtaactcctttaaaacggatatggcagaaattatcatagttaccgaagttgcataagagcctaagaggttgatgttgtattttacagaatctattactccccgtaaccaaatagatgcaaaactattcacgacaagacacttatcactaattcactatatgactacgtttcaattgcaattttaattttaattacttgtagaaaccactaattcctagaatagtgctaacaaacaaaacaaatcaacaaattaaaacaactccaattgattcactctaattgacaaaaatgacaaaaatgtaattcgattaacaaaaacaaacatgactagacaaattttttttttaaaaaaaatatcatcatcaacatagaaaaaagggccaaaaagtaagcctcatttgtgtcaaacgcacaatactcaaaccgcagaggcccaaaaacccctcatacttaatccataaaccttatcattctatcatcctctttcttctctcatccttcaaatttctctctcttttttttcataccatcacggcatcactcaacaaccaaaaaccccactaaatataattgcataaaccttaaatttaatttcccttttcaattttattactctttcaatcatttttgattgaagggtatcattaattgatacgaaaagcttgggaaaaaaggctgctatggcgtctgagagttctccggttcttgctcgccaaccctcaggtattagagctgtgccttctaatgatgatgatgatgattttgatgctaatttagtttatgataatggtaatgattatgataattctgttgatgaaggtactaatattgatgaaacgaataaaactttgagtgttagtaatgacaattcgattaatggtagcagtagcaataatagcactgaaagtagcagtagttttggtagtgggattaatggaggtttggtgaatggtagtgggaagggtggtgatgatgacgaggtggagattgaggatgttgtggatgatccagatgaagaaacctcagaaaataaggtgggcggtgccaagaatgaggtttctggtggtgggtctgtggggggctcggccggtgtgccggttgcgaaagtgtcgggtgagggtgatgatgatgataacgaggtagtgagtggtgaggaggatggtgctcaggtggaggagtcatatggtgtcaagaaggatgttcccaaggttagggtttcagttgaagaagaggaggatgaggaagaggaatggggtgaggcggaagaggggccgaagggggagacacctaaaggcgatgagggggaggagtttgatgaggcggtggaaggaccgaaggcggagacacctaaaggtgatgagggtgaaggagagaaacctggggaggtggaggagggggcgaaggctgagagtcctaaagatgatgagggtgagggaggggagtcatcagaagctgtttctggtgatggaaaggccgagggatatgagggtagtgttgtggattcgattaagctggatgttggtgaagccgtgaggtctaaggttgctgttgttggggtggatgaaaagcaggagaatgagcctgaacctgcgggggagacctctgttgatgagcaatccgttgagggggatttggcaactgctgaagatgacacggtggtgtccgctaatgaggaggggaattctgttaagaatccttcttatgctgatgttgtggggatggagaaagagcagaaggacgagtctgaacctgcaggggagacctctgttgttgagcaatccgttgagggggatttggcagctgttgaaggtgacacagttgtgtctgctgatgaggaggcaaattctcttaagaatccttcttatgctgatgttgtatcacatggtgctgctgccgaagataaaaagttaatgaaggagtcagaggttggaggagggattgaggataacccccctgctgatgaaactgcttctgcagattctgctactgatggtgatgttggggttaagtacactgacatgggggatgctattgtggattctgtaaatgttgatgctgctgaagctgttaggtcgggtactgctgttgttggggtgtcaaaggaaacaaaagattcaggagctgaggaggaaacttcttttgttgaaaatgctgctcaggtggttgatgattctgcacccgaagactccaagctgactggcactgatgaagtgaagtctgctggtgaggaagactccaagctgactggcactgatgaagtgaagcctgttggtgaggaagactctgttgtagatggcatagatgtcaatgttgttgaggctaggaggtctggcatagctgttgttggggactctgaagtgcatgaaactgaaccagaagcaaaagatgctccagctgctgtcgctgaaaatgtgacattggccaatgaatttgtgccgcttgctgctacaagttcatctgaggtgagtactgactatatactacgaagtatatgtttgatgaatatcttatcgataatgttgaatttgctgagcctgttttgtgtatgcagattgatgttgatggcgaacagcaaaaggagagtcaaagtaatgaagcagaagcaccacagcttgcagagagtgtggagcaacaagatgcagaggagactaaacttgaaactgatttgcaatccaaagagcaagagcacactgatgagcagcagtttgattctggtgaagtgaatgagaaggctctgccgccggctgatgtcccagatacaatttctgctattcctagtttagctactttagttgatgctgaagatgaagagcttggaccacaagaggaaggcgatgctgaaggctcaggtacagatgaggatggtaagcttgtttattttggaagtgggggttcttctaacaagactacggaggagttagaatctcaagatcgttccgagatgattgatgatcaggttatcatagactcagaggatgaaggagaatctgatgaggaaggggagggtaaggagctctttgattctgctgccttagctgcccttttgaaggcagcaactaattctggctcagatcctggcaccatcactataacatctcaagatggctctcgccttttctccgttgagcgccctgctggtttgggaccatctctccgttctgtaagacctgcatcaggcccaagcaattccaatttcctttctcaatctagtgctgctgctccgtcagaggaggaccttagtgaagaagagaaaagtaagctccagaaattgcaacagttgaaggtgaagttcttgaggctggttcaaagggttggctttacagcagagcactctttagcagcccaagttctgtataaattatccttttttggaggaagagctgcgtttcctgccttcagtcttgataatgcaaaacagacagctatgcagcttgaagctgagggaaaagatgatttgaagttttcattgactgtattagttattgggaagaccggtgttggcaagagtgcgatcatcaattctgtattaggagaagagaaggtcaaaattaatgcgtttgaacctgaaactacttctgtgactgagatttgtggaactgtggatggagtcaagatcaggttcattgatgctcctggtctcaaatcttctgctatggatcaaggttacaatcgcaaagtcctagcatccgttaagaagttcacaaagaaaaatcctgttgatgtcatgttttatgtagatcgtctggactcacagacaagagatctgaatgatttacccatgttaaggacaatcactagttcgcttggttcttcgatttggcggaataccatcatcactcttactcatgcttcttcagcacctccagatgggccaactggcactgcattgagctatgaggtatttgtggcacagcgtagccatattgttcagcagtctattggtcaagctgttggtgatatgcgtttgatgaatttaaacatgatgaaccctgtttcccttgttgagaaccatcctgcatgtcggaagaacagagaaggccaaaaggtgcttcctaatggccaagcgtggaggccacagttattggtgctgtgctactctgtgaaaatcttgtcagaagcaagttccaacgctaaaccgcaggatccttttgacagccgaaagctctttggtttccgtgttcgttctccaccactcccatatctgctatcttcactgctgcaacctcgtgctcacccaaaactctcagctgatcaaggtggggacagtattgattctgatgttgacctggatgacttatcagattctgatcaagaagaagaggaggatgagtatgatcagcttcccccatttaaacctctgaggaaagctcagatggctaagctgagcagtgggcagaaaaaggcatactatgaggagtatgattatcgtgtaaagcttcttcagaagaagcaatggaaagaggagctgaagaggatgagagagatgaagaaggggaagagtggtacaaatgcttatggtgaggtgccacaagattatgatggtgagaatggagatggtgataatggggcacctgctgctgtcccagtgccattgcctgacatggttttacctccatcttttgacagtgataacccagcttatcgatatcgtttcttggagccaacttcacagtttttggctaggccagttttggacacccatggttgggaccatgactgtgggtatgatggagtcaatgttgagcagaatctgggaattgcacggcgctttccagctgcagtgacagtgcaagtgactaaagataaaaaggactttaatgtccatttggactccgcagtttcagctaagcatggtgataatggctctagcttagttggatttgatgttcaaagtattggtaagcaatatgcctatatcatcagaggggaaagcaaattcaagaacttgaagaaaaacaagacagctgcaggagtaagtgttacatttttgggtgagaatgtggctactggagttaaacttgaagatcagattaccttaaacaagaggctggttttggttgggagcactggaactgttcgttctcagaaagatgctgcttatggagctaacttggaagtacgactcagagaagcagattttccaatcgggcaggaacaatcttcatttacactatcgttgatgaaatggagaggggacttggcagttggaggcaaccttcagtcccagatatctgttggaaggaattcaaagatggctcttcgtgttgcattgaacaataaacaaagtggacagatcacattgaagacaagcagctctgatcatatctctcttgcgtttgctggtcttctgccgattgcaatttctatctatcggaaattgaggcccggtgtcaacgagagctactctgtctactaaactactacaatttttgttttccgttcttttgcttttatagtgggcaatacattatgatgttttcttttgtttccttgagcttcctgttctctttttcaatgaggcgtcgtttcagtattgttagcttttctgcactttcttccgaggttattttgatctccaggcgattattctataaatatgagtatcaaagtggccttttgttagttgcatttctttctactagtcacttttctgcgtttgaggctgacctttatgcagatgtaccgccctagcgctcatgtaagttttctttgcatcatagatgtgaggatgggtttctcaaaacgattgagcaataatgcatattttgctgaacttgctgctgcacatttttc

SEQ ID NO: 89 - DNA, 304 bp, Lolium arundinaceum
tgtgtctggcttgagcagttcaagagagtacactaatagcatggatgggcagattgtgcttgatgattctgaggatgatgaggatggcgacgataatgaggatgatgatgagaaggggtttgattctgctgccttagccgccttgcttaaagcagctactggtgcatcccctgatggaaacatcacagtttcttcgcaagatggatctagaattttttccatggatagacctgctggtctgggctcgtcagccccatctttgaggccaactgcgccacgacaacctgcccggtcaaacctcttc

SEQ ID NO: 90 - DNA, 2296 bp, Lolium arundinaceum
acgacaacctgcccggtcaaacctcttcagcccctctgagctagcagtgactgctgagccaaatgacgagatgacagaggaggagaagaaattgcacgacaaggttgagttgatccgtgtaaagtttctgcgtcttgtgtataaattgggggcaacccctgaagaaacagtagcagcacaagtgctgtaccgtctgagccttgctgagggtatccgacatggaaggcaaacaaacagagctttcagccttgagaatgcacggaagaaagcaatacagcttgaagcagagggaacagaagatttgagcttctcatgcaacatacttgtcttaggaaagattggggttggcaaaagtgcaactataaattctatttttggtgaagagaagaccaaaactgatgcttttggtgcagccaccaccagtgtacgagaaattgtcggcaatgtagatggtgtcaagatacggatcatcgatacaccaggccttcggcccaatgtgatggaccaaggaaacaacagaaaaattctcgcatccgtcaagaaatataccaagagatgtccgccagatatcgttctatatgtggaccgccttgatagtctgagtcgtgatctcaatgatttgcctcttctaaaaaccatcactgctgttcttggttcttccatatggttcaacgctattgttgctctcacccatgctgcttctgctcctcctgaaggccccagcggtgcccctatgacatatgaggtattaatggcacagcgatcccacattatccagcaatccatcaggcaggctgcaggggatatgcgactgatgaacccagtagcccttgttgagaaccacccttcttgccggaagaaccgtgagggtcagaaagtgcttccaaatgggcaaagttggaggcaccagatgctgctcttgtgctactcttcaaagatattatcagaagccaactcacttttgaagcttcaggatccttctcctgggaagctttttgggttccgcttccgttccccgccacttcctttcctgctatcctcccttttgcagtcaagagctcacccgaaactttcccctgaccagggtggtaatgaaggagattctgatattgatttggatgagtattctgatatagaacaagatgaagatgaagaggaatatgatcagcttcctcccttcaagcctttgaccaaatctcagcttgcaaggctctcaaaagagcagaagaatgcttattttgatgagtatgactacagggtcaaacttctgcagaagaaacagtggaaggacgagctccgcaggttgaaggagatgaagaagaggggcaagtctgatatggactcttatgggtatgctagtattgcaggagaaaacgatcaggatcctcctccagaaaatgtttcagtccccttacctgacatggtgctgcctccttcatttgattgtgacaatccgacataccggtaccgctttctggaaccaacctctactgtccttgctaggcctgttttagatgcgcatgggtgggatcatgactgcggttatgatggagtaagtgttgaagagtcactcgctctccttagcaagttcccaggtactgtggcagttcaggttaccaaggacaagaaggaatttagcatccatctagattcttccatctcagcaaagcatggagaggatgcgtcgtcccttgctggttttgacatccagactgttgggcggcagcttgcgtatattcttcgtggtgagaccaaattcaagagtatcaagaagaacaagactactggaggattctctgtgactttcttgggtgacattgtggcaactgggctgaaggttgaggaccagctctctgttggtaagaggctggcattagtggcaagtacaggagcaatgcgagctcaaggggatactgcttatggagctaacttggaaatgcgcttgaaggacaaagactatccaattggccagtccttgtcaaccttgggcctgtccctcatgaagtggcgccgcgacctcgcccttggcgctaacctgcaatcccagttctcgatcggaaggggttcaaagatggcggtccgccttgggctgaacaacaagctgagcgggcagatcaccgtcaggacaagcacctcagagcaggtacagatcgcgctgctgggtcttgtcccagtacttgcctccatctaccggagcatctggcccagcgaaccatcgtttgcttattagcttggcaagaagagcatctatttgtgtcgtcagcatctttttttatttttcctaatttatttgaac

SEQ ID NO: 91 - DNA, 1092 bp, Lolium multiflorum
caaaaagccagccccccgcaggattcttcttcgagaccaagcaatccttcccgtctcccccgacctctccccttcctgctacttcccctcggcccctcttttttcgcaatgggtggaagcaactatgatgacgactgggtgttgcctagtgctgacatcacccttgttcttgttggaaagcttggctacggcaagagtgcaactggcaatagtatccttggacgggaagcatttgtgtctgaatactcccatgctagtgtgacaaatacttgtcagatgggaagcaccactctgaaagatggccgcaccataaatgttattgatacaccaggactatttgacatgactgtaacacctgaggatgctggtaaagaaatcgtcaagtgtatgaacatggccaaagatgggatacatgcggtgttgatggttttttctgctacaactcgattttctcgagaagattctagcaccattgagactattaaagtgttttttggagagcaaattgttgatcacttgatcctggtcttcacctatggagatctagttggtgaaactaaattgaagaacatgctaagtaatgccccggaatatctgcagaaagttgttgagctatgcaaaaatagagttgttctttttgacaacaagaccaaggaccgaatgattcaagctaagcagctggaaacgttgcttgatgtggttgattctgttagtgcaaataatggaggaaaaccatttacagaccaaatgctcactcgcattaaggaggtgcatgatagagaaaaggaggttcatgatgccatgggatattcagaggagcagatatctgaattgaagaaggagatccacagaactcgtgatgaacaacttgcaaacattactgccatggtggaagacaagctaaactgcacggtggaaaagctgcaatgccaacttatggaagaacagaacgcaagattagaagcagagagggtggctgcagaggccaggatgaaatcagacgaggagatccgtcagctcagagagcgccttgagaaggcccaactggaaaacgaggaattcagacgattggctaccagtaacaagtgtgct

SEQ ID NO: 92 - DNA, 479 bp, Lolium multiflorum
atgatgaggatgacgacgataatgaggatgatgatgagaaggggtttgattctgctgccttagccgccttgcttaaagcagctactggtgcatcccctgatggaaacatcacagtttcttcacaagatggatctagaattttttccatggatagacctgctggtctgggctcgtcagccccatctttgaggccaactgccccacgacaacctgcccggtcaaacctcttcaacccctctgagctagcagtgactgctgagcctaatgacgagatgacagaggaggagaagaaattgcacgacaaggttgagttgatccgtgtaaagtttctgcgtcttgtgtataaattgggggcaacccctgaagaaacagtagcagcacaagtgctgtaccgtctgagccttgctgagggtatccgacatggaaggcaaacaaacagagctttcagccttgagaatgcacggaagaaagccatacag

SEQ ID NO: 93 - DNA, 720 bp, Lolium multiflorum
ttattgaattgatgtccacgtatcttttctactttagagtgactttagaaattgcatcaactctgactggacattcatgatataggtggaagacaagctaaactgcacggtggaaaagctgcaatgccaacttatggaagaacagaacgcgagattagaagcagagagggtggctgcagaggccaggatgaaatcagacgaggagatccgccagctcagagagcgccttgagaaggcccaactggaaaacgaggaattcagacggttggctaccagtaacaagtgtgctattctgtaaagcggttttcttggttgcgtgcggatgctttagtgatttgtcaatagagggcttcagtagtcttaagcctgccccgtaataactgataaattttagcgtctcatctcgtacatctatattagtagtactggaactgtaatgcctgagtcgtactatatactatatataatggttgcagtgtataattctgagtatcatgtgtttttttttgctgtgtcatgaggagagaatgttgcatgtttaattctctgaatagcccccaaattcctgtggtttatacctacagccacagttggaagttgcctttttctttgaaagaaaatacaatcctcttgtgttgtaggagttagcctgggaagctactgaagcaactttgctgccgaacaagagaacccaccgtgcgagctaggccaggctgacgc

SEQ ID NO: 94 - DNA, 205 bp, Lolium multiflorum
gttcaagagagtacactaatagcatggatgggcagattgtgcttgatgattctgaggatgatgaggatgacgacgataatgaggatgatgatgagaaggggtttgattctgctgccttagccgccttgcttaaagcagccactggtgcatcccctgatggaaacatcacagtttcttcacaagatggatcaagaattttttccat

SEQ ID NO: 95 - DNA, 408 bp, Lolium multiflorum
gaccccaagtcgactcccagattattttcttgttttctacttctttcttcccaaacaaaaaggattcttcttcgagaccaagcaatccttcccgtctcccccgacctctccccttcctgctacttcccctcggcccctcgtaagttcatccgatctgcaggtcaattttcggtgcaaatttccttggtgcgtagatgaatttcctgcttgtcccgtcaaacagtaatctcgtttcgttctcgccgactacgtagtcgattggattttttagtttttagtttttagtttcgtgtttctttgattcacggattcagtgattgggtgggctggtagggaatttgtgtgtgtctgcgcgcgcgcgtgcgtgatgatgggggttgcagtaattaggcatctagagtgcagaga

SEQ ID NO: 96 - DNA, 360 bp, Lolium multiflorum
ggtgttgcctagtgctgacatcacccttgttcttgttggaaagcttggctacggcaagagtgcaactggcaatagtatccttggacgggaagcatttgtgtctgaatactcccatgctagtgtgacaaatacttgtcagatgggaagcaccactctgaaagatggccgcaccataaatgttattgatacaccaggtaagaatgcatgtattgaatgtaactactatatcttcgtatttatctaccattcagatgttttgaatttgtgaattctacatactatgttgcatcttgtgtacatatcgatcccacgctttattctctgattatgctgagacgtttgatgcagtatctttagatg

SEQ ID NO: 97 - DNA, 895 bp, Lolium multiflorum
tttaatgggcatggaccaatgtgaactaggaaactagtaaatttatcttccttgctgaaaactactgatccgcaattcagcattatacttctacagattgttggccgttcatgtttattatgttttgctaatcacccatttcaactacttggataggactatttgacatgactgtaacacctgaggatgctggtaaagaaatcgtcaagtgtatgaacatggccaaagatgggatacatgcggtgttgatggttttttctgctacaactcgattttctcgagaagattctagcaccattgagactattaaagtgttttttggagagcaaattgttgatcacttgatcctggtcttcacctatggagatctagttggtgaaactaaattgaagaacatgctaagtaatgccccggaatatctgcaggtatatacttttgcatctttaactcttgaaatgtgcatgaaaggttcttgagcttgcgtgcaaatagttacatttgcatgttctgtctacagaaagttgttgagctatgcaaaaatagagttgttctttttgacaacaagaccaaggaccgaatgattcaagctaagcagctggaaacgttgcttgatgtggttgattctgttagtgcaaataatggaggaaaaccatttacagaccaaatgctcactcgcattaaggtaaataatgatgttgagcgaagtttgagattctcatccctatcctatatttttctgtagttaatgcttacctcatcttgtaggaggtgcatgatagagaaaaggaggttcatgatgccatgggatattcagaggagcagatatctgaattgaagaaggagatccacagaactcgtgatgaacaacttgcaaacattaccgccatggtaagag

SEQ ID NO: 98 - DNA, 900 bp, Lolium multiflorum
ctgctggtctgggctcgtcagccccatctttgaggccaactgctccacgacaacctgcccggtcaaacctcttcaacccctctgagctagcagtgactgcagagcctaatgacgagatgacagaggaggagaagaaattgcacgacaaggttgagttgatccgtgtaaagtttctgcgtcttgtgtataaattgggggcaacccctgaagaaacagtggcagcacaagtgctgtaccgtctgagccttgctgagggtatccgacatggaaggcaaacaaacagagctttcagccttgagaatgcacggaagaaagccatacagcttgaagcagagggaacagaagatttgagcttctcatgcaacatacttgtcttaggaaagattggggttggcaaaagtgcaactataaattctatttttggtgaagagaagaccaaaactgatgcttttggtgcagccaccaccagtgtacgggaaattgtcggcaatgtagatggtgtgaagatacggatcatcgatacaccgggcctccggcccaatgtgatggaccaaggaaacaacagaaaaattctcgcatctgtcaagaaatataccaagagatgtccgccagatattgttctatatgtggaccgtcttgatagtctgagtcgtgatctcaatgatttgcctcttctaaaaaccatcactgctgttcttggttcttccatatggttcaacgctattgttgctctcacccatgctgcttctgctcctcctgaaggccctagcggtgcccctatgacatatgaggtattaatggcacagcgatcccacattatccagcaatccatcaggcaggcagcaggggatatgcgactgatgaacccagtagcccttgttgagaaccacccttcttgct

SEQ ID NO: 99 - DNA, 2004 bp, Lolium rigidum
agcctgagtcagagaatgatgcaagtccagtggtaagtgggtacattcaatataattctgtttcctctggtgttgacattagctgggatttgatcaaatcacatgaaccaaagcaggttactgacaacagtagctttggaagccaggctaatgtggaagatgaggcggcaaagcctgagccaaagggcgatgcaagccatgtggtaagtaggcgtgtcaaatttaattcttccgcttatagggacattaatggggatataaacaattcaaatgatccaaaccaggttattgacggcggtgacttggaaatctcagagaagcttgcccctgtaacctcagacattgtgcttaatgaaagtaatgagaatgcacaaaatgctgagggccaggtggctactagtggaactgtggaagatgttagtgttgagaagccgacagaggttgagagtgttgttgctggcggcactgatgttatcctgtcccgagagttggctccagaacctatcgaggaaaacaatgatgctgcggagaatgaaaatgctgcagaggttattggccatatagaagaggctggtgatgatgacatagttgtagctgcagctggtgatgatcagaaagctgtagctgcagatgatgacgaagaaaagggcggtgaggagaatgaaggtgctccagatgtttctgaccgtgaagtagaggctgttgatgacgagatagttttagctgcagctgatgatgaagacgggagtggtaatgagggtgatgaggacgatgacgaggtgagctttgataggagtcctgcacgagttgcaatcatagagaattctgaagctgcgaagcagatcatgaaggagcttggggaaggttcctccagtggcagtcctgtgtctggcttgagcagttcaagagagtacactaatagcatggatgggcagattgtgcttgatgattctgaggatgatgaggatgacgacgataatgaggatgatgatgagaaggggtttgattctgctgccttagccgccttgcttaaagcagctactggtgcatcccctgatggaaacatcacagtttcttcacaagatggatctagaattttttccatggatagacctgctggtcggggctcgtcagccccatctttgaggccaactgctccacgacaacctgcccggtcaaacctcttcaacccctctgagctagcagtgactgctgagcctaatgacgagatgacagaggaggagaagaaattgcacgacaaggttgagttgatccgtgtaaagtttctgcgtcttgtgtataaattgggggcaacccctgaagaaacagtagcagcacaagtgctgtaccgtctgagccttgctgagggtatccgacatggaaggcaaacaaacagagctttcagccttgagaatgcacggaagaaagccatacagcttgaagcagatggaacagaagatttgagcttctcatgcaacatactcgttttaggaaagattggggttggcaaaagtgcaactataaattctatttttggtgaagagaagaccaaaactgatgcttttggtgcagccaccaccagtgtacgagaaattgttggcaatgtagatggtgtcaagatacggatcatcgatacaccaggccttcggcccaatgtgatggaccaaggaaataacagaaaaattctcgcatctgtcaagaaatataccaagagatgtccgccagatatcgttctatatgtggaccgtcttgatagtctgagtcgtgatctcaatgatttgcctcttctaaaaaccatcactgccgttcttggttcttccatatggttcaacgctattgttgctctcacccatgctgcttctgctcctcctgaaggccctagcggtgcccctatgacatatgaggtattaatggcacagcgatcccacattatccagcaatccatcaggcaggctgcaggggatatgcgactgatgaaccctgttgcccttgttgagaaccacc

SEQ ID NO: 100 - DNA, 2410 bp, Lolium rigidum
gatatgcgactgatgaacccagtagcccttgttgagaaccacccttcttgccggaagaaccgtgagggtcagaaagtgcttccaaatggccaaagttggaggcatcagatgctgctcttgtgctactcttcaaagatattatcagaagccaactcacttttgaagctccaggatccttctcctgggaagctttttgggttccgcttccgctccccaccgcttcctttcctgctatcctcccttttgcagtcaagagctcacccgaaactttcccctgaccagggtggtaatgaaggagattctgatattgatttggatgagtattctgatatagaacaagatgaagatgaagaggaatatgatcagcttcctcccttcaagcctttgactaaatctcagcttgcaaggctctcaaaagagcagaagaatgcttattttgatgagtatgactacagggtcaaacttctgcagaagaaacagtggaaggacgagctccgcaggttgaaggagatgaagaagaggggcaagtctgatatggatgcttatgggtatgctagtattgcaggggaaaacgatcaggatcctcctccagaaaatgtttcagtccccttacctgacatggtgctgcctccttcatttgattgtgacaatccgacatatcggtaccgctttctggaaccaacttctactgtccttgctaggcctgttttagatgcacatgggtgggatcatgactgcggttatgatggagtaagtgttgaagagtcgctcgctctccttagcaagttcccaggtactgtggcagttcaggttaccaaggacaagaaggaatttagcatccatctagattcttccatctcagcaaagcatggagaggatgcatcgtcccttgctggttttgacatccagactgttgggcggcagcttgcgtatattcttcgtggtgagaccaaattcaagagtatcaagaagaacaaaacaactggaggattctctgtgactttcttgggtgacattgtggcaactgggctgaaggttgaggaccagctctctgttggtaagaggctggcattagtggcaagtacaggagcaatgcgagctcaaggggatactgcttatggagctaacttggaaatgcgcttgaaggacaaagactatccaattggccaatccttgtcaaccttgggcctgtccctcatgaagtggcgccgcgaccttgcccttggcgctaacctgcagtcccagttctcgatcggaaggggttcaaagatggcggtccgccttgggctgaacaacaagctgagtgggcagatcaccgtcaggacaagcacctcagagcaggtacagatcgcgctggtgggtcttgtcccagtacttgcctccatctaccggagcatctggcccagcgaaccatcgtttgcttattaacttggcaagaagagcatctgttacttgtgtcatcagcatctatttttacttttcctaatttatttgaaccgtcgcctgtatctgtttcaattttcgtgtcttatccgcagattgttcctatcataattttggctgaagagttgttgtcttattcatgtagaactatagttgaataatgttggtagatctatatgatccttccaccgatctttgtattactattgttgccctccatcttcttgttattatattctgctatgtgcttttgcttagatgcggatgcctctgcttttcgtggtagtgtataatttgcattgagtacttgcaatagtgcaagtgcaacattctggcattactagatctgggtgagaaacagtgcttgctctagaatacaatcatggtcactggcaatcttcagcagggcaaatagtatttgatcctgctggaaggtgaaaactgctcatcagctacttgccgatgccagccattatatacagatttcgcaagtcatcttgtagcagggcatgcttctccgctatttatccagttttacttacagatttaattgataggttgtatactagcctcagcccacaagcatcctaaatatcttcactgcactgacccttggtctgcagtttctaattatcaggatgttagggcaagtcccagcggtaaactttgaaagaacatgctttatgctgatatggtggatctgaccaataaaagtcaatcccaatttgattaattctgctggatccgtatgattctttataagctgttgactgttactactcttaaagtactccgtaccatgcattgcattagatggtatgttttctcttaagcggcatatgctttgtgtttctactttcttttgtgagttggcatgttggccagaagctagtggaaaattctatggaatatgctgaaacctgcatgagattgttgccgagacgaactctcggttgctatctatggc

SEQ ID NO: 101 - DNA, 666 bp, Portulaca oleracea
ccccaggatccgtttgatcacaggaagttattcgggttccgttctcgtgcgccccctcttccttacctgctgtcctccctgctgcagcctcgggcccacccgaagctcccggccgatcagggcggcgacaatgctgactcggacatcgatctggacgatttatcggactccgatgaggaacaggaggaggacgagtacgatcagctcccgccattcaagcctctgagaaaatcccagctcgcaaagctcagcaaggaacagcaaagggcttactttgaggagtacgattaccgggtcaagctcctccagaagaagcagtggagggaggagctccggaggatgcgagacgcgaaacgaggcgggaaggggcccgtgcccggtttggacgagtacggggagatgccggaggagtatgacggggacggtggggccccggctgcggtcccagtcccgctgcccgacatggttcttcccccgactttcgacggggataatccagcatatcggtaccgtttcctggagcccacctcacagttcttagcaaggccggttttggacacccacgggtgggaccacgactgtggctacgacggggtcaatgttgagcagaccctcgggatcatgggccgttacccgggtgcgatctcggtccaggtgacgaaggac

SEQ ID NO: 102 - DNA, 3275 bp, Portulaca oleracea
  unsure (1)..(3275): unsure at all n locations
  unsure (1)..(3275): unsure at all n locations
aaaatctatgatatttagcgtataccctcgattttgtcccactacaatacactttttttttttggaatcaccgaaatacaagttgaaagtagggattattgcaatctaatttgtaaaaatagggattattannnnnnnnnnnnnnnnnntatatatatatatatatcataaaagataaattgaaaatatctatacaaagggctaaaaaagatctagagttgtgtacttgtgcataaaaactagattagattagatatgatagaaggcccaaagccctttatattgccaagaacactcttcccctttccttttatcttacttaatcccttaccttatctctctttctctcttcattcttccttcactccatctccttctccttccctcttcaccatacaaactaaccttcaccaacccctaaaaccctagaaaaccctcccccaaattccacacatactgtgttcagttttctcggattgtcgtcgtcgtcaacaatgcagtcggattctcaggcgccatcgcagactctctccaaacagccttcaggtattcgcgctttgccttctaatgatgatgattctgactccgaaccagtttttgcgtctgagaatgataacaattcccccgaattaacccctgaaagtgacggaaaaagtagtaattcgattgctgcgagtagtagtattgagactagcagtgatagtagtagcttgagcaacaatggtgggagtgatggtggtaaggagacggtgctgaagcctgttgcgaaggtgtccgcggaggaggaggatgatgacgataatgaggttggtggtgatgaggatgaggttgaggttgaatcttatcgtgttgagagtcctccgaaagctagggtttctggtgaggaggatgatgttggcgatgtgaatgatgaaaagaaggttgggaatgatgaaaaggaggttccgaatgaggctaaagttgtagaaaatgagcctgaagacgtagaaaatgaggcgaaagttgtggaaaatgaggcgaaagttgaaaaggaggttcagaatgaggctaaagttgtagaaaatgaggttaaagttgaagaaaatgaggctaaagttgatgagaatgagcctaaagttgaagaaaatggtgtggtggattcgaaagaagaggaaaaaacagagggggtatctgaggagaaggatgctattgtggactccattaatgtggatgttgttgaggctgtgaggtcaggagctgctgttgttggggtgcaaaatgaggggtccgacacgggacccattgaggaggagtctgtggaaaagccggttgaaattgacggggcgaaagctaccgatgaagaagtagtagtaggagatgaggaaacagttgatgttgttgataaggtagctgggaaggaggtggatttggaggtggtaaaaagttctttgggtggtgatgatgttgttgataaggtagctgaaatagatgttgatgttgttgataaggtagcagtagagaattcttctgttggtgaagaaaatgctggggacaatggtgaggaggattctgtggtggatgccataaaggtggaccctgttgaggctgtgcggtctggggtagctgtggttggtgaggaggaaccgaaagagactgaaaatgtgaaggaggacgagaccctggttgttgttgctggtgaaaatgtggcggtggggaatgattttgagcctctggcgggttcgaattcgtccgagttgggggccgagttggataaccatgttgaaccggctgagcaacgtggactgagtgatgatggtgcggcagaggaacccaaaaacacgcagtctgaacccgaagaacccaaagagcccgagcctgaacccgaacccaaagagtctggtgaggatgagaagaaggttgagcccgatgttgtggacaatgagacccagggggcagaagatgatgtggttgaagctgatgatgatggtgactcagataatgatgcttacacaagccagatggtggaggaactagaacgtgcttcgcgtggtgttgatggcgaagttgtcacagagtctgaggaggaggaagaagccggttctgatgaggaggacgaaggggagcaaaaggagctcttcgattcggctgcactggctgctcttttgaaggctgctactactgctggtggtggctcggattctggcaccatcaccataacatctcccgacgggtcccgcctcttctcggtcgagcggcctgcgggcctgggctcgtccctccgtgccatccggcccgcagcggcgccgaggtcgggcaactcgagcttcctgactcccccgaacctcgctgctgctccgtcggacgagaatctgagcgacgaggagaagaagaagctgcagagcatccataatttgagggtgaagtttttgaggctggtgcacaggttgggccactcccccgaggattctgtggcggcccaggtcctgtatcggcttgccctgcttgcgggccggcccacgagcccggcattcagcctcgagaatgcgaaacagaccgctgcacagcttgaggaggaagggaggggcgatgacttggagttctccatcaacattctggtcctcgggaagactgggatggggaagagcgcgacggtcaattccatctttggcgaggagaaggtcaagatcaacacatttgaccctgaaaccacctctgtgcaggtggtccatggcgttgtcaacggggtcaagatcagggtgattgacgctcctggcctgagatgttccgggatcgagcagggcttcaaccggaaaatcctgtcgtcggtcaagaagtacacgaagaagtaccctctggacgtcatgctctatgtggaccgcctggactcccccactaggagcctcaacgacctccccatgctgaagaccataaccgcctgtctcgggtcctctgtctggcggagcgcggtggttgccctgacccacgcctcgtgcgcgcccccagaagggccctccgggtccccgctgagctatgacgtctttgtcgcgcagcgcagccacatcgttcagcagtccatcgggcacgcgacgggtgacatgcggctcatgaacccgagcctgatgaacccggtcaccctcgtcgagaaccaccccgcgtgcaggaagaaccgtgagggccagaaggtgctccccaacgggcagacatggaggccgcaactactgctgctgtgctactctctgaaaatcctgtccgaggcgaactcaatctcaaagccccaggatccgtttgatcacagg

SEQ ID NO: 103 - DNA, 2304 bp, Portulaca oleracea
  unsure (1)..(2304): unsure at all n locations
  unsure (1)..(2304): unsure at all n locations
atctcggtccaggtgacgaaggacaagaaagacttcaacatccacatggactcggcgttctcagccaagcacggggacacgggttccagtctagtagggttcgacatccagaccatcggcaagcagctcgcgtacatcgtccgcggggagaccaaacacaaaaccgcaaggaggaacaaaacagccgggggcgtatcggtcactttcctaggcgagaacgtggcaaccggggtgaagctcgaggaccaggtttctgtgggaaggcggctcgtcctggtggggtccgcagggaccgtgcggtcccagaaggacgcggcgtacggtgccaacctggaagtccggctcagggaggcggactacccgatcgggcaggaccagtcctcggtcgtactgtccctgatgaagtggcggggtgacctggcgctcggggccaaccttcagtcgcaattctccgtgggccggggctcgaagatggcggtcagggtcgggctgaacaacaagctcagcgggcagatctcggtcaggaccagcacctcagaccacctccagctcgcgctcgctgggctcatcccgattgcactctccatatacaggaatctgaagccgagtgccggtgagaattactccctctactgagattcgtcgcatttttggtccgtcatctgttatattgtttttgcattctgcagtttgttgggttatttgtatgtcagtttctgaattggactttggaataagactctgtcatttggtttagcagcagttctttttgggtatttttttttgccttggttgtagtctggcggaatggtcattgtaatcgaagatgagtattatgcgaaatgaatctcgtttccacagcaaaaagtcgatttcctacttcctgctgattgctgaattatctgatgcaattaaattcgtgttaactggtctcatcgcgctaatttcttggtcattcgttgtgcataattgtttctcaacttcatgttggatgctggtttttgtccgatggtttgaagggacggtaaattttgagtctggatttggttgcactgattagagcactttccgatttgcatcgtctgcgtatcgataaaatgtagcgtacaggatgaattttgtgctacaattgggatgagcctgagcaaattgggatgtgggggacttaaactgccttgttttgatagagttggactgactggtttaggttgtgcaacctgactgcatcaattcatctgaatttctggtgtcaatttgatataatggtgcgtttgttagttttttgggaaagatttttttccggaaaatttttccggggaagactattcttagctcccgcttgggaaactttttactgaataagtcccacataaaaacttttcctatattatggagaaccaaatattggaaagttttttagggcgcgtttggttggtcaataannnnnnnnnnnnnnnnnnnnnnnnnnnnnnnnnnnattttccccatgtttggatgtgggttgacttcgggaaaatttttacgatgggttcaccatttttttctagggaaaatttcccttagagagggggctgagggaaatttttcccatgtaaaactactcatggaaaattttcccgggaaaaatttcctatgttcctaataaacgctccttaaaatatatgtacagctgtatataagaaatatgtagtcatgaacttctatgataaagtcatgaactgcattaatcctacacacaattttgttttgtttatgaggatagttatatgccaggacttttttgctctatgagtgaaattcatcattaagggcatggcatccaaggttgtcttggtgagaacattccttttgcttgttaactagcagtgctgacatgccttcaaatttgactgaaatggcaaaaatggattcaatggaagatgcatctttgaaactctcacaaattttggctaaaaatagcgaaaacctaaccatacaactccttctgtcccatgttaattgtcatatatttgactattatggtctccaatgtctctctttgatttatcatttactgcgaatggcctgctgggccacctgatgcactgaatgaataagccgccttggaacttcaaaattcttcctgaccccctgataaccatcttgactcaagatggatcttaaccatcttaaattgttcatatttcatatttttctaccttttattaatattttctttaataattatatatatttaccaattataataatataatacttattagctaggtgaaaaaaatttaataatagtctaattttatcaat

SEQ ID NO: 104 - DNA, 4953 bp, Senna obtusifolia
tccaacttcaacaaatctttaagaacattaatgttcaaattcaatcaagactaatcaaatattaaaacattagccgcattagcatgctgcccatcaaatctttaaaagaacattcatgttcaagttcaaccaggaagctgaccttcgtttatatcatcttttccctttattgggtaaagaataatgacatgtatgaccacaagctacttttaatctaagtcttgcacacatgcattagaaataactaatcagtaacataaaaggaaaaggtgctatcagctatagcttcagccatagcatcatcttaatttttaggaccaatgtccttcagggcacagatctgctcttctcccattgaagacatgacagaaaccacaagatctttcccttcagcaaacccatctttgatctgggaaagcagtgcgtcatcagtgggaagcctcagatcatccttggtgtttccattgtcagtcaaaaggctcacaaaaccatcttcagagatatcaatcagctgatagtcagtacgattaacatgcggaacatcacagttgtgggatgagggaacaatatcttcaagttttttcccattaaaaatatcaattgcaacaaagtggcactttgcatgtccatgcttgccagtttttgaagtagaaacttctacaaccttgcaaggcctgcccttgatgacgatgtagccattcttgcgaatggtaccagcttgctgaggataggtcttcgacgctccggcgtcggcctgagaatcgaagtggtgctcctcgtccgacatagcctctctcttgctctctctcgttcgctcgctcgctctctctattcctcacaacctaatctcttttcttccttctttcttccttccaatagagcatctcatccatggactctgaccattctgcccctgaattttcatctaacgtctccgaccaatcaggttccgttccttcgtctaatgctctcgaaggttctggtgaggaagttttgacgcagaagccacctgcgggtgttatggaggttggcaataaggaggacgctagtgttagttttaacgttaatggtggtggtggcggcggcgaggggtccgagaaggatgatgggtttgagagtggtgatgaagagtttgagacgccgttggcgagggggattcgtgtgtattacgatgagaaatcgtcggagggggaggctgttcatgcgccttttgtgaattattctgaggagttcttcacgcccaaggctgggaggggaattcctgaggtatcggtggtgaatgatgatgaggagcgtggggttggaggttcagggggtaatgatttgggaagccatatacaggagcaaggcggcggtggtggtgattcgaatttggctgaagagggtactgcggagaaatttggaattggagcaaccacagaggaatatcaagaggacgctgtgcgaacggagcccataaaggaaagtggtgttagtgatggccagggggtatttgttgaggattctggggggatagataataagggttctgagagtggaaaagtggaggggagtatgcacgatgtggttgaaggagaaatggttgctgagcagaatggagtagaatcccacaacttggaggatgatgaggctgtgaaagagcagaatttatatgatacgccacaggcaattccagtggaagctgacagtggtgctcaacctgtcacagaaggagacgccaatgttgacactatacaggttgatttgttgccgtctggagtggcagttgttggtgacaaggaggaaattgatgagtctgaaattaaagggatggaagctcctagtggtgttagcctggaaaatgggtttgaagcaattgaaggggatactgaagaacctttagataaggttgagactttggatgctaagtctgattctaatgtagatgatgacgatactaaacatgcagataaggggatgcatactgcttctcaggaaaatgctgattttgaaagtcacagtgttgagacagaggtaaaggctcttcaagatgacataaacgtagaagatcttgctaacgagggggacactaggagccatgtcgaggcttctggtgattcacctgcatctgaatatgtggatcctaattcttcctcaagccgagaaatgagacaagaggaggatgatgaagtaaagtttcattctggtagcagagagattgatggttcagtttcagatgaggatgccgaaggtatgatctttggaagctccgaagctgcccggcggttcatggaggagttggaacagcagtcaggtgctgacggttcacaggatccttcacagagaattgacggtcagattgtgaccgactcagatgaagaagtagacactgatgaagaaggggatggcaaggagctatttgattctgcggccttggcagctcttttgaaagcagcaactggtgctggacaagatggtggcaatatcacaataacctctcaagatggatcaagactgttctctgttgagcgcccagctggtttgggaccatcactccagtctgtcaaacctaccgctcgaccaaatcgtgtcagtcttttctctccttccaatcctagagctggtgctgaatctgatagtaacttgagtgaagaagagaagaagaaacttgagaaagtgcagcaaattaggattaaatttttaagattggttcggagactgggttttactccagaagaatcaatggtagctcagattctataccggttgacacttgttgcggggaggcaaagcagcccactatttagcttggaagatgcaaagaggagtgcttcccagcttgaagctgagggaagagatgatttggaattctccttgaatatattagttattggaaaacaggtgtgggtaagagtgctacaataaattccatttttggtgaaacaaagaccagtatcaatgcatatggacctgccacaactgctgtgacagaagttgttgggatggtagatggagtgaagataagagtttttgacacaccaggattaaaatcttctgcagtggaacaaaatttcaacagaaaagtcttgtctacggtgaagaagttcacaaaaaaatctcctcctgatattgtactctatgtggatcgtctggacacacaaacaaggaatctcaatgatctgccattattaaaatcaatcactaatgtccttggttcttcaatatggcaaaatgccatagtcactctgacccatgctgcctctgctcctcctgatggaccttcaggttccccacttggttatgatgtattcgttgctcaacgatctcatatagttcaacaaaccataggacaagctgtcggtgacctacgtcttatgaatccaagtctaatgaatcccgtttctcttgtggaaaaccatccttcttgccggaaaaatagagatggtgaaaagatccttcctaatggtcaaagttggagatctcaattgttgatcttgtgctactcaatgaagattctctctgaagctggtaatctttcaaaaactcaagataaacttgaccagcggaagctgtttggttttcgtgttcgctcgcctccacttccatacttgttgtcatggctgttgcaatcacgcacccatccaaaactctctgccgatcaaggtggtgacaacggtgattctgatattgagttggctgacttgtctgattctgatatagatgaagatgaagatgaatatgaccagctcccgccatttaaacctctcaagaaatctcagattgctaagcttagtaaagagcagtgtaatgcctactttgaggagtacgaatatcgagtgaaacttctccaaaagaagcaatggagagaggaattaaaaagaatgagagacatgaagaaaaatggtaaaactacggtaaatgattacagtcagatcgagcaagatgatcaggaaaatgaaggtccagctactgtgcctgttccattgcctgatatggccttgccaccatcttttgatagtgacaatccagcttacagataccgcttcttagagccaacttcccagctcctaacaaggccagtgttagacacccatggttgggaccatgattgtggctatgatggtgtaaaccttgaacacagtctagccattatcaatcaatttccagccacagtcactgtccagatcaataaggataagaaagacttcagtatccatttggattcctcggtcgccgcaaaacacggggagaacggatcaagcatggcaggatttgacatacaaaacgttggaaagcagctagcatacatattcagaggagagacaaaattcaacaactacaaaagaaacaaaactactgctgggatgtctgtgacatttctgggcgaaaacatatccaccggactaaaaattgaggaccaaatagctctgggaagacgatttgtcttagtgggaagcactggaactgtgagatgtaagggtgattctgcttatggagccaatgttgaagtgaggctgagagaggaagattttccaattggtcaagaccaatcttcattgggtctttctctagtgaagtggagaggagacttggctttaggagctaattttcagtcccaattttcaatgggacgaagttataagatggcgatccgcgccggattgaacaacaagctcagtggacagatcaatgtgagaacaagtagctcagatcaacttcaaattgctctagttgctattcttccaattgtcaaggctatctataagaacttctggtgtggggcaggtgagaattatcccatctattaaattttgttccttttagatctcaaattaagcatagtctgttcattcagttgcttctttttatcattttcctaagtgttgagttagctattattgatctttcatatttattcttggtatattggttgttggtggattttgttgtcttagactttgtactgaaattgag

SEQ ID NO: 105 - DNA, 3011 bp, Senna obtusifolia
ctaaagaatctattgatgaggttacgactttggatgctaagtttgataaaaaggatgataatatagtggaagatgatagtacacacgctgagaaggatctgcaagatgacacaaatgtagaggttcatgctaatgagggagaaactgccagccatgtggatattaatttttcattgagccaaacagtaagacaagatgaggatgatgaagaaaagctgattcctagtagtggagagattgatggtccagtttcaaatcaagaggctgaagatatgatttttggaagctctgaagcggcccagcggttcttagaggagttggaacagcattcaggtactgactcatactcaggtgctgaaacatcacgggaaaactcgcagagaattgatggtcaaatagtgactgactcagatgaagaaggagacaccgatgaagatggggatggcaaagagctatttgattctgctgctttggcagctcttttgaaagcagcaacaggtgttggacaagatgatggcaatatcacaataacctctcaagatggatcaagactgttctctgttgagcgtcctgctggtttgggaccatcactccagtctttcaaacctgcggctcgaccaaatcgtgtcggtcttttcactccttccaatctcagagctggtgctgaacttgatagcaacttgagtgaagaagagaagaagaaacttgagaaagtgcagcaaattaggataaaatttttaagattggttcagagattgggttttactccagaagagtcaatggtagctcagattctgtaccgattgacacttgttgcagggaggcaaagcaatcagctatttagcttagaagatgcaaaaaggagggcttcccagcttgaagctgagggaagagatgatttggaattctccttgaatatattagttattggaaaacaggtgtgggtaagagtgctacaataaattccatttttggtgaaacaaagaccagtatcaatgcatatggacctgccacaactgctgtgacagaagttgttgggatggtagatggagtgaagataagagtttttgacacaccaggattaaaatcttctgcagtggaacaaaatttcaacagaaaagtcttgtctacggtgaagaagttcacaaaaaaatctcctcctgatattgtactctatgtggatcgtctggacacacaaacaaggaatctcaatgatctgccattattaaaatcaatcactaatgtccttggttcttcaatatggcaaaatgccatagtcactctgacccatgctgcctctgctcctcctgatggaccttcaggttccccacttggttatgatgtattcgttgctcaacgatctcatatagttcaacaaaccataggacaagctgtcggtgacctacgtcttatgaatccaagtctaatgaatcccgtttctcttgtggaaaaccatccttcttgccggaaaaatagagatggtgaaaagatccttcctaatggtcaaagttggagatctcaattgttgatcttgtgctactcaatgaagattctctctgaagctggtaatctttcaaaaactcaagataaacttgaccagcggaagctgtttggttttcgtgttcgctcgcctccacttccatacttgttgtcatggctgttgcaatcacgcacccatccaaaactctctgccgatcaaggtggtgacaacggtgattctgatattgagttggctgacttgtctgattctgatatagatgaagatgaagatgaatatgaccagctcccgccatttaaacctctcaagaaatctcagattgctaagcttagtaaagagcagtgtaatgcctactttgaggagtacgaatatcgagtgaaacttctccaaaagaagcaatggagagaggaattaaaaagaatgagagacatgaagaaaaatggtaaaactacggtaaatgattacagtcagatcgagcaagatgatcaggaaaatgaaggtccagctactgtgcctgttccattgcctgatatggccttgccaccatcttttgatagtgacaatccagcttacagataccgcttcttagagccaacttcccagctcctaacaaggccagtgttagacacccatggttgggaccatgattgtggctatgatggtgtaaaccttgaacacagtctagccattatcaatcaatttccagccacagtcactgtccagatcaataaggataagaaagacttcagtatccatttggattcctcggtcgccgcaaaacacggggagaacggatcaagcatggcaggatttgacatacaaaacgttggaaagcagctagcatacatattcagaggagagacaaaattcaacaactacaaaagaaacaaaactactgctgggatgtctgtgacatttctgggcgaaaacatatccaccggactaaaaattgaggaccaaatagctctgggaagacgatttgtcttagtgggaagcactggaactgtgagatgtaagggtgattctgcttatggagccaatgttgaagtgaggctgagagaggaagattttccaattggtcaagaccaatcttcattgggtctttctctagtgaagtggagaggagacttggctttaggagctaattttcagtcccaattttcaatgggacgaagttataagatggcgatccgcgccggattgaacaacaagctcagtggacagatcaatgtgagaacaagtagctcagatcaacttcaaattgctctagttgctattcttccaattgtcaaggctatctataagaacttctggtgtggggcaggtgagaattatcccatctattaaattttgttccttttagatctcaaattaagcatagtctgttcattcagttgcttctttttatcattttcctaagtgttgagttagctattattgatctttcatatttattcttggtatattggttgttggtggattttgttgtcttagactttgtactgaaattgag

SEQ ID NO: 106 - DNA, 1347 bp, Sorghum halepense
tgtgtgccttggcggcccttctgaaagcagcaaccggtggatcctcagatgggaatatcacagttgcttcacaagatggttctagaatattcaccatggaccgacctgctggtcttggttcatcagccccttctctgaggccaactgcacctcgccaacctgcccggtcaaacctattcagcccctcggagctagcagttactgctgaccctacagaagagatgacagaggaagagaagaagctacacgacaaggttgagttgattagagtaaagtttctgcgtctggtttacagactaggagctactcctgaagaaacggttgcggcacaagtgctgtaccgtctgagccttgctgagggtatccggcatggtaggcagacaaaccgagcattcagccttgataatgcacggaggaaggccttacttcttgaagcagagggaaaggaggaactgaacttctcatgcaacatacttgttctaggaaagactggagttggcaaaagtgcaactatcaactctatatttggtgaagagaagtccaaaactgatgccttcagctcagcaaccactaatgtgcgggaaatcattggtgatgtggatggtgtcaagattagaatcattgatacacctggccttcgacccaacgttatggaccaaggatcaaacagaaagattcttgctgctgtcaagaaatataccaagaaatgtccgccagatattgttctatatgtggatcgtctggatagtcttagccgtgatctcaatgatttgcctcttctgaagaccattactgctgttcttggctcatccatatggttcaatgccattgttgcactcacacatgctgcctctgcacctcctgaaggcctcaatggtgctcccatgacatatgaggtcttgatggctcagagatcccacatcatccagcagtccatcaggcaggctgctggagatatgcgcttgatgaacccagtagcccttgttgagaaccatccttcatgcaggaaaaaccgtgagggccagaaagtgcttccgaatggccaaagctggaggcatcagatgctacttttgtgctactcctcgaagatattatcagaagccaactcacttctgaagcttcaggatcctaatcctggaaagctttttggcttccgcttccgctctccacctcttcctttcttgttgtcctcactcttgcagtctagagcccacccgaaactttctgctgagcagggtggcaatgaaggtgattctgacattgaattggatgagtattctgatgtagaacaagacgatgacgaagaagaatatgatcagcttccaccgttcaagcctttgaccaaag

SEQ ID NO: 107 - DNA, 518 bp, Sorghum halepense
tgtctacaccaaacctcctggtgcgcgctgttaacaatcctgatggatgggatcatgattatggatttgacggtgtgagtgtccaacatagccatgatattgctaacaaatatccagcttctctgtgggttcaaattaacaaggacaagagagagttcaccatccatttggattcctcgatgtcagttaagcatggtgactatgcctcaagcctggctggctttgacatccaaacaatgatgaaccagcttgcttacaccctcagaggggagaccaaattcaaaaactttaagaaaaacatcactactggtggtttatctatgacttttttgggaaataccatggtggctggagcaaaacttgaagacaagcttttagttggtaacaggttaacactatcaggcaacactggtgctgtgtccatgagaggtgatgttgcatatggagtgaatatggaggcaactcttcgtgaaaaaagctatcctctaggtcaaggccttgccactttgggtgcatcc

SEQ ID NO: 108 - DNA, 5909 bp, Sorghum halepense
cgagaaacggattggatggcggcgtcattgaggatggcgacgggacggacgccgagggatcgctgggtggtagcttccaaacttccgggagcttcattgacgcgcaggacggcggggaggctgctgcttcaggcgatttcgtgaccgtttcagatagtaccgtgctgaaggatgatgataagcaggtggagcacactgtcaatgacgcggcgtctgagcctgttgctggggtcgatgacctggtcattgtggatgctttggaggggatgcttgatcgtgaggttgctgaatcgcttccaatttccaatgctacagaaggagaggatgctggtgctgaactttgcagcgatgattctgatgcaaaaggtagtacagccaaacttgatgctagtcctgaatacgctaccacaggagaggtcacatctgatggcgtgcaagtttgtgataatgttgatgacctaggttccactgaagtcggtggtcataataaggaagatgaggaagctgacggttaccacgatgcttctaatgatctcaaatccatcccaatctcttcaagtgatgatgctgtggaatttattgcaaaagaattggaggacaacgtgcctacttccagaggcgcacgctatggtgtggaggattcggatgatgcagagatcaatggcgatgatgaatatgaagaggagatgaatgtaaaggaggccgagctttttgattatgcagctttaattgagcttctaagggctgcaagcagctcacctgaacaaggcaaggccaaggttttcccagttgaatcttctgagcccaggcatctgcctcctatggtagccagcaatgcagccaatgctagggcgaatgtggcttctgctcctgtgccagaagtaactgctgaccctgagaaagagatgactgacgaggaaaagaagatatacagaaaggtggacatggcacgaatcaagtacatgcgtcttgttcatagattggggtatgatactaaccatcaggtaccagtacaagtgttgtatcggcttagtcttgttgaaggattcaggcgcgtaaggatgacaaaccattcctcagagatcgaggatgcctggaagagggctttgcagcatgaggcagagggaactgaagaccttgaattctcctgcaatgttttggtccttgggaagactggagtggggaagagcgcaacaataaattccatcttcggggaagataaatccaaaacaaatgcgtttctaccgacaacatcatctgtgaaggagattactggtgttgttgatggtgttaagtttcgtgtcattgacacccctgggcttgggatttcggccaaggatgacaaatcaaataggaaagtgctcaaagctgttaagaagtatatgaagagatgccctccagatattattctgtatgttgataggcttgatacacagcgagaggaggcaaatagcctatctctcttgcgaggcattaccagtgtgctaggcctgtcaatatggtccaggacaattattactctcactcactcaggagcagatccgcctgaaggccctaatggttccgcggtgaactatgatatgattgtgactcatcgaactcatgcaattcagcaaagcatccggcagataactaatgatcctcgaattcagaatgcagtggctcttgtggagaaccatcatgagtgtcgcaggaacgcagaaggtgaaaaggtgcttcctgatggccttatctggaggcggctcctcctcctcctatgctactcactgaagatgattgctgagattgacagtctctcaactcgtcgtgcttcttctacaagttttttaggtcgctttttccaagtgcctccaattccttacttcttatcatctttgttgcaatctagagagcaccctaggcgttccaatgaacataatgttgggagtgtggactcagattttgacctagatgaattgttgaatggggaccaagaggatgaagaagatgactatgatcagcttcctcccttcaagccactaagtaaatcccaggttgcaaaactctccaaggagctacaaaagttgtattttgatgaatatgattaccgaactaagcttcttcagaagaagcagttgaaggaacagctcgaaagatttaaggaaatgaagaagaaagagggcgatgataatgatgtaccttctgatgatgatcatcccgatgatggatatgatacagatagatatcctacgccagaatggaccttgccatcttcatttgattctgatgatcctgtgtaccgctatcggtgccttgtgtctacaccaaacctcctggtgcgcgctgttaacaatcctgatggatgggatcatgattatggatttgacggtgtgagtgtccaacatagccatgatattgctaacaaatatccagcttctctgtgggttcaaattaacaaggacaagagagagttcaccatccatttggattcctcgatgtcagttaagcatggtgactatgcctcaagcctggctggctttgacatccaaacaatgatgaaccagcttgcttacaccctcagaggggagaccaaattcaaaaactttaagaaaaacatcactactggtggtttatctatgacttttttgggaaataccatggtggctggagcaaaacttgaagacaagcttttagttggtaacaggttaacactatcaggcaacactggtgctgtgtccatgagaggtgatgctgcatatggagtgaatatggaggcaactcttcgtgaaaaaagctatcctctaggtcaaggccttgccactttgggtgcatccttagtgaaatggcgtaaagagtggaccatggctgcaaatttggattcccaggtctctgttggaaggtcttcaaacatggcagttcatgttgatgtaaacaacaaactaactggacgggtcagcatcaaggccaacacttcagaacagctgaacattgccctttttggtacctgttcagtgataatgtatttgtggaacaagatgcaccctggtgcagatcctaatgctgagtagcactggttagtgtgacaattttgaaccctaacatttgtatcttttccttgttccttctgtttttctactttttggttataactactgttgaagcttgttagtcattcctccatttagtctcttccctgtgccttccacactaacgtttggttattgcaaattgaaattcatgtatactttgtctgttataatatgtaggctctgttatagtatatagacttgtttacttgttggatatcaggcatatggttgcccttgttctttaaatctgtttgtatttacaaaaaaaaatgcattatacattgcaaagatccaagaacaaatattagatctctcatatatgagcctgaattgttttcagtgaagtggctaaggatctttgtttgcctaagtgactaaggaactgtgatggacttaatggataaagaactgtgttgggctaatcgcttccagagtgccagactaataaatgatctacgttctgttttggtcacgactcatgagtcatgacacatacaactcttttccgaatccactatgtcctcttgattatgttgtatttctgttaataggttgcagtcttatctggtatctttatcttttctgtttgagaactgttacaattagtgttgcatgagtccttgttctacagtaagcaaagccatataaagaaactttacgtccctgtcagtatgcttattattagtagcaatcgctggtgacattattttgacctttgaaaattttcagtaaagactgggtaaaaaatgtcgaacttgattagaattgccttggcatttatgccatggacattttgactggggtttttgcttatcgaacaaaccactggaatagtttgctcagttcaataggtttatccatatttcattgaatccgtgttcaaaagagttctcaaagcttttacttcgatctgtcctaagaaatactttgaattttctgacatgcttaatgttgctgtattcagaactcccaagatccaagcagtcacaggttggcaagcacatcatttgtgcacccagcttatgattcaagaacgggaggtagctgaaaactgcacactctgccaacttgctaggaatggaagttgaaccatcgctttctgtcaagattcgagataagtgtagctatggcgtttctttttttttccccatccagtgcgcagttggtggccaacttcatgactatgatgagtgactcaacttattatgtcaaaaattgtaattagtaacacgtttgatgaatcataatgcccccaaaaattggtcttttttggcctccctttcattaagcagtttcatcccttctaatcagaagacacaaaaagtgtggcccccgaaaatttagtttctgatagcttgtctataggcaggcaatatattgtcatgatttatgctctttgcagcatatcagattagtgaagtcttttgtttctgctaatatccttggcaatttctttgtggatatctggagataagataaggtgcttgagaaagcaagcaagaggattggcccactgggtttggcttgcccttgcaagtgggaggcagtctttttcattattgtttagaataggattcgtgttccattaatccataggaaaagaggagtccaattcaaaggtgctttcttttatagttatataaaaaaaggccttccttttattcttctttttctgggcgacttctatgttctatccaagtaataatatgatatgatattgcacatataacctataacaaacgatatgatactgcacaaatatatccctaaaagaagcattcagcttcctttcaagatgcagctttgttgaataggtagtctttgatctctcattgaactcctagatctgttgaggttcgttgcttgaaatttgcaagtgttgaaataattagtatttcatgggcacgtagctggattcatggttcctaaaatcccagcagtgctgcccagatcagaaggaaggaaatgaatggcctttttttcctcacaaccaactgaatcaccttgacatgcaaaggggacaccttattttgtcaaccatatcagtttctagacgcttctttgcaaagaaaacatgaattcaactcatgaacatggtgcctctcatggctaggattaaagcattcaacaaccgaacagatcaagaagaaggtagtaaagaagtgatagtttcagacagagtatattgtagataaaagatcaccattagaagaagattcttctgaaccaaatcagatggaagaagcaaaagtggacacgcaaagcaggaagatttttattttctcatagctattcacaggttccccttattacaagatttctggaaaacaagttcatggctacaaaagtttcagatctcctccctcttgaacccacacccatgacccatgccatgcatgaacttcccaagaactcaacctctccaacatcagacatggactacgtaccttgttttttcacatcatcatacccatatatccatatgtacctagttcatgttcatgttaatttacaagacaagctccggttcttttatggttcagttccttgcagatctgaccaagacacggccacacaagcggccatgctcttgcaaacccagatctcggtttgtgttttatgtgtgaccccagggagccaagaacatgactctccttatggggtcctcggcggccgagccgcggcagtcagcgccaccacggctcggttcgccggccggcctggccgccggtgtgctggcggcgctgtaggagcgccggagtttctcacggagggcctgcttgacctcgtgagcccaggagccctccccggcctgcagctgagggggtttcatggctggct

SEQ ID NO: 109 - DNA, 5168 bp, Spirodela polyrrhiza
  unsure (1)..(5168): unsure at all n locations
  unsure (1)..(5168): unsure at all n locations
ctctctctctctctctctggacgttgcgtcctcgatggtgtctccaaagaaggttccgggagctctcagacgacgggccaacggcgttgcttctcgtggggcgcatgcagacaaagctcccgcggccacactcgccggatagatcggggttaacgccgcccgctgctcgccggccgtgaaggtaaatcgcctgatttctctgcggtaaatcagaagccctaccggcggcgtggggacaggaagaagaagtaggtacagagattacgcttgctccatcttcacagatgggatggtgatgatttctagagataattacagtgcagggaaaactgttcctcaaaaacccctaggaccttatctccctcttttccttcccgcatcctcttcgtgtggctcccccgcgccgttcctcccccccaacccgaaccccaggggaggtgccggagcccctggtttcatcccgtccatctaattctccttcccaagaggtatagggttgagggttgttgtaatctcttatcggactgtccgcagctgtgcgcatcctcattcttcaattctgctgcagaagtgaaagtggtatcgtatctatggagtcggaggtcccctcttccgcagtttctccggcgcaggagaagcccgtggcctcgtcgggctctgcggttgccggcgcatccgccgcctccactgagggtacggagcccgtgccgccggcttcctccccggtgtccgagccagaggagtttctgagcggcgaggacgaacccgagcccgagttcgaggccgcctctgagcagcttctcgtgcctgaacccgacggggaagccgtcccggagaacaagcctgctgctgccatcgaggaagagatctcactggtcgattccaaccgcgacgacgttccatcgcgcgtcgtcgtcgacagaaatccagtccccacccccgaatcatctctttccaaggacgaagccaccgttgccgatgtcgacgctgatcggagagcttcgtcgacacgggctgtcgagtccgaatcccttccttctcatcaagctttagtgaacggaggtgatggcgccctccatgaggacgcggacaacgggaacgagaagaaacccattgaagaggcggaaggaggtgccgaggcagataatctggaaggggctccagatgaaaacactaaattgaaggtgaattgtgatggatcatcaagtggatttaacgatgataaaaacttgctcaagggggacgaagatggcaaagatggtagtcctcatggcgatctcgtgctcgatggagctcctgctggggctgaggatgtgtttcaggataccagggagagtgaacatgctgacacaggcgatggggataaggaaggaactgcccctgttcctgaagctgttcaggacttggatgcagagaaaattccgtccagaaatgggactaccacctgcggggtggaggaagagccaacgatttatgaggagagtaagtctacagagaagcaaatcagtgctgctcaagcggtggacttgaagagtgaagaagacactgcagttactgtgcaggaaaatggagatgaccatgatggtggttctgatgataattttgaaagagttactcctaccacggttgacggccaggaatttcaagcatctaaaactctagagagtcctgtgcatgacttcactgaaacgaaagaaaattctgagaatgttgagaaagatgaagcacctcaggtggtagatggctccaggcaatctgaacattcagagcagaagcctgaaaactttgacagagatgatgatgttgatgagatcgttttcttgcaagccattgctgggagagatgcaacagagcaagccttggctgaactgcaggtgaagcccaatgaaggggatgctaggtatccagaaaaagagcaaccgcttgcagccagtgaggagcctttgaagtctaatgcttctgattcttcggaagttgctgcccatgcagaacatagaggtttggttaatgggggagaagtaaatgacgaagaagcagaggaagaggaagaggaagaggaagaggaaggagaagagggagaagagggagaagagggcttgccctctgatgggccttctaaggtttccattctggggagctctgaacttgtcagacggattatgaaagagctggatggaggatcttcaggtcccagttccgatttcaggagctctcaggactatggaaatcaaatggatgggcagatcgtctcagattctgaagaagaggtggacactgatggagagggagaaggaaaagaattatttgattctgctgcattggctgctctcttgaaagctgccactggtgcttcctccgatggcactatcaccatctcccctgaggatgggcccaggacattttctgttgagcgtcctgctggcttggggtcgtcagtcccatccttgaggccggcacctgcccgctcgatcaggtcaagcctcttttctccttctgacgttgcagtacccggagaaccagagaatgccatggacgaggaagacaagaagttgcaggagaaggtcgaccagataagggtcaaattcctgcgcctcgtccgcaggctgggccagtctcccgaagacagagtggcatcgcaggtgctctatcgtctgggtcttgcagaggggatcaagcgcggcaggcaggtaggtcggggattcagccttgagaatgcaaagaagaaggctctccagcttgaagaagatggaaaggagcctctggacttctcctgcaacatcctaataattgggaaaaccggagtaggtaagagcgcgaccatcaactcaatttttggtgaagaaaaagtgcctacgaatgcatttgaatcttcaactacatccgttaaagagatcgtcggcactgtggatggcatcaaggtctgtgtcaccgacacccctggtctcagaccttctgtcatggaccaaactgcaaataagaggatcctggaatccatcaagaggtacaccaaaagatgcccccctgatattgttctttatgtggaccgtctcgacacacagacctgggacttcaacgacttgccgcttctgaaatctatcacggcgaccctgggctcgtccatctggttcaacgccattgttgctctgacccatgctgcttctgctcctccagacggccccagcgggacccctctaagttatgaggtgttcattgaccagagatccaggattgttcagcatgcgatcaggcaggccgccggggacatgaggttgatgaatcctgtggcgctagtcgagaatcatccctcgtgcaggaggaacagggaagggcagaggatccttcccaatggcctgagctggaggcagcagatgctacttctgtgctactcatcaaagatcctgtctgaagctaatgctctcctcaagcttcaagaaccctctcccgggaagctattcggcttccgcgcgcggtcccccccgctgcctttccttctgtcttctctcctgcagtctcgggcccatccaaagcttgcagctgacaatggaggcgacaacggcgattccgacgttgatctgggtgacttgtcggactccgaccaggaggaagcagaagacgagtacgatcagctgccgccattcaagccactgaggaaagcccaactcgccaagctcaccaaggagcagcgcaaggcgtactatgacgaatacgactaccgcgtgaagctcctccagaagaaacaatggaaggaggagatcaggaggctgaaggagctgaagaagatggggaagaagggccaagatgaagcgttcggggacatggctgacgactacgaccaggacggagctccggccgccgtccccgtcccactgcccgacatggtcctgccgccctccttcgactccgacaatccggcctaccgtttccgcttcctcgagccgtcatctcagctgctcgctcgccccgtcctggacacgcacggctgggaccatgactgcggatatgatggagtcagcctcgaagagagcctcgccgtcgccagccgctacccagcagctttttccctccagataacgaaggacaagaaggaattcaacgtccacttggactcctcggtctccgccaagcacggggagactgggtcaacgctggcaggctttgacattcagtctgttggcaagcagctcgcctacatcctcaggagtgagaccaagtacaggaccttcaggaagaacaagactgctgctggaatatcgttgaccttcctgggggagaacgtggccaccgggttgaagatcgaggaccagctcctcgtggggaagcgtcttggccttgttgccgcctctggggccgtccgtgcgcagggtgatgtggcgtatggtgccaacctggaggtccgactccgggacaaggacttccccataagccaggacgtgtccacgctggggctgtctctgatgaggtggcgcggtgacctggcggtgggcaccaacttgcagtcccaggtgtctgtcggccgcggttccaaggtggcagtccgagtcggcctgaacaacaagctcagtgggcagatcatcgtcaggacgagcacctccgaccagctccagatcgccctcttgggccttctcccgattgccacctccatctacaggagcttctggtctgtggagtcctactgatctcccctccattcccattacctccagtcaccttccttcagatcttttgctctgattgcggagatgtttgagactgccctggttctatctttgagctcctcctgagatcttgaataatgtcgattaatttccatttttgggagttttgttcttgtgggcatggggtcgggagggcgcccttcatgtcccctgtaattttttgcttcattaataagttgatttctttttcctgcgctgtgactgcatgagaaatgccaacactgggctctctctctctctcnctctctctctctctccgtatcccctgcaattttttgcttcactgataagttgatttctttttcctgcgctgtgactgcatgagaaatgccaacactgggctctctctctctctcnnnnnnnnnngctcgctcgctctctctctccccgcatcccctgtaattttttgcttcattaataagttgaagtatcttacctctgctgtgactgcat

SEQ ID NO: 110 - DNA, 5972 bp, Taraxacum officinale
gaaaacggacctgctgacaaattcattctagaagaatctgctgaaaaggataacggtgaagaagaagggtacatgaatgcttccctttcagatgaagaagatacggatggtgtaatctttggaagttcagaagctgcaaaacagttcatggaggagttagaacaagggtcaggtgaaaatgaaggtgagagttctcaagaccgttccatggtagttgatggccagattgtcacagattcagatgaagatgatgatgaagaagaagatgaagaagatggtaaagagcttttcgattcagcagcattagcagcacttctaaaagcagcagcagatggcagttcagaaggcggcaacatcaccttctcatcacaagacggttcaagactcttcacagtggaacgccctgctggactggggcccacactcaaccgacccgcacctcgacccacacctgcacaaacccgcgccaatctcttcaaccccgcaagcctcatgaccgccagtgaatccgaaaccaacttaagcgaagaagaaaggaaaaagctagagaagttacagtcaatcagggtgaagttcttaagacttgttcagaggttaggtctctctccagacgagtctgtagcagctcaggttctttacaggttagctttaatcgcagggaggcaaaccggtcagttattcagcctggaagctgccaaaagaaaagccatggagctcgaatccgaagaatccacggatcttgacttttcagtcaacatcttagtaatcggtaaagccggagtcggaaaaagcgccaccataaactccatcttcggagaagacaaaaccggaatcagtgctttccagcccgcaaccgattccgtgaaggagatacgcggtgtagtcggtggggtcacggtccgtgtattcgacacccccgggctacgatcctccgttatggatcaaggctacaacagaagcgtgctgacatcagcgaaaaagtccatgaagaaaaaccccgcggatatcgtcctctatgtcgacagattagacgcgcaaacccgggaccacaacgacatcccgttgctgaaaaacatcacgagcacactcgggcccgccatctggcggtccgcgatagtcactttcacacacgctgcttctgcgcctccggaaggttctaacggggtcccgttgagttacgagatgtttctgacacaaagatcgcatgttgtccagcaagcgatcgggcaggcggttggtgatttgaggatgatgagtccgagtctaatgaacccggtttcgttggttgaaaaccatcagtcgtgcaggaagaaccgcgaaggtcaaaaggtgctcccgaatggtcaaacatggaaaccgcagttgctcatgttgtgttactccatgaagattttagcggaagcaaacgcgctatcgaaaccacaagacccgtatgacaaccggaagcttttcgggttccgtgtgcggtcaccgccgctcccgtacatgttgtcgtctatgctgcagtcgcgggcccacccgaagatgtcgccggagcagggcggggacggcggtgattcggatgttgagctggcggatttgtcggagtcggataacgaagaggaagaagacgagtacgataacctcccgcctttcaaaccgttgaagaagtctcagctttctaaactcagcaaagaacagaagaaagcttactttgatgagtatgattatagagtgaagcttttacagaagaagcaatggaaagaggagttgaagagaatgaaggagatgaagaaaagaggtaaagatggggtcacggtgactgagcaagaagaagaaggtgaaggagatgcgccggctccggtggcggtcccgctacctgacatggcgttaccgccgtctttcgacagcgacaacccagcgtaccggttccggttcctggaaccgacttcacagttcttagcccgcccggttctcgacacccacgggtgggaccacgactgcgggtacgacggagtcaacctagaacaaaccctcgcggtcgccaaccgctttcccgcttcggtttccgtgcaagtcacaaaagacaaaaaagacttcagcatcaacatggactcatcgatttccgctaagcatggagaaactgggtccaccatggcggggttcgacatccaaccgattgggaaacagctggcgtacgtcgtacgcggggagaccaaattcaagaacatgaaacggaacaaaacggctgcaggaatgtcggtgactttcctcggggagaatgttgtgaccgggtttaaggtggaggaccaggtggcgtttgggaagcagtattcggttatcgggagtgcggggaccgttcggtttcagacggattcggcttacggtgccaacatcgaggtgcagagacgggaattggattacccgattggtcaggtgcagtccactttcgggctttccattattaaatggagaggggatttggcgttgggcttcaacagtttggctcagttttctgcggggaggaattctaaggtggcggtcagggctgggattaataataaaatgagtgggcagattactgtcaagactagtagctctgagcatctttcgttggcgcttgtggcggtcattccttccattatttccgcctacaggaagatgatgtcgggtggtggtgacaagtactctgggtattaagtgaaaggttatttggtgtttttggttttattgttgagttgttattgaataatgatgtgtttggtgtttaattttgtgtaatcaattactactctgttacgaagatgagattaaatgaagagggaaatactacggtagtaattatgtttttcgttattctttttagatgaccatagcctcacctaaaactatcaattggttggcttccttttcatccacatgatcatgttttgtttttttttatttacttttctccttcaaagctatttttgttgcaagaggtcctcatcaccatgaattcaaagcatttaaaaaccttaaatccaccaactccatttatgcttagtgaaagagacccacctccgaaccataaatgtacggtcccaactccaaacctctcaatattgaaataaatgtaaaccaatttgagaagcaaaggtcaggagaatatgaaaggcaaaaaaagacccaaactacacttgagttactttccactataagagaaaaccacctgactacataaataagaaagtaaatccagaacataaacaaggaagagactgagaagaaggataaaaaacctaaccacaccactaccatattaattgtttttaagattaaatcatgtatcaacatgaatagcttgtccttgtccacctgttgccacatgctggtcctggtcctcttgaaatacttttgcaattttctcaattggaatcaacggtagatactcagccaccggataacctttctcagccgtgtaacacacaccgacattgtacttcttcgccatgaaagccgctgtgggaacggctacttgagctacctgagggaacactggaagtttattcaacgaccgccaggcttgcaccgcgtacctctcagctacaggttcgtagcttttgtagagctctttagctgtcggctcgtattttatgtacagttttttcgccgttgctctcgccattctgaaagcctctaaagctacatctctagccacctcagggaagttatgagccacgtacttggcttggcttggagcttgtttcatcagcgagggcacgtggcggtttagctccttcaatgcgtcatccacctgcacaagacgacaacactaaccgactgagctaggagttgattttaatttcagctcgtactttaagtttattacaattcgaccccctgactttagatgtaagttgtcttattaactttacattcaccaatcaaaacgttatgtcgctttcggttggggactctctacacctactttactgctttgcgacaaacgaagatgcgtatggtggggacgatagagagagggaaaaggaaaaacaaatacctttagatcaaggaactttaggagctcataaggaacgtcatgaaacctctcgcaaaccggtccggtgatagttttaacggtgctttcgactgtttgtacaccaggcttcaacgcaccggcgttctctttgaagtattcgtaaacggtcgaaaagctaacaatgaaatagatcaccgcgctttgcacaaaatcgagatgcttcagacgatcctctccgccatcgctcggtaccttcaatttcacaatcggaattaaattacatcaatcggacaaaactaaagagattttacaaagtggagaaaacagatctgatcagaaacatagagaaaatcatactaaatcaattgttcatccaatgacagaagttgttttctacgtatctactacaattaacgggaatatcgtcctcctctacacagcaattaaaaatacggagaaatcagattaacgtacatctgtgtttatactttctaaataacaaaaacgaattcgtacttaaatcatatcctcacacagcaacataagctgattactacaagttttaaggtaacgtcgtcgcgtaaacagcaaaaaaacggaaaatcaaattaactcacatattgtgtatgtaactttgccaaaaatgtttcaatagaagacgcttaccagtggctcagtcgcttgattggcttcagattccgccatgatttacaagaagagaagcttcgagagcgtttgacggaaatttctgtaatgaaagagacgagaaaagaggtacaggactaacggcaaccaatgctatgataacaggttttatacgggcgaaccggatctagtgcggaaaattcgagaaatgtcgggtttaaaatgaaaaacccaactcctatcgcctcttgagatgcttacacgtgtcatatgctgacagttagtttaaccttgaaaatataacaaaaacaagtagcaattttctaaaacagcattgaagtcttaaatgtcaagtaatttacataatttgttttgtagttgtacgaacttgtatcgcttgtccaattttgctttgtattcgattatatgatttttgtgtttatacttgttgtaaagatagtatttttcatcatttgttatttgttttaagtggtttaatcaacatacataatttacacgaatatagaagtatttttattattcttaccattttcattatcgtcaccgtcttcttcatgtcagaatcgccacaactttatcattcttaactcttgttatccatattgttttaactttttgtcttcttttttatttataactatcaataaactcaatctaggtattattttgctcaaatcaatagtgcagtagtgctataactaaaaatgatgtaatcataaccgcttgccagccaagttgtaggcacatactaccattatttgatttctttgttaggctgtttgtaaacgtagaagaagaggaggaatagtgtatgtatatgaagaagacgatggtattttaatcatttgtaaaatagatcaccttgggaagagggatataaagagcaaacaaacagagttaatgggggctttataacggaaatccattagatgtaataatcagaatgataatacatagcttttctaaatagtgaagaccatccacatcaaattttgataatttaggcaaaaactttgtattggtgtcaactatagaaatctttattatgtaagtttcatattcactaataatagtattgtaatagtagtatgtaacaaaattaatacatatatcaattgtgatgaaagtttaaaaaataaatgtcatgtctagtatttattgaataatattgcttagtaaataatttataattcacaaaaaaatacatttagcatcactcttatttgtaaaaagaaaagaaaaaaggaggtgtttgtgtgttaaaaaatgtacatgtcgaattgtcgatattgaaaatatttataag

SEQ ID NO: 111 - DNA, 299 bp, Trifolium repens
  unsure (1)..(299): unsure at all n locations
  unsure (1)..(299): unsure at all n locations
ttttcttgattcatccaaccagtggcttgtaagacctgtcctagaaactcatggatgggatcatgnngtgggttatgaaggcttaaatgtagaaaggttgtttgttcttaaaaacaaggttgttatgatgtggataaaaaggatgctaacgttcagatggaaatggcaagttcagttaagtatgaagaagggaaagcaacatcgttaggttttgatgtgtagactgttgggaacattggttagtttaaaaatgagtcattttaaaaatgagagtcatttaaaaaatgacaactatacga

SEQ ID NO: 112 - DNA, 922 bp, Trifolium repens
gcatattagggccagcgagagttcacaggatgacagaattgatggtcagattgtaaccgactcagatgaagaagcagactctgatgatgaaggagatggcaaggagctctttgataccgctgctttggctgctctattgaaagcagcatctggagcaggaggagaagatggaggtggtatcaccataactgctcaagatggatcaaggcttttctctgtcgagcgccccgctggtcttggcccatcactccagacaggtaaacctgctgtacggtcaaatcgtcctaatctttttgctccttccattagtagagctggtactgttgttactgacaccaatttgagcgaagaagataagttgaaactggagaaattgcaagaaattaggataaaattcctaagaatggttcagagactaggttttactactgaagaatcaatagcagcgcaggttttgtatcggttgacacttgttgcagggaggcaaactggtgaatttttcagcctagatgctgcaaaggagagtgcttcccggcttgaagctgagggaagagatgattttgaattttctataaatatattggttcttggtaagactggcgtgggaaagagtgctacaattaattcaatttttggtgaaaccaagaccagcttcagtgcatatgttcctgctactactgctgtgacggaggttgttggaatggttgatggagtgaaaataagggtctttgacacaccaggtttgaaatcttctgcatttgaacaaagttacaacagaaaagtcttgtctaatgtgaagaaattgaccaaaaaatctccccctgatattgttctatatgtggatcgccttgatctacaaactagagatatgaatgatttgcccatgttgagatcagtaactagtgcccttggtccgtcaata

SEQ ID NO: 113 - DNA, 707 bp, Trifolium repens
agacaagcaagatttcagtattcacttggattcatcggttgcagctaaacatggagaaaatgggtcaaccatggcaggttttgacattcagaacattggaaagcagctggcatacattgttagaggcgagtccaaattcaaaattttcaaaagaaacaaaactgctgctggagtgtctgtgacttttctgggtgaaaatgtgtccactggcgtgaaacttgaggatcaaatagcactgggtaaacgattggtattagtggggagcacagggactgtgcggtctcaaggtgattctgcttatggtgccaatgttgaagtgaggcttagagaggcagattttccagttgggcaggatcaatcttcactgagtctttctctggtgcagtggagaggtgatttagccttgggggctaatttccagtcgcagttttctcttggacgaaactataagatggccgttcgtgctggattgaacaacaagcttagtggacagatcactgtgaggacaagtagtgcagaacagcttcagattgctcttattgctattcttccaattgccaagactctttacaagaacttctggcctggagctagtgagaagtattccatttattaagttcttttgcttatgctgctagttaaggaagtagactatgaggtaataatgtgatgctgcatcttttcattaatttcttgaataatgtatt

SEQ ID NO: 114 - DNA, 317 bp, Trifolium repens
ttgtcccttaatgtgaaatagttgcctcaaatgatctttgagaaatatgcattatgaactctatgcataatggaaaagttggatggttcaaaactatttgatatgaaattttattcaaaatgtggatggtatctgtcagtgatgttgtatctattattgtgatcctaatttttccgatgccagatatgtccttgcctgcttcctttgattctgatacccccactcaccggtttcgttttcttgattcatcgaaccagtggcttgtaagacctgtcctagaaactcatggatgggatcatgttatgaaggcttaaatg

SEQ ID NO: 115 - DNA, 1593 bp, Trifolium repens
tcatctggaaaatctgttcctactagcacccctcttgttcgtcctgctggccttggatctgcagctccattattggaacctgctcctagggtagtgcagcaaccacgggtgaacaatactgtatcaaatgtacagtccccaaaaatggaagactcctcaactggggaggccgaggagtatgacgagactcgagagaaacttcaaatgattagggtgaagtttttgcggctagctaaaagatttggtcagacaccccacaatgttgttgtagcacaggttctttatagattaggactggctgaacaacttagagggaggaatgggggccgtgttggcgcttttagctttgatcgtgcaagtgccatggccgagcaacttgaatcagcaggtcaagagccacttgatttctcttgtacaataatggttcttggaaagacaggagtagggaaaagttcaacaatcaattctatctttgatgaggttaaatttaatactgatgcttttcatatgggaacaaaaaaggttcaggatgttgtgggaaccgtacagggtattaaagtccgggtcattgatacaccaggacttctaccttcctggacagatcagcaacacaatgagaagatcctgcactctgtcaaacgctttattaaaaaaacaccaccagatattgtgctgtatcttgatagattagatatgcaaagccgggattttagtgatatgccgctcttacgcacgataactgatgtttttggaccaaccatatggttcaatgctattgtggttttgactcatgcagcatctgctccacctgatggtcctaatggtattccttccagttatgacatgtttgtcacacagcgctctcacgttgtgcagcaagccattcgtcaagcagctggtgatatgcgtctcatgaatcctgtatcgttggtggagaatcactctgcatgtagaactaatacagctggccaaagagtgttgcctaatgaccaggtttggaaacctcatctgttactcttatcttttgcctcaaaaattctggctgaagcaaatgcgcttcttaagttacaagataatccacgtgaaaagcctttcacagctcgtgcaagagcgccaccattaccgtttctcctgtcatcccttctgcagtcaagaccgcaattaaaattacccgatgagcaattcagtgatgacgacggtctcaatgacgatcttgatgaaccatcagattctggtgatgaaaccgaccctgatgacttaccaccatttaaacctttgacaaaggcccagataaaaaatctttctagagctcagaagaaagcatatctggatgaggttgagtaccgagaaaaactcttcatgaagaaacaattaaagtatgaaaaaaagcaaagaaagatgatgaaggaaatggcagaatcagtgaaagatctaccaaatgaatatgctgaaaatgtggaggaagaaagtgaaggtgcagcttctgttcctgttccaatgcctgatatgtccttgcctgcttcctttgattctgatactccaactcaccggtatcgttatcttgattcatccaaccagtggcttgtaagagtc

SEQ ID NO: 116 - DNA, 579 bp, Xanthium strumarium
gcctcatcgcttgctggtttgtatatccagactgttgggcggcagcttgcatatattctccgtggtgagaccaaatcaagaatatcaagaagaacaagaccaccggagggttctcagtaactttcctgggtgatattgtggcaactggactgaagatcgaggaccagctctcccttgggaagaggctgtcactagttgctagcactggtctgatgaaagcccaaggggacactgcatatggagctaacttggaggcacgcctgaaagacaaagactacccgattggccagtccctgtcaacattgggtctttctctgatgaagtggcgtcgggacctcgctctgggtgctaacttacagtcacagttctccatcggaaggggctcaaagatggcggttcgacttggtctaaacaacaagtgagtgggcaaatcaccatcaggacaagcacctcagagcaggttcagattgctcttatgggtctcgtgccgattctagcttccatctaccggagcttccggcccagtgaaccatcatttgcttattagcatatcaggaagagttttggactacttattag

SEQ ID NO: 117 - DNA, 2858 bp, Xanthium strumarium
cggatacatcccgcatcccttgcaactgctaccacaagagcagcttgagccgcagccacactttccattgcagcaagacatgatgatcgactagaaggtgttaaaagagttgatttggaagataggttgtgaacgtaattgatagcaagttttcgcctttggatgttgaagatgtggagaaggaggttgattatgcgggtcaagaaaatgagcctgtggtggtcaaggctgctttaaatgatgtagaaaatgtttctgtggctgatttggagggagatgcggctcagtcaacggaagttttgaccaaagctatgcctgaggatgcagattatggtctagataacggggcggctgacaaatttgttctagaagaatctgcagaaaaagatgatgttgatgaacaaggctacacagatggttcccattcagacgaagaggacacagatgaggtaatatttgaaagttcagcagctgctaagcagtttattgaggggttagaaggtggtggtggtgagagttctcaagatcgttcacaaatggacggtcagattgtcacggattcagatgaagaggatgatgaagaagacgggaaagagctctttgattcagcagctttagccgcccttctgaaagcagcggctgatggcagttcagaaggtggcaacattacattctcttcagaagatggttcaagacttttcacagttgaacgccctgcagggttagggtcttcgctccaggccatgagagccgccccaagaccaccccgtgccaacatttttaacccttcaagtctaatgagtgctaatgaaacagatctcaatttaagtgaagaagaaaagaagaaactggagaagttacaatccatcagggtgaagtttttaagactcgttcaaagattagggctttcaccagacgaatcggtagctgcacaggttctttacaggctggcacttattgcgggccgacaaacgggtcaatcttttagtcttgatgctgctaaacgtaaagctatggagcttgaagctgatggaaatactgacctggacttctctgtcaatattttagtcatcggtaaagctggggtcggtaaaagtgctacgataaactccatttttggtgaagaaaaaaccccagtcggtgcttttcaaactgccactgattcagtgaaggagataactggtgtgatgggtggagttactattcgtgtgtttgacacacccgggcttcggacctctgtcatggaacaagggtataacaggagtgtattatcatcagctaaaaaattcacaaagaaaaacccaccagatattgttctctatgtagaccgtttggatgcccagacccgagatcataatgatattccattactgaagaccattaccagctcactgggctctgccatctggcgaagtgcaattgttacttttacgcatggtgcgtcagccccaccagaggggtcaaacgggacccctttgagttatgaaatgtttgtgacccaacggtcacatgtggttcaacaagccattggtcaagcggttggtgatttgagaatgatgagcccgggtttgatgaacccagtttctttggttgaaaaccaccagtcttgccgtaagaatcgtgaaggtcaaaaggtgcttccaaatggtcaaacctggcgcccccagctgcttatgttgtgttactcgatgaagattttatcagaggcgaattctttgactaaaccacaagacccgtttgacagccggaagctttttgggttccgcgtgcggtctccgccactgccatacatgttgtcttcgatgttacagtctcgggctcacccaaagctagcaacggaacagggtggtgatgtgggtgattcagagattgacctggcagatttgagtgattctgaccatgaaggagatgaagatgagtatgaccagctccccccgttcaaaccgttgaaaaaatctcaacttgctaagcttagtaaagagcagaaaaaagcttactttgatgaatacgattaccgcgtgaagcttttgcagaagaaacaatggaaagaagaactaaaaagaatgaaagaacttaaaaagaaaggacctgatggtttggctggtcaaaattaccaggaagaagaaggtgaaggagatgcaccagcacccgtggcagtcccgttacccgacatggcattaccaccgtcttttgatggtgataaccctgcataccgattccgattcctggagcccacttcgcagtttatggcccgtccggttcttgatacccatggttgggaccatgattgtggttatgatggtgtcaatgttgaacacaccttagccattgccaaccgttttccggctgcagttacagttcaagtcactaaagataaaaaagacttcagcatatggattcatcagtttcagctaaacatggggagaacatgtctactatggccggttttgacattcaaccaattgggaaacagctggcttacatagtcagaggcgaaaccaagttcaagaatttgaagaaaaacaaaaccgctgcagggatttcagtcacatttttgggagaaaacactgtagccgggtttaaattggaggatcaaattgcatttgggagacaatactcaatcatcgggagtgcaggcacagttcggttccaatctgattcagcttatggagccaacatcgaggtccaacgacgggagctggattacccaattggtcaagttcagtcaacaatcgggttatcgatcataaaatggaggggcgatttggcgttagggttcaacagtttggctcaattctctgctgggcggaactcaaaagtgatggttcgagccgggattaacaataaaatgagtgggc

SEQ ID NO: 118 - DNA, 1273 bp, Amaranthus palmeri
cttcagtaggtacctttcactcattgagtcatttttatgagcttccctacccacctttctatcttcctctcaccgaccaccgttcctatttcttcttgtttctctcatttctatctgcttccctaattacagcggaatctgtgtgttaaccgatggtcgactgactcggtcccgcttcatcatattgtcaaactcgggcagtcaaggaatatatctacctgttacatgtgagtttagatgaaagcgaagagacagcgacgataacagagggtttagtgattaattaactcagaaacctttgggtttgattttgtagatttgctgaacattcaactcaaaccatttacataagattttattcatgattatgtagattaaaatggctatccaagtagttcgtgaatgggttggaattcagcagtttaccggagcaacttaaactaaattgcttgaattattgggaaaaatgaaacaagagaatgtggattcttcgactatccttgtaatgggaaaggtggtgttgataaatcttcatatgttagtcgttggtgaacaagtggtagctattagtgcttttcagtttgatgaggctagggtagctatggaaatggatgcacatgagaaaaaactgcaggaagacttagagaggcaagatattttgaggaggaagacaaggtcaccaagcaaagctacgcgcatgttatctgggactcaagaaaaatgtacaacttgctctaaaactgtttatcccttagaaaaggtgacagtggaaaaccaattctttcacaagtcttgttttacgtgctctcatgatggctgctcaattaccccttcaaactatgttgctcttgatggaatcctatactgtaaacaccatttctcacaacttttcagagagaaaggaagctatgcacatattatgaagtccgcttcaatcaagagagcggcctctccagttcctgatgccttggttgctacaattccagctcccgaatcttgagtttctgattctttttttctcgaactatcccaataggcatcgccttcatgctgcgtgattactgtgatagattgacaaaaagacttgtgcctctctgttttgttgtgttaatattctatatcgactacggtgtttgcttccattgacaagttctgtaatggcagtaatgctttgaggatgaattgacttttcattaagagaaactagagcttgcctaatgccttactaaaactctctgtatggaaaaagaaatgtcaaaattcattgtatcct

SEQ ID NO: 119 - DNA, 2380 bp, Amaranthus palmeri
gttcgttttctcaatttgattttgtatttgttggattagggtttgattttgtagatttgctgaacattcaactcaaaccatttacataaggttattgtttttctcaatttgattttgtatttgttggattagggtttgattttgtagatttgatgaacattcaattctacaagaaaattttcgtactttacagctttatgcttttgttttgaagttgggtttattgtttgcagattttattcatgattatgtagatagaaatggctatccaagtagtttgtgaatgggttggaattcagcagtttaccagagcaacttaaactaaattgcttgaattattgggaaaaatgaaacaagaggttaggtcaaattctatcatctttcaacagtctttttaaatcatgtaaatttgttggtaattagttgatgaattttgattaattttgttgtatgtaatgttttgggccttttggctgtagaatgtggattcttcgactatccttgtaatgggaaaggtggtgttgataaatcttcatatgttagtcgttggtgaacaagtggtagctatcagtgcttttcaggtatggtcacagattcattgtatgaatgaatgtctggaagtgaataatgaaaatgtatgctaatgactttaatgattactcaatgtcaattctaatgactagaaggaatttgatattttttttgctgacaaaatcatttatttaattacgctgatatgcagattgcaaaagccacaatcttccaaagtgtcattgacttaaaagacaaatttgggatggaagatcgtcacaacttttaattttttattctcaggtattagagtggtgaacttgcattatgtttagttttcaatttgcatcaataaaaaaaattgcaaagggtagactgattttggtgatatctcggtgtgtataggttgtaggtactctcaattagttttttctctataacttcgcctcattcttagttgatttgttctttaacgtgttatgtatttgtttatttgagattgttggacatcaaccaacatccaaagtgaatgaaattctcttactaaagtagttgaattgagataagtggagtaattttaagtttaaactggtcaaataaaactaaacttgagtagtcagatcaattaaaactccacttagaattgttcgaccaaattgttttgataaacctaagatcttagccatctagattgcagctcctaattctatttcggatgtttcgtcttttgttttgttagtgtctctcttgttctgatttctatcatggcctctgcgtttgagttgtagccttgtaggttcttcaaattctagaacatctctattgtgataatgaagaattcaaggtattggtattaaggatattttgttgctgttgatgttgatgagggtataatgtatcactccttgttaattattttcttatgttatttatattgcatttgttaaaattttgttgtagtcattttcgaaagatcaagtacatagagtagtttgagtaatggagagttcgagtaatatggttttttcctatttggattgtgaagtattaagagtattttttgatttggtattatggttatagtgatggatgggtttgttgattttgtttcaattgttgatctttttctattacagagagtctgagaagtcagaagtttcttttacttgatcagatgggtgctatgttgagcttctgatttgtggtatccaaggtatgttgctgtagatgatcaggctggagaaacgcagggttcatgtttgtttgaattgcaaaacagcttccaagaaatcaaggacataactgtgaaatcatgccataaattaaagattgctcatgatgcttgatgtattgagatgctgctgttatgctgtggagatgttgcaggccttatgatggagtgctgctgtgtcactatgtgtgctgcctgccagattgctatgttggtctactgtgatttgaagttgatgagtgctttgaatggatacaaggctgctgctgcattactgttattaagggctgacaaggctgagctactgctgctgggttgggcagctggtttgtttgatgctgctgcactctgtaaattgtaatggactatgctgaagctgctgcatcaatctgctgtttgaggaggatattttacttgtggatgcttgatgctagatgttgtgctgctggttttgaagactgctgctgctgcatttgagatggtagtttggtattgcagatgaggatgatcttgctttgatgcttcaatgggtcttggaaattaggtgttgttgcttagtatttaatgctcttctgtttaagacctgttttgcgttaggctcaatgggtgtatgtttgc

SEQ ID NO: 120 - DNA, 13652 bp, Amaranthus palmeri
attactgatatttatagctttgacttttttattttctaattatgactaatattatcaatattgatttatttttactttttaggtcatatcatttaatatatgataaaatcatatatagaattatattttctttcaattatttataaaggctttataatgttataggatattttgagataattaagacataaaactatcaatttttaatttttattcaaataaatatcaaaaatttaataaaacggtgcatacggggcattatctagttacatactaaactaatcacttgtagtggtagaattgattaattaattaaattattaaaatactaaaagtctaaaactctattaaattgcaagaaatataaaatcaaacccttaattaattaattagaaatgaaccctatattgacccaaaatagattaaccctaaatagattaatcattaacctattcatgaatgaacaaagtcaagaaacaatgtttaacaatcaacacaaaccataaataaaaatcaaattaagtaattaacttaaatactcaatcagaaaatcagaaaaatgatggggcaagtgacgacctgctgccgcctgcctgcaccacgtctgttgcctgcacagacacacacgactgacgacctggtggcgagtttccggttgccgccttgccggagtgaaggagtagaggaggtctcagatctgggaaagggtgtgggatggaaactgggttttcgaaatggtgaggggtgggtatgtctggactttttaaatgggaattaattgggagttttagaaaaaaaaatctttaaaattgctgttatgaggacttgaacccagggtatatgctgtcaaataccaaaactcttaccaactgagacacatttaacatcaacataatataggaattgagcatctatataagtcaaatgctgtcaattgactgcattgacttagtgtgcatccgcccctgagtacaaaataagttaaaaaaaataagtaaaaaataatactattagtattatttttttttaaaaaaaagaagccgcgcaacaactcaataataaatagttttccagtctgtttcctgttttgcatttctctctcttgttccacccaacttcgcatcttccaatcattctcttctatattctataccaattccaaattccaattatcagcttctgcatttcatcttcatccctttctctttctctccttttcctttccctttcaccatttctgctcttcaaactctgtaattcaagctttgtatttcttcaccaaccattgtaaatatctcaacttcttcatttctacagcttttaacttctatttttgaattgacccatgttttatttttgttgttttcagcttattttttgttgctcaggcagagacctaaagaaaaggacggataagtaagtggggagcggattctgtttatagaagataaacgatgtcgtttacaggtacccaacagaaatgcaaagtgtgtgataagactgtttatttgatggatcagctttcggctgatggtgttgcttatcataagtcttgcttcaaatgtaatcactgcaaaagcaggcttcaggtttttctctttttattttgtctactctcatactaacattttcctggtttttatggtcttgacttcattgtttagtctaatttgttctaagttttaactaaatcgtaattgaaaaactgggcaactggtatccattgttttaatagaaattctaataatttgaggatttttcttgattttgttttgtgcatttagggttgtttatgtatgtcattgtatatatgatctttaaagttgtatggtttgtctttacggcattttgatggttgataggtaattaagcttttttaatggggtttacttttcagatttgaattttgaatttataggtcttggtgcttcttttacaccaaaagagaaagggtattttgctgcactgtatatgggtgaataaagcaacattgtatcatatcgtcttatctcaaatctaccaaactaatgttacctggatcgcaaaagtgtaatcgtgtttttgttcggcttaaggataagatctcatgatctttcttttaccacattaccatggttacaacaagtaaaaccatattttaagtttgaaacaagagaatataaaatgctggaccaatattgttcttgcacttcggatgtatactaactgtggttgagattgtcgttaatattggctaatttatctcgtatcgtgcttgcagctgcatagttattcttcaatggagggtgtcctttactgcaagcctcactttgagcagttattcaaggagacaggaaatttcaacaagaattttcagtcccgtataacccttattcttaaacccgatttcaaagtttttctgtttacggacctgttttttttatctatctaaccgagatattttttgcccctgcagctgctaaaatactagctgaaaagtcacctgatgtgaagcctgagttggtaaacatctcttttatatcatgctacttatatgggcgattttgttctttcttctcttatatcccatcatacaatttggtttcagacaaggtcgccaagcaaagctgcgagcatgttttctgggacacaagaaaaatgtacaacttgctccaaaactgtttatcccctagaaaaggtatttcttaataacttgcactttcatttgttgggtttcgcattgtttctttgtttcagaataccgtagtgcaaataccaatctcccttacccctaaagaaatataaatgaaaataatgttgtacttttatatactatatcaatttatggtagtgatatggcttgaaacaatctcacataagaaacatggcggagaggttgtatatggttgaagtttatttcatctaaagtgctggtgtcggaccctcgacacttacacttgaaactttgtttttactaaaagcaacaaaacgcttctgaaaatgaccaagtttgatgaatggacattagatatgtacctttaaggctatgtccaaccaaattagatcaacatatggttatttgaatgtgattagtgaaccaagagtgtagtcattgttttaattatctggtactggtgttaattgattcgtttgcaaaaaccgtaccaggtgacagttgaaaaccaattctttcacaagtcttgttttaagtgctctcatggtggctgctcaattaccccttcaaactatgctgctcttgatggaatcctatactgtaaacaccatttctcacaacttttcagagagaaaggaagctatgcacatattatgaagtccgcttcaatcaagagagcggcctctccagttcctgatgccttggttgctacaattccagctcccgaatcttgagtttctgattctttttttctcgaactatcccaataggcatcgccttcatgctgcgtgattactgtgatagattgacaaaaagacttgtgcctctctgttttgttgtgttaatattccatatctactacggcgtttgcttccattgacaagttctgtaatggcagtaatgctttgaggatgaattgacttttcattaagagaaactagagcttgcctaatgccttactaaaactctatggaaaaagaaatgtcaaaattcattgtatgctttaaaaaacattattcaaactgttccttcagaaaatcatgggacataagtcatgacccatgacctcagataaagtgatttcttttaatttactctttcagtcctttagaatttgtaaaattaaactcacatttcaaaaggatagagtagtatgatattgtgattgttgaacggtttaatttagatttacaatatgaaatctttaatttctttcgtacaaggtttcttaatatatgaaataatagaagtattgcctttatttggaattacttactacacatgtattagtaagtaatattcatcaattgacgtattattttatttttatcagaaagaaaacatgattaagtgtgattctctttagtaatgagatgtaaattaagtatatttagactagatctttattctttattatagaagaaaaatacatgccacatacactctcatcacacaatttatgtacatatgctcatcctcaaactgtgactagtaattggtatgactgttttatgttgtgtttaatagtagcatttgaagaaaatgcattcgtttacttcctatatatacacacccaaatttactaagagaagggcaattcaaagagaagtcatcaagcaacatattacttgtatttgcaactgtatctctttcatcgtagaagacggctgcttccatcgtaagctgagatgacgccactgctctgaccggaatcaatttcgcttgttccgtcataggaacttaaaacaacactcaggctctttctagcagtctgaatgatactctcgatttcttttaccacttcactcattgaaggccgcttgtatcctgaatcctcgacacacaacagtgccaattctgtaaattcctcgatgcaaatcaaatttccagaacgtatgacggggtcaacgagattgtatatgtatcctgtctcattcattgtcaccttaacttcttggacaatatatcccttgtttttctctaatggtggccttccagttatcagctcgagcatcactactccaaagctataaacatcgctcttctcagttaactgtctgcctgagaggtactcaggatctaagtacccctaaaaaatgagtatacattcaaataaatacacagaatcagatcactagaatgacttcagatattaactaggatcttttgggaggaggggcaataaatacatggttctaccaccattaatgaagatgactaaccattgttcctttaatttgagaggtggaataatctgtatcgttcttcacgagtttgcagagaccaaaatctcccacttttgcgttcaaataatcatcgagcaatatatttccagatttaatgtctctgtgtatgattggtggatctgcaagctcatgtagatatgccagacctctagctgcaccaagggctaccatcaatctactcatccagtccaatcgaacttccgaactccctgtagttgctcatcagtatacaagtagtttcagctcatccaagaaaatgctactataaattccagaaattaaaactatcatccaagaaaatgaaacgttcatttacacagcttcctcaaaatatgacaccatttaatagcagatgggagctatgtctcaatttagaactatcaaccaaagtggtccatggaagaactggcaacaacaacatgccatctcccttagtgccaagtgactcctgcctaggctgattaggaagaacctgtaatactgagaggcataggctatatatgccactataagtcaaacacgaaataaatttttgtgttaccgtatttgcaaaatacttctattgcctctaaaaattcatagcctattttctgataagaaaccatgtgaaaatgctagatttttaagttcaaacacacgacttagaattaaaacttcacaagcattcttgaattgcatatggtcttagctacatgcctacatcgggatttgaagggaaaaaaagattacctctaagactcgcttttaagctgttatttgggacatattcataaataagcatctgttcatctttatcaaaacaaaacccaaccaaactgacaatatttctgtggtgaacccttgataaaagctcaatctcagttttgaactcatgcgcactctgcaatgagtctttctttgctcttttaattgcaactagttgttcattgtcaagtttccccttatacacctgaaagcagaatgtctccgaatgatcaaatcatattacgtatagctctaactaaaaacttatacaactaaatatttctgaataataaattcaccaaaataaagccataaaaattgacgaaagaattttcatttgttatatcactaaacaatgaaaagaatgaagaacagacaaaccattcaaatagtttaagtcgtaaatagtaatcttactaccaaagatatcctacgagatatgagacgtaaggaacactgaataagagagcaatcaccttcccataacctccaatcccgatctcacttgaatgtgaaaagttattggtgcaacgttcaatgtcttcaagagtgaatactttaactcctttcagttgtggaaggtcacctttattccaggttgctgcatttaaatgaaaagcattacgtgtttttaaacacacccctagaaaaaccaatattcaatatagttatgcagggttggcgaccaatcttaccaaaaggattatttaatttgatcgctcttatagctattttcctttgacgataggcataagctccaatgaagattgttatcagcacgagcacaaagatagatatcgacgtactaataatgaggcgatacctaagtttcctcattttacatatgtctaatttgcatgacattagaacaggttaggtagaagagaggtatcaaatgaataaaactaaataaaaatgtgaataatattcctcttgagtaactaaaagtgtattttcacctggatcattacaaactggagtgtgcttatatggtaattgtacattaaaaatatgctcttggaggatattcccaatgaatgagattaatgattgattaaaatgttcaccctcaggaggaagtattgctatttctaacacgagataatcatatgaagggtctatccttgaacgaaccaaacatatttcacttatgtggggggaaccaatagtactcttgagtgtattattgaagttatagtaagatgaggtgtgtaaatcagaaaagttgtaagatagaaagatcaaacgaccaaggtagggacgtttacaagcttttttacgctggttctcgaagcaagatagagaaacacattgtgtttgtggtatatactcaaaaaaatcaattggtaggtcatcgttgcagtttccttgagtttctccctttctgcagactgtttcgccatcaaatctgcaaaaataattaaacaggactcaggagttgctcagttcaggcaggatcaccgaatttcggctcaagttaagcagtaaaaaagaaacatacagactgaactatacttacagaatcctgtaattgtattctcctgcatctatctcatcaatggaagtattccgcaaatctataaagcgaagtttactgccatagccagtctcaagattcacagtgccattgagtttgttatttcttagtagcctattttcaaatgtaaattgtaatcagtaacacgacatggaaacacgttattgatgcatctcatatttatctttcagacaaatagccaagtcagaaagagaagcaaaagataatacaagatggcaagagaaaccatacacagtttgcagatcagactgatttaacagtgctgctggtatttggcctattaggctagtgttttccatctttctgcaattgagcatcaaaaaagtaagatctacgtgtacaaacataagcaacatgtcatttctgtcattacaatatccttgaaccgttgaacgtcatgacacaggaacaaaatgcctaagtagtcattacatacaaaatcaatgttacatagcaagagccagtatatcttagctgtcataaaggcacaaaactatatgcttacaaatggttcaagcttagcactagtgaaatagcctttcttgtaaatgtaaacgtttcttcgatatatcccaacaagaaatgtatgctaagcattcttctataagattttccgttgtgagcagtagttttgaagtacaatacaagtcctccaagatatattttacccaaataatcagaaaaatttcactagaatgtatgacacagctcataagatgcttccacttctgttatatttcttgtacatcatcatatgaaagtgataggaagtattacggtcctccctagaaaaaatgaccttgaatatctaagccctcttcattttgtatttgaagaggcctgcaaatgaaaagtaagatggctgaaaaaacaaataaaaaaagagatacatacagtgtagtcatttttggcaaagttgagcaccatagaggaatttctgattcatcaaaactattattactcagatctctgcgatgtgcaaatgtagaaaattaaaagtgttatttgatttagcatatctgttagatagaaaatggcaatatttgttactcacacatatgcaagggaatgcatttctgaaagatcagggactggaccaatcaagctattgttagccaagttcctaggaaacaagataagtgatgatcaatttactctaaatatcagtacaatgaactagcctaggtatcaattctgattgtttatgtatacttacaattcacccacttttgcgagcctactaagattctgtggaactaagccactaagttcattcctgtccaaacgactgcaacccatggttagatggtaagttgtctacttgtgtagtagaaaatcagttgagaaaaataactcataagaaaaacttacatgacctccaaagaaagcacatgttctaatgtgtctgggatacttccagttagcaggttgtcattgaaaattctgtcagatcatataaccagcattttagttgggtacttatgtttgtattacagttgcaaggtagcaaataaattacaagaaacagtgaagttttactttccggtgtacattttggttagattggcttgataactttaactaagggaggtgagtcaaaaatctttgaactttgaatttacatggagtgatagactagctgattaataaataatttgcaaaactaagaaaagagatggaagcttgggaaaggtaaggaagaatgctgaaagtttggatcaactacaatgattctgaatgccgttggataaggcttttctttgaggttcaaacatcttgctctgaatcggagactatattttgttcagggtacaggtcatgaagatatcattttaggaaataaaaaatttaaacggtgtaaaaatgttagttcaagaagtcaaataaaaattgcattttccagaggtatcattggacttacagatgcctcagcttcatatcgacgtggaaaagttcacgcggaatttctccagaaagtttattttgtccaaaatgactgcaaacagagagtattggtttaccatacaagaaaagaaatcatcaaacaatttcaacgagatgtccatacaaatgttctgcttcatgtagctgatccaggcctggtgttgtcttgttagatattggcagttttccgttcaattggttgttagtcagatcaagccagagaagtttccggagatttccaatagaatgtggtattgatccattgaagttattcgaattgagaaacctataagacatcatgaaaacttagaggggaaagtagaaaagtattgacattcactgttatagatctcggtggaagatagagatgaccatgattcgttcggaccattgaatcggccatcaatttggatcaaaaaactttgaacctgaacctaaactggttcgactgggattaggttcggttcaaagtttaattgacaaccggtacaagttcagttcgatgccgacttaattagtcaatttttcacttttttaaaaaaaaatatattaaaaattcttctttttacataaacatcaaaaaatataaatgtaattgtattgctaagatacgggagtagagtaaaagaaaattcaagagagaagttcttacaatctcttgagctgaagcatggatcctattgattcaggaatgtggccagagaaactacagccagacagaatacttcatgaagaaaaaaatgtgagattaatgatagcgttaaatgtttggaaggtgaattatgtagcattagagaggataaaaatcttacagtatttctaaattcttcagacttccaatatttaatggcagactaccagtcagcttattgttgtctgaaagatccctgaacacagaaagcacttcaactcattagagaagaattaatatatagtgataaggtggctatgatggaactaagcgaacctgcagagacatgtatcaatgagaattcatgtgtcagattaagtagacattttaagataaattgttaagcacattaccaaattcaataataaattttgatcatattgaatttatttgactgttaaatcttagcccagaataagtaagttgaactagaagatgcatttatctgctgtactaatcagtgctttcttccctatttaacacacattgcttggtaactgattggtagaaatgttgcaagttctaatcacaggcattttctcacgtcagattagaaccacatacagcttcttcaactcggataatgacaagacaacttgaggcagtgaacctttcaatttcgcacgtgataataatctgcaatgtcaagtaaaaatgttaagttggatcagctcttacataattgtgactttgtgagtaagactatttataacttgcagaaaaacactagcaggcagcagcaaacttacatagtagtcacacgggagcctttgcagaaaataccatcccatttttcaccacatggatcaattccgtcccagttggatggcgtgtttttccattgttttttaagagatttaagcacagccactgcatcagctccactcaatcagaaactttttatttcactagagaactagatagatgtgcctcatttagtagatgagtataaaaaagtagtactatttttctgtccgttagatgcagaagatcaccaagaagaggttcatgcattttttttcaatcttctgtttataaagagggcagatacaaacataactagaacaaaggtaagcagaagcatcttctcccaaaaaatcgataaaacgagcaaattataaacaagtaatcctaatgttacgattttggtcatcgaataaattttctttgcacatgtaaaactgtaaaagccaatgctcataaaaaatcaaaaaccataaaacaattttgacaaagcttgatgaagctcattcattacaattttatagacaaagagatgtttcaaactccatccattgacgagttaaacttgaaaagtgaaatctataaagctatggaattaaggtgcctaaagatttcatgtgctttttgtacagtttaatttctccaatttatgatttgccaaagcctaatcatgtatggaaagtcatgatttagcaatattacaaaagacaagaaatagaattatttaaaccaacttacaatcattcgcatctgtttgtgctgtggcttcaatgccaatatatgaaaatataagcaacatgcatgccaaattgctagaactcatggctacagtcaaccaaatagtaattgattcggttctagggacttcaaagatggagtaaaatgtattatcgtcatctacctcaacacagttcattaaaattaatacttacgacttacaagtgatgaattgtgagtaatattttataaaatttaatattaatacaacttaataacaatttgttataataagcgaagttcaagctgctgaggactgaggaaataacaagtgtacaaggtcccctctcaaagaacaaatgttgctgtcaataaattcttcaatcgttttagagaaaaggaagttggatgtaaacataagcatagagtattacaaaagcacagacttcgtggaaacccatgatcatattatacaaaatgcataaggttatattatccaattattccaaagcttgaactttgaacttgacttttaatttgttttgaatgattcactagttttgaccatgtaaggacaggtggaaatccctacatgtttctccttggattattataataacatttaccctttcatattattgtattagcaaaactaatgaagctgaaaaccttaccaactttctggcaatcaaaagatcctccgatgttggacagtgtcaccccttgagtttagcaactcaattcttatctaaacttgcctgcaccttcaaacatcaagtaaaaagtcaaaatatattctcaacagcttcacaatgtttttttaaaaaaactttagacaggaagtgaagatagacaatgattcaagtttttatttacattaaagacaaaaaaagaaagctttggcaaaagaaagaagggatttcattaatcaaaaataatggttatactcaaaagatttaaagtcataacatcagctacgctccgacgcctttaagaggactaaacctatgtcagacagctcaagaaaaaagattgggtcagaccacaaaccaagtgacctaatctgaaatgttataatgcacaataaggatgattgctgcccattatatacaaatgtgcagaatactattctgaacaaagtaaatagtgtatgtaaccaacagggacatttgtacagatgatttgttatctaacgacaggaccgcttcctatgatatcaaaggaaacattgctattgctgctataaggataaccattatctcgtgctccaccatagctcgctgaggaggtaattgattcaatatcatagttcagattaatggcttcaatcattttctcgatctctttcaccacttcactcattgaaggcctatcatctcccatgtcttcaagacacctcattgccagtttcacaaactcttccgtgccactcagaatgtctgattctgaatgcatggcagcatccacaagactaaaaacattccctgtctcctttagttcctcccttactaatctgacaatgtatttgtttttctctaatggaaaccttccagtcaccagctccagcatcaccactccaaagctataaacatcactcttctcagtcagtaactgggtcatatagtattctggatccaaatatccctgcacgagcatgacaggaaatgtatgaacaatcttcacagctttcttctttctctccctcgacgaaaaaaaaagaacaagtgtataggcattaaatactaaccaatgttcccttaacttgggtggtgaactgagctccatcgtcactaagaagtgtggacagaccaaaatctgccacttttgcatttagacgttcacccaagaggatattgtcggatttaatgtctctgtgtatgatgggtgggtcagcaagctcatgcaagtatgctaaacctctagctgcaccaagagctatttttaacctcttcgtccaatttaattgaatttcagatttccctgcagccggatcatcagcaaatgagtaatttcatccagaagacaatgcaagaatcaaagtatcaagtgtacccaatactctagttgagtgagtttcacgatataattgggggattaatgagttcacaagttttgtcccttaagctaacttagagcgactaattcgaaggttaaaagaaggctacgaaaaagatacactgagaagaatcaatataaaaactaacaatttaacataaatttatgatccaagatcgagtattagtgttcttgaacccgttgctttcgttcttgagccactcgggtttaaatcttttcataagctggaatttgtcacatgcttaacttgaaattatgttgaggatatgtagctcgccc

SEQ ID NO: 121 - DNA, 6538 bp, Amaranthus palmeri
aggtggtgttgataaatcttcatatgttagtcgttggtgaacaagtggtagctatcagtgtttttcaggtatggtcagagattcattgtatgaatgaatgtctggaagtgaataatgcaaacgtatgctaatgactttaatgattactcaatgtaaacattcttggttttggtatgttactgcttttggaaattgacacatgttttttgttttatttgcattttagtttgatgaggctagggtagctatggaaatggatgcacatgagaaaaaactgcaggaagacttggataggcaagatattttgaggaggaaggtacttaagcttcttttattgatcaattctaatgtccaaaatctcttaattttcaaattttcttaaggttgtgtttggaaataagtaattcgttttaaattgtagatttcatttatgaaatcataaaggaagaatttaagaataacaagtttcgagaagtcattctcaaattctcaactttaattactattaaaataatggtggaactggctcaaattcaaaattaaatttcaatgatttgccaaacaataaatttgagccaattttagattcccaaatgaaattatcgtttccaaacatagcattacttattttgtctgtgacgaacccaatgtatttgcatttgatatcacgttcaggtataaaatggggttgttatcttcctcttttgctcatttcttccacaatgccggtaatctagggtttatttaattttgtttaataatattagtgtttgggttttctactactttgttaccatctatgaaatttcattttgcatatacatgtacatatgttgatattgaaatcaaactgtcaagtttgctgttaattaggtttttgcattgcagatattgcatttgtatgcatttttggtgtgtagactactatagaggaaatcaaagttgctgctcaacatttcaattgctatgtaaattctctgttatattttttttatttttaatggcttatgtttgctttttgttttgtttagatgctctggttggatacattgaataacgtgtgttctttgtctatgtcgttttatgaatttaacatctttagcttggaaattagttcaagaggttaaaagttaagtttatatctataaaaccatttcaataagtgtagatttggataaggttggattatggatgtcaagattgtaaaaattaaggagtcaattaagtaaaaactatgtagccaaattcggtaagtaacttgttttttggcaaacaatgttgtatgaaacacctattatgtatttatttgaagcctatagcatctatatttttggtggatactcttcctctccttcaagcagagagaaaggaaggagtaagacttttcagtgcattgtttttatgtttttcagttaaatcattaactaaaagatatacaatgttatagcatgtaagcatgttttctgtgcccaactaaaaaaaagaacatttagatgatgcatgttattgtctatataatggtgcatatgcttcgatctgaatttactccataatgtcacgagttatcacttgagcaccaagcatattttccgtgcccaactaatttgatgatattttgttatttgaacaagccaactttgcagactttatatcattcgtttatgtaatgttatctgggatcaatatatgtaggatcttatcgtatgctcctcacgacactctaaattattattgctactaaacagtggactgactcttattattttatgtttatggactgattttagcaattgggtgtactttgaactctaataccttatatatgaaattttatttagcttataatagaactaattccaggtgttcacactcatcacctattgcctcagttgcctccacacaccttacatctactgtagatgcagatgaagccattgacaagttggtctttgtttttccataaaatctaaaagcagcagcaattgttgctactgttgatcccactattttacatggagctgcgttttttattatgtgttatattttctaggatggtaaagcttatgctcatttactctatgttcttgaacccaaacacaataccaatattactttgcgttttccattcaattgttgcattaccatgtgtgcataagactactttctaacataaatatatagtccctgcacttgagaaaacactaacccgctttactcttcgctcttcacttggccattctcgaaaagtcagctactggattaggtacaattggttcatttgggctattatagttcttcttggtgggtttgctatgacttctgaaagataagatttttggattataactgttattctgttgacagaaggaacaaggatttttagtagaagtcacgaacttgaatggaaacgccaagctacatggtctattactgatactgggatcaacagtttgctatgaagttgtttactcttttcttaattttttcattgtcttttttgtagttatttgtcaatttaagtatcaaatgtctttgtgtagtgaggttatattatcgtttcacaatttgttcacattgttttcttggtgaagttcaaacgaacaatgcaaccttttctggtatgcaagtagagaaacttaaatcttaataatgtttctgctaagaagaaaaatagaagggttgaacttaaatagattgatgcgggatagaatgcaacaagagagtttctcaagacggtatttaagatgcgttgtatggctccttgggctgagcttaaacttttacaaacttagttatgatattaaatgatattatgtagcaaagagtatgaaggagatcctagcccctgcagaggttgctatgtaatagtgttctataagatataacatgctgcagacctagatgattttgttttgggtgtttgctttgtgaagagttagttactgctacttcattgtgatctacaactaacatttagaatgcagttagttgctagggtcagtgttcaagtttttgtttgttggcaccaccagataggttttctggtgacaacttatgtcgaaactcttttgatatgtaaggactaagggtgtacatgtactaactattggagcatgtgaattgaaactccttgtgagttgtgaaactatggaggtgcataataacttagttttttttctacaaatatgaattttcttatcaatgttgtcggccctttgaacttgttgaaatttcaaaattatttgtatatttctgtttgcaaaaccttaatttatgtagagctcatacatcctttaaagtaacatgagaaaagttgaaaacaatattgatgtttattgtccattaaatagacttcatattttcatttgcgtatttattgaacatgtctagctactatgtttttgctatttagaatagaatgtagttcatatgcaatgaccagaaggaaatagcaagtttgatataaactcctgcaaattacatgaaatgtcctagaggtgtttaaaacaaattcgataactcaaaattgaaatcaaacccgatttgaccatactttcaatactttctcatgccttcatatacatcttcagcccttaaatccttcaaacctttatctcacattgacattttaatattttatttcgaattattattttttttgataaatacttcgaattattattaatataagtgtataaataacattatcaaattcaatagtgtaacttaggggaccgcctatgtagcacctttacaacatattgacatttcaatattttcattcgtatattattacatatcaatacaaatgtataaaatatcataattaagttcaatagtgttatcttatatcctgtcattcaatttggtctcagacaaggtcaccaagcaaagctacgcgcatgttatctgggactcaagaaaaatgtacaacttgctctaaaactgtttatcccttagaaaaggtatttcttagtaacttgcactttcatttgttgtgtttcgctttgattctttatttcaaaatatcatattgcaaatactaatctcccttacccttaatgaaatatacatgacaatgatgttgtacatttttcttgaaacaaaatgaaaatgatgttgtacatctatatactatatagatttatggcttgaaacaaaataacataagaaccatggcagagaggttgtttatggttgcagtttatgtcatctaaaaaaactggtgttcgaccctcaacagttgcacttgaaactctgtatttataaaagtttgcaaaacgcttcgaaaatgaccgagtttgatgcatagacattggacatgtacctctggctatgtccaaccaaattagattaacatatggttatttgaatgtgtttagaaaaccatgagtttagtcaatggtcacttatcatgtaagcgttgtttctattcagtttgttatccttatacttttgaaatgtttgctttgccgatgtttactgcttatatggggctttttgatctaccggtcatggtagttttctttgaagacttgcctttggcttcattttgtttctataaattttgttgtctaaacttttgtatcttattcaaactattctggaattggtgtgattgggaacacttttcattatcctctttatcatccttattttctttttctcctcttgtattcaccttcattttcctcttaatctagcctctctaatccccctcaaaagattaattaattcagaatccaaacatactgtataatatgaatgaacaagggcatctctgattcgagcttattccctcgactattttcttctacaggaggatattcacaagccttaattttatccaagagtagttgaaactggttttgtttcaaacaaaaaatatcaataagtctgtcacctttttgtttcttgtacacttttgtttcatgtttaggaaaaatttttaggcaaaggaagattagagttgcaatctcatcgctctctcacttaggtattatggtatgagtgcatgaaaatgaagagattgtaatcgaatttctactatctcgtgttttaattatcttgtcctggtgctcattgattcgtttgcaaaaactgtatcaggtgacagtggaaaaccaattctttcacaagtcttgttttacgtgctctcatgatggctgctcaattaccccttcaaactatgttgctcttgatggaatcctatactgtaaacaccatttctcaacaacttttcatagagaaagtaagctatgcacatgtatgaagtccgcttaaatcaagagagcggcctctccagttcttgatgccttggctgctacaataccagctcctgaatcttgagtttgatactttctttctgaaattatccaaataggtatcgccttcatgctgcgtaaaaactgtgattaagtgacaataaaacttgtgactctcttttctgttgtgtgaatattctatatcaaccacagtgtttgcttccatagacaagttctttaatggcagttatgctatgaggatgaattggcttttagtgttatgctctcaataaacatctcctttgcattaagagaactagacctgccttactaaaactacatgaaaataagaatgtcaaaattcattgtatgcttaagattattcaactgttcaatatatcatgggacatgagtcatgacctcaaataagtaaattgcttttaatttactctttcaattcttttgaatttgttaaattaaattctcatttcgatttgtttaatgtaatgaatccaaaaggatagcatagtaggatattgtgattgttgaactgttcaatttggttcgtacaaggtttcttgatgtgaaataatagtactatacttttgtttgaaattagttgctacacttatataataagtataagtaagtaatatttatcaattgatgtattatttcattttttatatgtatcacaaaagaaaacataattaagtttgattctctttagtaatgagacgtaaattattatattccaactctgtatttattctttattataaaagaaataaaatacatgccacatacacacttgaaaacaactataaatttattgaatcaaagctttgtataatacaaaatggatattgaatgaatacgttaatttgcatcttgcatgttgtcttatgttgtatttctgctaatttactgcatatttgattcgatcttacaatgcttttatgttaaagatcatacattaattatttattgcaaacataagtaagccaatcaattactattcacaaaacgagcatctcgtattggctgaatcataaaattaatttaattaattaaaatatcaaattatacatgtaaaatacaattatgattgattcgagcatctcgtattggctaaatcataaaattaatttaatataattaaaatatcaaattatacatgtaaaatacaattatgatcaattaatttgtttaactaaaatatttaaattaaataggatttcttgggggagcgcgtgcgtagcacgcgccccacc

SEQ ID NO: 122 - DNA, 933 bp, Amaranthus rudis
ggccattacggccgggcacttgacatgataaaaaggtttcttttggataagacaatcgatgtattgctgtatgtggaccgactggattcctatagaatggataccttagacaagcaaattattaaagctattacagatagttttgggagtggaatatgggaccgtgctgctgttgtccttacacatgctcagttctcaccccctgatggactcagttacgaagacttcattgaaaaaagatccgactcttttctaaaagttgttcgctttggggccggaataaagaaatcgggttctcttgcatccacaatgcctgttgtttagttgagaacagtgggcgatgcaatataaatgacgaaggtgaaaagattcttccaaatggaatttcatggataccgaatatgttcaagactatcatagatatcgtatccaatggaagtaagggtatcttggttgaccataagttgattgagggcccaaatccaaatgcacataataaaatgtggatacctttgcttgcattagctcagtattttcttttgataaagccgattcaagtacaaatcaaaagagatgtttcgaaagaaaaaaaggctccatgggaactccgagatctagttgctgccaaacgcagagtctaatgatcggtggattggcctcattcgccttttttctcgcttccttccgactctatctaaagtgtttctcgtctcattctatagaggttgttacattcagcgttgtggtaatcttcggcaactcgagcgattttgcgtatctacgacagttggctactatcaatttttaggatataaaagtttctgatttgaatttctttaatctgtctttttggtagaggtatactactgtatgtgtatgagtgtatctagggaatttactggataatttattttgcaatagaactgctttttg

SEQ ID NO: 123 - DNA, 416 bp, Amaranthus rudis
caataatatataaaatttgcgctcgagcaactctagtgactttccggtattcaaattgactcacttcgtttcacgttgggacttttgggattgtggagatgattgattaattttcagaggatcggacttgcaagggaaataggagcgaacatgttcgctagtttttacaagagacgaatgattagcaaattactaattgtattatgttgggttattaactttgccataccatccttaaaatctctaatacatttttggttttttgttgcagtattttcttttgataaagccgattcaaggacaaatcaaaagagatgtttcgaaagaaaaaaaggctccatgggaactccgagatctagttgctgccaaacgcagagtctaatgatcggtggattggcctcattcgccttttttct

SEQ ID NO: 124 - DNA, 1257 bp, Amaranthus rudis
tttgagttgacctaggcttagggtaccttatgtttgggatccacagtccacaccttctcggtccagatttacgacccacttttgattattctttatatcctcccaaatcccattactccaagcaaaataaaaagtgtgttataggaaaaaagaaaaaaggagattgagctaatccacccttttttgacgaggaagtcggttttatttttatgataaacagatagcttaatggccataatgtggactaggttatgagtactgtcttgtagcctagttgtttctggatcattgtcttattttttctgctgattactctttggtgtgggttatcttttaatgtcagttcctttattcaagttacttaaaatatggattgaacatcctctcttgcagtgtttttattttctttatttgtctttcttcgacaaatcaacacatttgtggacctgttcaaatttgactaactatctgtcaatttcttcttttggcttttcggagtgttttctgtctacaattctggcaaattcagctgcaattaattttctgtgttgtgtgtatatttcatgtacttctgttcttgcattcaatctacttttttcctttcttttacttttgccattcatttggtcctcatgctaattctaacttactctttcatttggttggagcaggtttcttttggataagacaatcgatgtattgctgtatgtggaccgactggattcctatagaatggataccttagacaagcaaattattaaagctattacagctagttttgggagtggaatatgggaccgtgctgctgttgtccttacacatgctcagttctcaccccctgatggactcagttatgaagacttcattgaaaaaagatccgactcttttctaaaagttgttcgctttggggccggaataaagaaatcgggttctcttgtatggcaacttcatctgtttggctttggatttttcatcctgcttggtttatgtgtttcttctaattcattttttttggtgcatgctgttatattgtgttatgtttgattctgcttaattaaggaaataaaaaaaaaagttgattacatcttttttttatgcaaattgttattcccaacttcgttgtcacttataggcctataacctataggaggaagccatgacggtattctagaaaaccgatttatattatacttctatatctggaaaaatatcattttatttgtcgaagaatctgtgcgatggttttcctggattaag

SEQ ID NO: 125 - DNA, 617 bp, Amaranthus rudis
gattggcctcattcgccttttttcttgcttccttccaactctatcttaagtgtttctcgtctcattctatagaggttgttacattcggcgttgtggtaatcttcggcaactcgagcgattttgcgtatctacgacagttggctaccatcaatttttaagatataaaagtttctgatttgaatttctttaatctgtctttttggtagaggtatacagtatagtactgtatgtgtatctagggaatttactggataatttattttgcaatagaactgctttttgtaatatcatattgcagtttttctcagcttctattactgttttgttttcaaacaatttagagcttgttgatatcattttctcaaagctattttcagtattataaaactggttgtgatttattgatttcaacaataagtttttggaattcatcaatctaacaatattatttctattcgggatgagcatagtttgaatctgggtcaggtctggctggacctagatttagaccctaattttttttattggactcagactcggacttagatttatagggcctaaaaaatttggattcggacccagatccttagggtgtggcgggtctagggtctggatct

SEQ ID NO: 126 - DNA, 974 bp, Ambrosia artemisiifolia
tacaacttgtttaattctatataacaggcgagggatagtttgacaattcttgtaatggggaagggtggagttgggaaatcttccactgtgaattcaattcttggggaacgagtggctgcagtcagtgcatttcaggtatttactagaacttcatagttgcagaatgatgttcaagtgaatttcaatttataagtttttgatttgatatgtttatttaatattgtagtcagatgtaccacgacctgtgatggtctcccgtgagcggtcagggttcacattgaacatcattgacacacctggcattgttgaaggaggatatgtgaatgatcaggccctgcaactcatcaaaaggtttgctattgactttctgtacttgtagacaaatacttacgatgtgtgcgtgagtgtgtcatatgtggtttgaggtgttagaatgtacgggtcaggtggattggataagccgtaagcgtcaaaacaggtcgtttttagtacgggctgaaacgtgccagattggattgacctgcaaacacgttgtccatctttgataatttaatagctgattaatgttaagttatgaggttgtatgcgttaaagttgactttgggcaactttcaacgtgttggacccgtttgaccactcgcttttagctactctttattttacccatttttttaagcaaagccgacctagtcatctaaatataccaatttataggactttatatatattacctatgtaggccattctaagcataatgctcctgctgtcacctatataattgcctgattttcaatttcaggatgtccccaaagaaaaggaatattattttattcccctttcaaatttccaatctaatttgaccccatagtggcagtggcgcatccaggaattttttcctatgggttcactttttggtggttaaactttcataaccgtacgttagagtgtttgggtcgggtcgggtcacggaacat

SEQ ID NO: 127 - DNA, 555 bp, Ambrosia artemisiifolia
aagttatgcttgttttaagtttggtcgttttctagcccgtttgactttataaagttgctccacatacgagtctgccagttcttggatccgctctttatcaactttcacataattgaatgtcattttaatttatactacaatctaagggaaaagttaaatgacaaagccgaacatacaaacgctgcagtttacatggcgtctcagttgatccgcgaatggagtgggattcaacagtttcctcctgctactcaagacaagctgcttgaactgttgggaagactaaaggaaaaggtcttaactctttcttttatactcctttttattcgtcgttacacacatgttaaatgtagaatatagctccaatattgcagaaaagggacaaactgacaatccttgtgatgggaaaaggcggagttggaaaatcttcaaccgtgaactctatcattggtgagagagcggttactgtcagtgcgttccaggtagctactaactgtacaaaaaccttttgaagatttatgttatgcatatttatatgttgaattgcttattttgttc

SEQ ID NO: 128 - DNA, 257 bp, Ambrosia artemisiifolia
ttcattatgtgtctgcatcgttgagatttttggggtctgttgaatttttgttttgggcctgcagattcttccaaatggtactgcttggattcccagcatagttgaaacaatcacaaaagtcgcgttgaccgaaagcgaaagcatattggttgaccagaagttgattgatggacccaacccaaatgatagagggaaaatattcattcctctaatcctagcatttcaagtaagtttttaaatctgatatgttttattgg

SEQ ID NO: 129 - DNA, 944 bp, Ambrosia artemisiifolia
agctacaactgtacaaacagctgttgaagatttatgttatgcttatttatatgttgaattgcttatttgttcactgaaatgatcttgcagtcggaagcagcaagacctgtaatggtttcacgagagcgttcaggattcacgttgaacataattgacacaccaggcattgttgagggaggatatgtcaatgaccaagccattgacattatcaaaaggtcatctttgttttccctggcttttaagtaacgggtcaaaacagtttcggattaaaatgtgtaaattttttatatgtgttaaaatgtgtctcgttgtattgatccgagactttttgcactagatatttaacccccccccttttaaaaaaaaagtgtgtctaatataattacatgaattttattatttcaatcataacaattatacatatttctctacatggtttgtcttagcaggtttcttttgaacaagacgatagatgttttgctctacgtggaccggctagatgcatatagagttgatacactagatgggcaggttgtgaaagccataagtaacatttttggtcaagaaatatggcatagagcgattttagttctcacacatgctcaagtatcacctccagatagtctaacttacaacgagtttttgtcaaaaagatccgaggctcttctcaaggttgtacatcttggtgctaggttcaaaaaacaagatatcgaggtgcatcatctcttcaaacttactctcttatagacgtgcacgcccatgcccaatacacacaaaatatactaaatttactatgttcttgtagagcatttcgattcctgttggcttggttgagaacagtgtcagatgtaataagaatgggaaagacgaaaaggttggtcatttgcctcgtatcttttgacttccattagtcgttggcaatcaatccgttttgacagttggtc

SEQ ID NO: 130 - DNA, 1186 bp, Ambrosia trifida
ggttcaatggcccgtgaatggagtgggattcagcagtttcctcttgccactcagaccaaattgctggaattattgggaacacttaaggagaaggagagggacagtttgacaattcttgtgatgggaaagggtggtgtcggcaaatcatcgactgtgaactccattctaggggaacgcgcagttgcagtcagtgcatttcagtcagatttgccacgacccgtgatggtttcccgtgagcggtcagggttcacgttgaacatcattgacacacccggcattgttgaaggtggatacgtcaatgatcaggccttggaactcatcaaaaggtttcttttgaacaaaacaatagatgttttgttatatgttgaccgactggattcctatagagtcgataacctggatagacagattgtcaaggcaataacacagagttttggtaaagaaatatggcgtaaaggaattgtggtgctaacacatgctcaattcacaccaccggattgtcttagttatgatgagtttttcgctagaagatcagaggctctccttaaagttgtagactctggcgcttggttcagtaaacgtgaaacaatggatcatgcggttcctgctgtcttggttgagaacggtgccaggtgtaataaaaatgacaacgaagaaaagattcttccaaacggaactgcttggattccgaacatagtggaagccatcacaaacgttgctacaaatgaaagtcaaagcattctggttgaccagaagttgattgacggtccaaatgcaaatgaaagagggaaagtgttcatcccagtcatcttagcattccagtacttgtttgttaaacgagttcagaaatggatcaagaatgatatagctaaagaacccaagtcttcttgggaatgagccccgagtgttctgttgcttggtccttgagtaaacctggtttcatcggtgattatcttaacatggtcttaatttagatgtcttttgttcgattcagtgattttctagttttacgtctgttctaagcttatgatttaagttcactacggaaaatagtgcttgaggtttttgtggaaccatatcttgacagccaaaatcaaaacgttgttaaaagtcgagggactgacaccgtgcattttgttagtcttatggatgtgttttgtcatatatgtttccatagttgttaaaa

SEQ ID NO: 131 - DNA, 521 bp, Ambrosia trifida
gctttagattcttccaaacggaactgcttggattccgaacatagtggaagccatcacaaacgttgctacaaatgaaagtcaaagcattctggttgaccagaagttgattgacggtccaaatgcaaatgaaagagggaaagtgttcatcccagtcatcttagcattccaggtaagctatcaaacttctgacttctttatatgcacacacaaatgagttttcaggttgggttgacccgaaacggttttccctccaaaattttcaaatgttacccttgattactaacatgtttactcatcctgaaattaatattattagatatacctgttcaaaatgaagggtataaatgtcctaaactttaaaataggtatatatgagatatgattaatttggatatatgaaatcatcccaaatttataacatgtcaataataatctaattatctaaagtatatgttttacaaggttctatctgccatttgacccatttacattttcaacccgtatgacccttcttttagcac

SEQ ID NO: 132 - DNA, 2088 bp, Ambrosia trifida
gccttctacaactttgcgttattccgtcgagatatataattgtgtttctgaaatctgaatggtagttttgatgagtaagaattcggttgagttataggttgattgtgtttgttcaggttcaatggcccgtgaatggagtgggattcagcagtttcctcttgccactcagaccaaattgctggaattattgggaacacttaaggagaaggtcaaaatcaattcctaattgtacaactttatcatcgttatagctaatattaaaaccggttctacggtttaagtagcttctttcgatgtacatttagtttgtgattcttatagtaggttttctaatcatatttaacatgttaattatttgataaatcttaaagcaatggataaataggttttttatgggccaagccaacccattttgacctgtaaacttatgttatttgggaaatgacacattgaaatctcatacaagtttaccacttgtttaattatatggttatgcgatataacaggagagggacagtttgacaattcttgtgatgggaaagggtggtgtcggcaaatcatcgactgtgaactccattctaggggaacgcgcagttgcagtcagtgcatttcaggtatatattaaaccatcatggttgtagtcttgtaaaatgatgttcaagagagtcagttttataaaaattttatttaatttattgttcacattttgaagtcagatttgccacgacccgtgatggtttcccgtgagcggtcagggttcacgttgaacatcattgacacacccggcattgttgaaggtggatacgtcaatgatcaggccttggaactcatcaaaaggtctattattgagttttgtacttgcatacgtaaaataagtgtagcataatgtgttattagctaatagatatgtgtgtcagcctgttggtgatcaggccttggaacgcaaatcaacccatttatacgaggctttctttatgtcaacgggctattttaaagatttgtgattttgtggttgtctaagcaggtttcttttgaacaaaacaatagatgttttgttatatgttgaccgactggattcctatagagtcgataacctggatagacagattgtcaaggcaataacacagagttttggtaaagaaatatggcgtaaaggaattgtggtgctaacacatgctcaattcacaccaccggattgtcttagttatgatgagtttttcgctagaagatcagaggctctccttaaagttgtagactctggcgcttggttcagtaaacgtgaaacaatggtactaattttttaacgagttctgttgaatttatcatttttgtgttttccatgtattctgctgaaatgagaaagatatatgatttgttaattttctctgttggactaatttttcaactttataatgggtgtgccgtgagatccgagtaaacattggaaataaaagttttggggtttagtttctgatggtgaataattttttcaatccctaattggcggttgggtgacgaattaaaatgggttcaagaaaacggctactctgttaaatgggttcaaatgggctggatccgtttggcaatccgccaacatttttttgtttttcgtttctgaagttataaatcagttctgttcaagtaaaatgattccggaggttttaagcatttatacacagacactttggtcgactcatgagtcatgacttgacatgagatttttataaacagctagaatcagaaatttcggtgcttgattttttatatgtccctgaaattgtcttttcagtccaaaagtcataggtttgatcctcatatgtttcaacccttggatcaaatttttatcgctggtgtttttagtttttgcaaataccgtttgaccatacaaaagttgaaaaacttgattattctctttaggatgcatgtatagcactaaaagcatgatattttctgcatctgcctcatgtaggatcatgcggttcctgctgtcttggttgagaacggtgccaggtgtaataaaaatgacaacgaagaaaaggttggtattgttcaattaacatgcttgcttatatgttaaataaaatcttt

SEQ ID NO: 133 - DNA, 307 bp, Commelina diffusa
ccaaaaccctcgcaccaccatcgtcttcgtttttctagggtttaatctatcaaaccctagaaaaatctttgcaagggccatggcggcgcagtttgctcgcgagtggattgggattcagcagttcccccgtgaaaacgcaggaaaagttgctgcagctgttggggaaactcaacgaagagcatgtgagcactttgacaattctggtgatgggcaaaggcggggtggggaagtcgtcgactgtgaactcattgttgggcgaaagggttgcgagtgtcagcgcttttcagtctgagggattgaggcccat

SEQ ID NO: 134 - DNA, 224 bp, Cyperus esculentus
gaaattgggcgttaattggtgttttatctggcaatttgaaatgaatgtgtgtaattgttggcattgattggtattttttgtgataaaaattgtgggtttttttttttgtgaattaggaaatggcgatgccgcttgcccgtgagtggattgggatccagcagttccctgtagctactcagaacaaacttgttgaattgctcgggaagttgaagggagaggttagc

SEQ ID NO: 135 - DNA, 1397 bp, Cyperus esculentus
atcattaaacggtataccttgaatcgggttttgtcttttttgtaaaatgggtacatatccagagcccatatgaatctaatccttctgttggtgacatgggttaacttttgagtaaattaagccaaaaggcaactctacttttgcaaatgtgcgcttgcatttttgagaagttcaccttgaacacaattgtaactgcactaatttgacatacgacatgcccaaaaaaaaaacaaaaaaagaaaaaaaaaagaaaagaaacagattatacttcactctttttacatttgcattatcataactcatatgtatgtatcattattttcaggtttttgctgaacaagacaatagacgtgctcttattcgtagagcgactggatgcgtaccgcgttgacagcttggacaagcaggttgtcaagtccataactgaaacctttgggaaggccatctggagtcgctcagtactggttttgacgcatgcccagctatctccgcctgatgggctgtcctatgaggaattcttttccaggagatctgaggcagtgcttcgttacatgcgtgctggttctggtatcaataggaaagtttttgaggtatgtgaacaagattcacaaaattaactcaatttactttatgatataacctgtatatagccttatactagtttgtatttgaaagaaaactgtacttttggtggatcttaatttttttcattctaaatctaaagtacatcaaagtaaaaaggacatacgttcagcatggtaatatctatctatgaaggaccagatctgcctttacagacttcttggtttttttggtgatactgatgcatatctttacaggactgaacctgtcaatcgaaaaaggtgtttcgagtcaataacagaaaagggaatataaattcggatatactaattacatttctttttaatcaggcaaacccgatccctgtggtgttggtagaaaatagtgggagatgcaggacaaatgagttgggcgaaaaggtactcattttaattaaatgtgtaggctttatttactgcccaacaccagaagtcataaaagactagtataggtgtggtagagtcaattggcttcagtagtacagttatgcaataattttactcaattaaccactatgttaagggcaattggccatttttgaatccttaacgcacaatatacttcaattaagtatcatatcatcccaattcttaattaggaactgcaaaacttggctgcccctgatgcaagtacccttgaagtgcttaatcatacagcagacttaaaaaatcattagttttagtaaaaatatattgtggttaaatgattatccaacctgagtcacaaaaaccaatgtagattgtaataatggtaacaacaccaacaacaataataat

SEQ ID NO: 136 - DNA, 1171 bp, Euphorbia heterophylla
tttgtttctggctgcccgtttgcctatacaggcatcaaacaaatgggtgctgtaattcgtgaatgggccggtttccagcaatttccctcggccacgcaggggaagctcgttgagttgttcggaaaattaaaggaggagggtgtgagtactttgaccattcttgttttgggcaaagggggagttgggaaatcctcgaccgtcaattctctaattggggagcgagttgttaacgtgaactccttttcgtccgaggtttcgagacctgtaatggtttcacgcaatcgagctggattcacattgaacatcatagacactcctggccttgtggagggtggctatgtgagttaccaagctttggagttgattaaacggtttcttttgaacaagagtattgatcttctgctatatgtcgaccgcttggatgcatatagagtagatgacttagataagcagataataagtgctatatctgacagtttcggaaaagaaatatggcgtaaaagtttgcttgtccttactcatgcacagctctgcccaccagatgatattagttatgatgtgttttcttctagaaggtcagaatccatgttaaagactatctctgctggatctcggatggggaaacgagaatttgaggaatctaccattccagttggcttggttgagaacagtggaagatgcaataaaaacgagtctgatgaaaagattctcccaaatggcgaggcctggattccaacactggtaaaagaaataatagcagttgctacaaatgggcataaatctatcgatgtcgacaagaagttaatagatggatcagagtcaaatgacagagggaaagccttgatccctctcatccttgggatccagtggattgttgtgaaatggattcaaagagcaatcaaagctgacattgcaaaagagggtaaggctttgtgagtgatgctctcttagagccatggttagtaccctcttttggtagtctcttgagaatttaatggcatcaatgtgtttttttgttagcgacggaattcagtaaaaaaaaacaggttctttgcccttcagttgagtgtgtttctttatttttctttctgtcttggagcttgatctaagttttgtaaaatatttgtattagatataatataagatctttgagagactcctttagcttagc

SEQ ID NO: 137 - DNA, 4985 bp, Euphorbia heterophylla
agttatattaataacatgccactgattatgaaagtaactaatatatttaaataaattagatacaataaattatttatttcatgattaattacattataaaaaaattaattatttattatattatatcattcacaattaatattattttaattttaaattaaacattaaaattttaataacttgtttcataatttaattgttagataaaataagaattgttaaatatttatagtgcccatcatatatgaaaaggaaaataaaagagctagtataaaactactttttacttaatactctctctgttttttattaactgtcgcttttgggtcaaaaatttgttttttaataagtgtcactttcaagttccaaagtaattattggaacatctttccaaatttgcccttatttaatacacattgtaaatgataaaagatgataaataaccaatcatctttttaaaaaatgattaatgatataggcatttttgtactttcattcttttttcaaataattattaatattttcttgatatgtacaaacttaccaaaaacgacaatcaataaaaaacggagggagtagtttaattttacatgtgccaagattaatatggacatagataagcgcattactttatgctccatgtataattgacaagtgtctcgcaaactactttatctattactttttattattatatttacttataacatactcgtcaaattgtcattacacatggatatgaattatgaagcaatgcacttggtgcatgatgcaatataattttttctttatctcgggaaattatacaattttattctaaaaaaattgggaatattttttttattatgaaaacaaatgagaatgttaagaaaaaaaaaaattatgcaaatatatagagcggcatatcttatatatacatatagtggcaacaaatataaattcaaaaaaatattggtttcgataaggtcatctgctgcaccttcttcggagctctaatcctttgtttctggctgcccgtttgcctatacaggttatcacctcttcctccattttcatatttctttgcttcatcttatccttcattattatcttcattctcactacgccttcaatcaccttttttgctggtacatgcatttcaaattgttcccacactctcaatttaattgattagggtttagggttttaccatcgactcattatttttgtcttcaattgttcatgtaattgtgtgtatactttcaggcatcaaacaaatgggtgctgtaattcgtgaatgggccggtttccagcaatttccctcggccacgcaggggaagctcgttgagttgttcggaaaattaaaggaggaggtatccaatttcgaaattcaattatattccttggttttttagttgtttcgattttctgtcaactccgagcctgactattatttattgcagggtgtgagtactttgaccattcttgttttgggcaaagggggagttgggaaatcctcgaccgtcaattctctaattggggagcgagttgttaacgtgaactccttttcggtatgtaatatatatttctttcctttgaattaggaatttagggtagcagacattaggcttttactacttaattttccctacccgtaataacattttctgcaatttgaagtccgaggtttcgagacctgtaatggtttcacgcaatcgagctggattcacattgaacatcatagacactcctggccttgtggagggtggctatgtgagttaccaagctttggagttgattaaacggttagttatactatttttttggtggctttctgtctgtgactttctgcatttcaaccttaaatttggggtgacttattgactttgacatttttggggatggggttttgtgtaggtttcttttgaacaagagtattgatcttctgctatatgtcgaccgcttggatgcatatagagtagatgacttagataagcagataataagtgctatatctgacagtttcggaaaagaaatatggcgtaaaagtttgcttgtccttactcatgcacagctctgcccaccagatgatattagttatgatgtgttttcttctagaaggtcagaatccatgttaaagactatctctgctggatctcggatggggaaacgagaatttgaggtccacattcaacttctaaatattcttttagatgcatccctggcattcaaatgtatgctaaattgtttaagtgaaaaacgccacattaagtagtttcatcacatgatattcaagtatgggatgctgagcttctgaattcattagtttatttgtaggaaaaaaattcttcattgctaatgtgctgctacaatgcattttctacatagttaacaagcaagtttgtgcttgtctttcacccttaaaagaaacttaattatgaactctggactctggtgaaaagagaatatatataactcccttgacctagaaatgtaaatgtattagctatcttcgtataagtgtcaagctataattaaaattgaaggtaagactaaaatattttccttactatttttctttgcacatattttaaaagaaaatatgttgaatccatatttagtttttcttattttgtagtaccatagaaatatctgttgttaatttactatttactatcaagtatctaggactctatttgcttcttgaagaggtgtccaagatgattaattcttgcattctttctttttttatggaataactagaagtctagaatgattcaagtgtcgacagtaaggttctgattcatctttaacttgttcaccaaactaattacttgtttaaaaatgagtttgagtttgctgtctaagagtttgaaatgcttcattgggcttagagaatttgcataatattcaaattttacattcttcgatggaaggggaacatggaggcaatcgtttttccagtaaattagataattacattattctatcatcttaatctgcctgaatctaggagggttactgaaacttccgccgtagattatcatctgataattaaggtgcaggtttggaaaaaaatccagagacaatgttatgctgtttagaattaagttggatgaagttggctttgattgaaagaaagagtgctctatagtagggttagcatactatatacagtattatccttttgtcttctatgatggattccattagcaatctgaagatataaaatacagaagtgtcagaacaaaaagttcttgggttaacatactgtataaagatattgccaacattaaccgagaaataagttcttgggttatcatacatgtaaaactctataaaaaaattgaagcgtatgacttcaatttttcttggtgtaaatagattcacgctatccacacttcagaaattgttcagaacatactgcatatcaaattggaaataaatcaatttcttgtcatttgttagacataattgttttctgtgtttttgagattttttctgattgcttttataatccctgttttaagtaatggttattttatcaattgcaaaatttagagaagtttaagtaatatgctttctttgttgtatgtctatatgatttggcaagtttgaaataactctttaacatatttggtagatttttcatcacttaatgtttttggtatgatgtttccagaactttaaaattgacagtgctcatcttctttcataattctatgacttgcttaaaactttgctctgttctgctttatacatggcatggacgaaaccttttgatatacaaattgaaagggaaatttgactgaaaatatggatccagtggaagtggattgtctgaactcataggttccttttactcttgagtcttgataagggatctttagatcaacaactaatttgcatgactgtattgttacaaagttgtgttgaggtttctgttatgtgatttgaatctttaagttggtaaaaagcttcatcaatgacagttttgggttatcttgtttaagggatccttcaattgaaaaaccggctcttttattattcttgatagttgattgcttttatgaaaattattagcacactataagaactgttgttctgtttctttattttgtttttctcatcttgcttttgatgcttataggaatctaccattccagttggcttggttgagaacagtggaagatgcaataaaaacgagtctgatgaaaaggttttgtctctatgcgaacatgtggccctttattctaattataagcaagcaatagtaacttgtattttgtatagtttgagaagtaaattaatccaagtcattttattaattgcattgactaacagattctcccaaatggcgaggcctggattccaacactggtaaaagaaataatagcagttgctacaaatgggcataaatctatcgatgtcgacaagaagttaatagatggatcagagtcaaatgacagagggaaagccttgatccctctcatccttgggatccaggtaaaaccttcgctttattatattcgaaggcaatgcactttattatttttaatatggcgagttttgatgttgcagtggattgttgtgaaatggattcaaagagcaatcaaagctgacattgcaaaagagggtaaggctttgtgagtgatgctctcttagagccatggttagtaccctcttttggtagtctcttgagaatttaatggcatcaatgtgtttttttgttagcgacggaattcagtaaaaaaaaacaggttctttgcccttcagttgagtgtgtttctttatttttctttctgtcttggagcttgatctaagttttgtaaaatatttgtattagatataatataagatctttgagagactcctttagcttagcaatcatgccaatgaagttgtagcagtttttaacgtgttgatttgtgaagagctcgtgaaggtaaagtggtgaggttagaataatgttgaaagtagcactcttattctctactaccctatac

SEQ ID NO: 138 - DNA, 1067 bp, Festuca arundinacea
ctgtagctgcagatgatgacgaagaaaggggcggtgaggagaatgaaggtgctccagatgtttctgaccgtgaagtagaggctgttgatgacgagatagttttagctgcagctgatgatgaagatgggagtggtaatgagggtgatgaggacgatgacgaggtgagctttgataggagtcctgcacgagttgcaatcatagagaattctgaagctgcgaagcagatcatgaaggagcttggggaaggttcctccagtggtagtcctgtgtctggcttgagcagttcaagagagtacactaatagcatggatgggcagattgtgcttgacgattctgaggatgatgaggatgacgacgataatgaggatgatgatgagaaggggtttgattctgctgccttagccgccttgcttaaagcagctactggtgcatcccctgatggaaacatcacagtttcttcgcaagatggatctagaattttttccatggatagacctgctggtctgggctcgtcagccccatctttgaggccaactgctccacgacaacctgcccggtcaaacctcttcaacccatctgagctagcagtgactgctgagcctaatgacgagatgacagaggaggagaagaaattgcacgacaaggttgagttgatccgtgtaaagtttctgcgtcttgtgtataaattgggggcaacccctgaagaaacagtagcagcacaagtgctgtaccgtctgagccttgctgagggtatccgacatggaaggcaaactaacagagctttcacttgagaatgcacggaagaaagccatacagcttgaagcagagggaacagaagatttgagcttctcatgcaacatacttgtcttaggaaagattggggttggcaaaagtgcaactataaattctatttttggtgaagagaagaccaaaactgatgcttttggtgcagccaccaccagtgtacgagaaattgtcggcaatgtagatggtgtcaagatacggatcattgatacaccgggccttcggcccaatgtgatggaccaaggaaacaacagaaaaattct

SEQ ID NO: 139 - DNA, 414 bp, Festuca arundinacea
gaaggtgcaagaccaacgagaatggggcgaaggtttgtctgtttcacgctgtatttgacttgcatttcgttctgcctagcttcttgattataattaaggatttcatacaattgtgtccagattcttcctgacggaactccatggattccaaacctgatgaaagaaattactgttgtcgtctcaaatgggagcaagtccattcatgttgatcagaagttaatcgacggtccaaatcccaacaatcgctggaagaagtacatacctctcatccttgcagtgcaggttagatcttcacatgataataattgtaaaatcccagataaaattggaatattatctgtataaacagaacactaacctgatatcatttatgctcttctccagtacttcttcgtcgtaaaaggaatccgaagg

SEQ ID NO: 140 - DNA, 1596 bp, Festuca arundinacea
cggcggccacccagaccagtctgcacgagctcctcggcaagctcaaggaggaggtatttcccgtctatatccgcccctctttactacctagaccagctattcaatcgaccaggactatgttctgatgattgtgtctgcgttgtgagttttgacgaaaattgatggaattctgtatgttttgcctatgttgtgatgtttagaatgtgagcacattgacgattctggtgatggggaagggcggtgtgggcaagtcgtccactgtcaactccattgtcggggagagggtcgccaacgtcagcgccttccaggtgtcacgtttgtccctggccatgtttctatctgtgcctctgttctgggttacttattatgtgcgggagtgcatccttatatgttatttctgtgcagtctgagggtctgaggccgatgatgtgctcccgcaccagggcaggattcaccttgaacattatcgacactcctggcctcattgaaggtggatacatcaatgagcaggctgttgagatcattaagaggtacggacatgttgggcggtaacttgttaataggagattatagatactgcaacttaaaaaaatagggcattgggtgtccctctcgcgcgagggttgcctttttcgactttgaggctcatagtatctggttactctgaattggcaaaatcgtttcattgcatttctcgagcattggtccagcatgaattactgcactgttgattgctgatccttggttggtatgtcatatgtgactttatgaacaagtccagtcgttacttttgttaacacaggccctagatttagttaggacactttattgtccatagaaatcacattggtcaggggtaacatattgctgatacatcctttaagaatggtgaatgcttgggtgtacattaacatatcagttttctcctacacgggtagagagagttctacaccacaaatcaaactacgaaaaagtggttcagattgaaatcttgtgtttatatagacaggctgtccctgtcctcagtttccctccttagatcattttggtctaagtttgtgctaatcatgtccctgatgtagcttataggaaccataatttataagttagactccataatttgctctgcaagtttttagcctcttatagtctatgtagatatattaattttactctggcattgaatttcttctttgttctaaatagtaaatcgtggccagctggtggtcaccccaccttaagcacttcatgtgatagatacctatgtgtgctaccgaatgatgtaatgtgtacatctgtattatgccttgtcgatttggatatcatatttgggtttcccttcagactttaatttctcagatactgatcaggttaagccgccaatacatgcctgcttgtttgccttgtttctcttcattttcctaagaagatagtccattgacagtgtagttcattaggttggcatctgtagagaagttcatgctccttccgtaactggtcactagtgttgtgatacaatctgtatatcataaaaagttattcccctgcttgcatttacatgtaatcaatgctattgcaggtttcttctggagaaga

SEQ ID NO: 141 - DNA, 243 bp, Lolium arundinaceum
cattatcgacactcctggcctcattgaaggtggatacatcaatgagcaggctgttgagatcattaagaggtacggacatgttgggcggtaacttgttaataggagattatagatactgcaacttaaaaaaatagggcattgggtgtccctctcgcgcgagggttgcctttttcgactttgaggctcatagtatctggttactctgaattggcaaaatcgtttcattgcatttctcgagcattg

SEQ ID NO: 142 - DNA, 2046 bp, Portulaca oleracea
ttttttgggggggggggtgtggataaggatgaagccttcttcccaaatatccttggtgattttgtaactgttgtgggcttcaatccttgatgtaaaaagagggcaaccatcttgtatgtggcggggatagaggaagagagtttgggcgtgttccacatgcaaatgtagaatctgttgattactccctccatcccatattatttgtctttttaaccaactttttttaatcatgcagtatttgtcattttagaatcccaaatatttccaattattttatttatctaccccactttatcttttctttttcattattatacgactattttctgtgtaagatactcccaaacacatccaaactacccaaccaactatgttctattggtttttgagctttctctgaagtgacttataatgtgggatggagggagtaccattcaacaagtgtcttgccagtgggagtacttctcttcatctattcccagtggctccttctgcctccagtacctccttttcttactgcggcaattatcatatagttatttgaagtggattttctgctctactgttttaacttatagccaatgcctgatccagattgactagtaggccagtctcctggacttccattttcttaccacatcatgcactgtgcgttttttttttaaatggtcaactgatacaacctacatttttcctgtctgtatactggcaagctgtcaggtctgtacgtatcggtcatctgggatgaaattggttcagggaacttgaaaacctctgaaataaggttatgatattattaggatgtgtttttttttggtgtgaatcaatctcaaggaatattgtacttcctttcgccctagtgttttgtagttgcaaacttgaaataggattgtgctgctgttattcatatgatctgttcaatgtcaaattgttggctgtgtcgttgcaattgtgatatcttattcgttttgttcatgtgacatctgttattctgttgtctggcccatctccccactgaagtgaatattttttcttaaccttgtactgtaaatttgttgggcagattccttttgaataggacgattgatgttctgctttatgtcgatcgattggatgcctatagagtggataacttagacaggcagattatcagagctataacagatagctttgggaaaggtatatggaaccgtgctgctatagtgcttactcatgcccagctgtcgcctcctgatggattgagttatgaagaattctttactaaaagatcagaggctcttctcaaagttgttcgtatgggtgcccgcataaagaaacaggattcccttgtatgacctcgttttccacttatcattgactttcttgtaattcatgctttttcaagatgcttttgtgatttgtgttggttgactcatgagcttctaatagttacttttcagttttttttttttacaatttttttttaaaatggcctctactctctaatttttagcacctattttacgtatcataaccaaaatctctgtttaaaggcataggatatggtggcatttagaaagaattcaagttacttttaaacagcagttcttagacacagatggttttgggtttttggtactatactttttaggattattgtgtgtatcctattttgatgtagagtagaaactgctctctgatacaaactgttatagaattctttttgttttgggactctgaattgatttaggtaccagttcgggtcaaaaatttcaatttctgtcgcaaaatgtttgcatttaaatgttggatctgttaaaaacttgaaatggtggtttgttttgtttttcctacataatgaagtttccctttaagacaaagtgagagagacactctatacaggtcaatttaagctgttcctagtgtgaagcagatactttctctattgtggggaattttcttgtgttggtctgttttgcttatttttatgcttgagatacctgttctctgactgttttttttctttttggtgcctgttcatctttaggcttcctccatgcctgttgt

SEQ ID NO: 143 - DNA, 404 bp, Portulaca oleracea
ctagtatgctcaaattcttttcccattgatattaatttcagtctgaaggatcaaggcctgtgatggtttctcgatcaagagcagggtttacattgaacatcatcgacacaccaggtcttgtggaaggaggatatgtcaacgaccaggctcttgagagcattaaaaggttagtgatggctggtattatgtgagaaaactcgtgctgttttcacgtatgctatgctactaacattactcgttatgcttgcaaaattttatgcattgtgcttgctagtaacctgtcgataatttgtctgtagaagttgcatttgtttgtgaccttgtcggcccccctttgtccaagtaaggtggcttattttcaggctgcttacagttgggctctacctttttttttcttttttttt

SEQ ID NO: 144 - DNA, 1140 bp, Senna obtusifolia
aaacgcttgaatagacggataagggcggtgctcaagaacgatttccataaaccaatcacgttctggggaacatccgaaaatggcatcccaaacacgtgagtgggcaggaatcaatacatttgcacctgctacgcagacaaaacttcttgaattgctgggaaaacttaaacaggagaatgtgaacactttgacaatacttgtgatgggaaaaggtggtgttggaaaatcttcaactgtaaactccatcattggggagagagttgtttctattagtccatttcagtctgaaggaccaagacctgtgatggtgtcacgatcaagggcaggatttacattaaacatcattgacactcctggtcttatagaaggtggatacataaatgatatggcacttgatataataaaacgtttccttctcaacaagaccatagatgttctgctttatgtggaccgtttggatgcatatagagtggacaacttggataagttggttgctaaagctataacagacacttttggaaaagaaatatggaacaaggctctaattgtgctcacacatgctcagttctcacccccagatgggttgccttatgacgatttttctccaaaagatcagaggcgctcgtgaaagttgttagatcaggtgctcggctaaagaagaggcctctcaggcttctgctattcctgttgttttggttgagaacagtgggagatgcaataagaatgagagtgatgaaaagattcttccagatgggactgcttggattcctcatttagtccaaaaaatcacagaagtgacgttgaacggcagtgaatctattcatgtggaccaaaagttgattgaagggccaaatccaaatcagagaggaaaattatggattcctgttatttttgctctccaatttttccttgtcattaaaccaatacaaggatttatcaggaaggatattgaaaatgagagcaggccatcttgggagacacgcgagataggtgttcgcaggagagatctgttttaactttgcgccttttctcatgaaattttatctatgtttagcttccagtgtttcatctaatggttttctgttttggagtcattttggtggtaggtttcaatgtacgcttatatgctagtatatatat

SEQ ID NO: 145 - DNA, 1927 bp, Sorghum halepense
ctcctgacccctgcacccctcccagcggctcatgagtgctcccttctccttctatggaccatcatatggagcccgttgtcttatcatgttgtatcgatcttctgaaactacatgacctgttggcatatcataggtcatccactatgttacaaaatgcctaagctctaggtaaagggcaccgctcgcttagtgccttttatgtgtgttagattttgttggtagtttccaactggcaacaggatgtgtgtatatggtcgtttagcatgtacacaaacaacgttgaattttgcttttcattcttgaatcatcagcaattcagcaaaatgtatttgctctataatttgcatttttttgttccactcttatccttgtatcggcgtatcctttcgataatatgtgttttcaataattccttagttagctatgctcgtccacgtgtttcatcctcaattattagactatgtgaaaattattggaagcaactttggctaaatgactgtatcatgttagttacttttctctacctgctgatttgttttatgacacgctctttcaaaattatgtttccatggacaacaggaaatttggatttttcagtacatcacagatctctttgtgcacaagcagacatgccgaattcatttcatttttgctttttaagctagttctaatggaatatctacattttgcttttttaggatttccccctgccaatagcattagtggagaacagtggaaggtgcaaggctaatgaacatggggagaaggtttgtctgtttttgacctagcatttctctgttctcgtgacttaatggttaatagatgatgatatttcactgttaacagatacttccagatggaactccgtgggttccaaacctgatgaaagaaattactgttgtcatctcaaacgggagcaagtccattcatgttgatcagaagttaattgatggtccaaaccctaacaatcgctggaagatgttcataccacttatccttgctgtggaggtgaactgccttacataatactcttttcactgacatcaaacagaactctacactcatatcttctgtactcttttccagtacttcttggtagtaaaaggaatccggagggcgatccatgcagatatcgcaaacgggaaggtggatgactgggagcagcgttaccgggacttggtgggaagcagggaccccgtagagcagaaaggttctacctcccggaaccgcaaagcctaagttggtgtaccagaaaggattttattcatgttgtgacccactcgatctgctgttccttttcctaattctgtgttgggggctttatagagttcgctggtactacttgaaaaagactgctcgtgttgtagttgataaaaatatgttttccattttatgatgcttggccctcttcgcaattttgaagatgttatcgaatacctgctattttattgtctttaatcttatatggcatggaaacatcaagtgtgtgaatgcccctcaaatgtcggttgatggtttattatgaagtattactgtatctgttcttggttatctaacgtgcctaggaatctaaggatgatatttttccaagcagcagtaacttctattttcatgcaagaaaccttggctcttgtggcagtctggcataagtagcttcgttctgggcctggaagcacggcgtgcctgtaaagactgaaacattggcttcactgcttcagtgacaatattagcttcattaagggccaaaaaacagtgtgcctgtaaaagattccaacgagtccataaaatcctacaaagtcaccagggtacacatttccaaatctgtaaaacaaaaaggatgacggtccttccaaatctgaaaagaaagggttgctactccctgtttttccaatatataattttaggcaagctaatttgctcattttag

SEQ ID NO: 146 - DNA, 1532 bp, Sorghum halepense
ctctctacaaccatgacacagcgctatgatctactattaatgttcctgtccctagtagtctagtgaaacactccataaccttgactgcattttataagttaaactatattgctagttctgcaagcgaacagacctcttgcaatttgaagagcttaaacaagagataatttaaaaaatgtgcagatatttgggttagggactttatatgcagagtggctgtgttatcttgaatgatgtagtccatatgcagccctaacagcattaatttctctttatttatatatttaccaaaacctcagaaaaaataactgtttttgggcaaagaaatcaccaagcatcttaaagtgtggaattggggcatgtcggtgttctgttgaagttgtgttccaatccgaggatagttgattaaactaacctactgaaatgtttgtggtttgctggtctcacctacatttacccttggatccaaatgcaagtgagacattgtgttacaagtgcaaatgagtgaaatagcaactcctgaagccccttttaaattaatatacatgtatcttacatgttatcaattatattgcagatttcttctaggcaagactatcgatgttctcctgtacgtggatcgcttggatgcgtatagaatggatacactggatgaacaggtcataagagccatcaccaattcatttggaaaagatatttggcgaagatcattggttgtgttgacccatgctcaactctcaccacctgatggaatcgactataatgatttctttacaagaagatcagaggcacttttgcgatacatccgctcgggggcaggaatcaacaaacgagaatatggggtaatgcatgttttcatttatcgtataactatttccatcatgctctatggaatacccatgcatcaattaggagctgcagtgagtgtttgaccttcctcagccactgatcattttctgccattttttactcctgtggagatgcctttttggacttctgatcttggtttcacttccctaatatgagtgctagaaaccacattagcttctaaatgatggtcatatgcagatgtatttattaatttatgccattaaccttgcacggtcatcatttgcagtgtcagattaccttgctagttagtctccatgcaactggttgctgaaccttgcacaggcatcatttgcagttttcgctagttcatttggtatacgccagtctagatatatttgaggtttacattggtagaggtcttgtcagtcttattcaatgccattattttttcttcatctatttagtttgctaacgttttacacagttttcaaaaaagcactaccaggaggtcactgcagtgtactgagcgagagggtgccacagcgccttataagcggtatcctaggtggctgttggttctctgtgactctgctgccgctggcgcctgaccccttcatctcagccgccttctgaccccttcatctcacctgcctcctgaccccttcatctcagcggcctcctgacccctgcacccctcccag

SEQ ID NO: 147 - DNA, 7430 bp, Sorghum halepense
aaaaagagggagcgtgactgctggcacctaactaaagccagcgcgctgcgcgcgttaaggcattagcattaccgaccgtttcttcacacccccgcggtttatacgcattcaaactcgcgttcaacgtcaacgttccaattcaaaccctttacccgtccgttgccttccctccctatttgaacccgccctcctcctccccccaacccagtcttcgcattgaactcttcacacctcacccaccaacacaccaatccagcacgcctcctcgccgtcgtctccgataactcatcgtccaaatccctgtccttctatggctctgctggtgcggagggcacgcagggcggcgaccaaggccgcggtgtcgctcggcggcggcggcggcagcagcagcgtggagcttgcgatcccggcgcactaccggtgcccgatctcgctggacctcatgcgggaccccgtcacggcgccgacggggatcacgtacgaccgcgagagcatcgaggcgtggctggacacgggccgcgccacctgccccgtcacccacgcgccgctccgccacgaggacctcgtccccaaccacgccatccgccgcgtcatccaggactggtgcgtcgccaaccgctcccgcggcgtcgagcgcatccccacgcccaagatccccgtcacccccgtccaggcctccgagctcctcttcgacctcgcggggtgcgcgcgccgccgcgacgccgccgcgcggtgcgccgaggtggtcgccaagatcaaggtcctcgtcagggacagcgagcggaacaggcgctgcttcgcgtccatcggcacgggccgcgtgctcgccgccgcgttcgagtcgctcgcttctgctgctgctgctgacgccgcgccggcggggcgcgtccttgaggacatcctcgcggcattggtctgcatgatgccgttggacgaggaggccgccaggacgttgggcttgccgagctcgctggggtctctggtcgccattgctgagaacgggagcttggcgggaaggctgaacgccgtgctggcgatcaaagaggtcgtctcatgcgacggggcgttcactgatctgagcggaaaggtcgacgagatcgtagacgcgctggcaaagatcatcaagtctccgatctgcccacaggcaaccaaggccggcatggtcgccacctatcacctggcgctgtacgacgagcgtgtcgcggcgcgccttgccgccgccgggctcgtccccgtgctcgtcgaggccctcgtagacgccgacaagagcatgtccgagaaggcactggctgtgctcgacgcggtgctcgcatcggaggaaggccgcgcaagcgcgcgggcgcacgcgctcgccgtgcccatgctcgtcaagaagatgttccgcgtgtccgacctggcgacccaactcgcggtgtcggcgatgtggcgccttggaaaggcgcacagcgacggcgaggaggaggagaatgcggtgacgcggtgccttgtcgaggcgctgcgggttggggcgttccagaagctgctcctgctcttgcaggtcgggtgcagggacgcaaccaaggagaaggccaccgagctgctcaagttgctcaacaagtacaagagcgtaggcgaatgcgtcgacgctgtggatttcagagggctgaacaatctgtcatcttaaatcaaagggaactgtgatgtaaaaagttggattttgtaaaatagagacgatttaacttgtaagtagataggatagttgcaattttgctgggcttgcttccatgttaatatttcagcagcataggcgcttataggttcaaatgaaaacaaaaacatagatctgattttcgttttgagacgaacttgtgtgtaaactttttgctgggcgtgcttccacgctagcttagttcaaatgacaacttggatccgatttccgttttgtaaagaacttgtgtgtagatttcttgtttaaaagattgtaacggaggcaataccatattctctgaatcagtactcgtactcctagtatatgctaatagaccagatggaaactagtgctaaaatccagtagttaagcactggaacatactaattgtcaccaaaagtatggctaatctacctaatatagtgcaacggagcttttgagagcccaacttctaattatttagagtattttatttattccctggtaagcttctcttcttctccctctcccacacgcggtgagatcttcttcgccatggagatctagtgtgggatggagttcctagagctagaggtggatactgtcatacaaatttggtcgatgttactggtcttggcaaaggcaacgaccgtaaaagttgctgtcttagaggcaagtggtgcctatagatttagcagaaaaatggaggcaaagggtggagtagacatcttgagattacttgacaatgacgatgactgtggaggggtattagctatcaagtctcattgtagctagagatgatgctacgatgttgaagaggtggagtggagcatgtcaaagttcagttaagacttaagatcaaggtagcgaatagggtgacatgacgtcagttaggtcaggtgtggtaaaataggtgaggttaagatagtataatgagattttggacatctgattgagattgaaggactaaaaacatgatagagctgggattggtaaatcattcaataggtgtatcgacaaagccctgtctcatcttgaatccactctatttgatcactaccaagcaaacgattcaattaggaacatatataatcagtgtaattgtgaaaacttctttgaaacatatacttagaaatttttaaaaatatgtatgaaaatgataaaattcgtgtgcatgtgtactaagacataattcatttgaccttgtcttatgttatgtgtgtttgacatgacttctccttcatgtgcttctttaagaggagccagattgtagccattcgatcttctcttttgtagctctttctttgtctcttccaaccttccacttaagccgcttctgaacttgaaacggaacttgtgccaaatagaacttacatatgcacatgaattttattattttcatataaatttctagaaaacaattttgcattctaacttttgcaagaatgtatacatctattgatattaatatttatgtgtttcctttcaaacaaagaaattaagcttattgtttcaagggagcattgtgtcgaatgagtcatttgcaccgaatatttttttagttccacctcacatcctaggttcctaacaactctgcttatgagagtagcaaaagaaagaaaatgcacttgaactgtcaacataacctacaaccatacgtcatattaaactttgaccatgcatttgaaaagaagtgtagttagatcagcacctaattaaatttgctatgaactgtcaagtgtactatactactatattttttttgcaaaacattttttattgcgacttcgtcacaacaacgtctagaaaattgccagaatccggcagtgtttggtctctcgacatcccgcagagggcagaatggcctggaagttggaatattatgcagccacgctagtccaacgtatccgcctagatgaacgaacagttgtcaccgttgaaaaccagatgagttcaagcttggacgcagtggtaaaacgtgaccacgctgaccatgcaccgaccgagcttgaccagaccagtccgcacgccggccccatgcatccagagccgggcccgggcccgggcccggccggcgacgactcggccagcgcacgtatccggcggctttgtccgtagtctagcagctagcactccgtgtgatggtttcgtagttctgtagcatggcagttttgtagtacgtactagcgactaacgacttccactgttccattcggacttccacgccgcaaatgtatcacatgcaaaattggaaactattggcgccactgtcactgccagtcgcccttggcgcacgagccaccggatcgctacctggctggtttccagaagcgagtataatcacatggaaacctttgatttgttgtcttgttttgttagtatatagatagatctttgactctttgtgtatttgtcttgaggcaatacattctgtcagagagtagttatacaataattccaagaaaacggtggtaaaccagtgggttttccaagtggctagaagatagaaaataattttgcatttggaattctagattattttcaaatcaccctaaccactttcatatcttcttttatctctttacaaatttgcattgggaactcttgtctttactcgttattcttccccacattcttccaccttcggattggctaattgatatgtgcgagtgcagaaagattgggagtgttgaggtaagaaattggagatcagtttatcaaatctagcttgcgaaaaaaaatcaagattgggagtggaatttgggagctcttagaggtgatgctcttactagctacttcgaccattccttccaaattatatcacacttttaagttcactataagacggatttgtctaacttcgacaaactttatcaaaaagggcatcacaatatcaaattgaactatgttaatggtagttgattatttgaacttgtagctatcagttttctaaaagctccctcgatccctttattaactgtcattcttatttccgagaagtcaaacatacttaatttgatgatatatatataaataatacttatagtacataattagtataattagatatatcattgaatctatttttataataaacttatttagagatacaaatcttgctaatattttctataaatctagtcaaacttaaaaaattttaatcagcacgaataacataacaacacttaaaaagggacagagggagtatttataagatagaacaaagctaagtgcattacaattcggtagaacaagtttggtagaaccatatgccactactagagaagtggacattagtcccacgctccggcacttcactaacagttactcccttcgtctttttcacacatcatacgagctttgttctaatgaaatatttatattttttatcatcgacttttttaaatatatatatatatagtttcataagataatatttatatttttagattcactacgaggaatactttcataacatatacttatacattataaaagtataagggttttatgaaataaataaataaataaatagtcaaagattttaaattttgacttagaacaaagctaatgtgacatgtacaaaacaaagggagtagttgaaatttagtagtgatggtaatatcctatttgttcaacggctacaaggacaaaaaatcattattttcaatatatataagcaaagttgtctccttttaaaaaattgacttctaaacttatgcaatgctcgggcagtataagtttaaaattcatcgactatctatatgactatatctctcgtaaagctagtttcattataagtctatcacaacatgcaagtcatccactaaccatgcatgtcattgcactaacttcaaacctcttaatacaagctatgcatgtcatcttcatttaatttcattctatttttttgcaatccccatagcatgtgcagggtatcttctagtttttataaaatgttttttgaggggatttataaaatgttagaaaaggagtatatatagattaaataatttaagccaagtagagcctaacaacgttagatggcgccccaaggcctgtaagctcacttttatagcaaccaaggcacaggcccataagtttccaaaaaaaaaaaagccacaggcccataagtaggccatatcgtttagcacggtacagcccacagagaaaataaatgaaaaaggaaaaagggaaaaagcaaaagaaacagggagtcccccgtccccaagagccaagaggccaagcaagacccgaccccaacatccatctcatcgacaccccctccgcctccgctagtctccttatcccttccctccgcataaacccccgccgccgtgaccccgcccgcccgctcgccgccttcccctcgcagcgacccggccctcgctctaggttttaactgccggccccgcgtctccaggtaagcatctacgcctgacccgccgcgcgcacactccgctccgtccaggcaaaattggttttttgtctctgattttgtggaacgcgcgtccttgtggcaggtaaagggaagggagaggatggcgtcgccgataccgcgcgaatgggccggtctgcagcagtttccggcggccacccagaccaagctgcacgagctcctcggcaaactcaaggaggaggtactccactacgcgtctatgcaacgttctatgcctgaatcagttattacctccggtctaaaatagatgtcatccgaaaatgtgtgccatggaaagtccaatcattattatgcatggagttatttttcttatcgcatgaaaatgaatgacatcgaactctaaagtactgcaaccgcaatgtcattacaatttggtaatttgtactattgtgagttatggctctgtagagtttaggagctgtctctggtagagcttttatcacgcatgctaggtctgcaattagagtcgccgacctagctgtgcaatgtctaaatgttatcatgtaaactgctacctccagaaaattgatttcaataaagcagggccaaagatgtcattggtctaccatattgccctagatggcaattgaattgggctagaggtagtatattactcaaggatagccgtgctttctggttggttatgtttctttaagaattggtggtcaatgagtgttctgcttgtgtttgtgatgtgaaggatgtgagcacattaacaattctggtgatggggaaaggtggagtggggaagtcatccactgttaactccatcgtcggggagagggtcaccactgtcagcgctttccaggttttgcttcaccatgttctaagtttctggttcgactcctgccacagtaacttatgtgtggttctgttgttggatgttgtactgtgcagtctgagggtctgagaccaatgatgtgctcgcgcacaagggcagggttcaccttgaacattatcgacactcctgggctcattgaaggtggatacattaatgagcaggctgttgacatcattaagaggtatgcacatttcaacatgttgagtcatatccatacattcctgaaagtggtgcaatttgttacagattttatagcatgtaatatagggctttatgtggcactgtgccctgacaaaggattgccattctggacctagtttaaggaagaattgtttcatactatctggttgcttcagttggatatatagtggatttagcaaggtctttgggtagcacatttagaaaacattgttttcacatgaaatactacatgacagatccttgaatgctataaaaaatgtgtg

SEQ ID NO: 148 - DNA, 6412 bp, Spirodela polyrrhiza
  unsure (1)..(6412): unsure at all n locations
  unsure (1)..(6412): unsure at all n locations
ctctatctctctatctctcactctatctgtatctctttctatctccctatcgctctctctctctctctctctctctctctctctcatggagttgaaaggaccatttataaatgagagcattgattagttcattcggagaaatgtatgtcaacagatgagcagctaccatttgaatgatctttctccaatctcattctgtgtttattgcaactttaactgcagcgcatctgtctgtaaattcttctgtcctacgcattctttctaggttcttgattctggtggtcccttatcaaactcccagttctagtaagattgccagtatttgttctctctggggttcattgccaacacttcatcttgagatccttattttacttgcattagttcttcccacagcacccaaattctctcatcatttcctgttggtgttcaagagtaacgaggggcttaaaatctcagcagcctgcagaatcaactcaacttctcgcaatgcacgtctgactcattcctccattggattaagctggcattggtggggaatgtttagcaaagaaggagaatgattcaacaggatgcacaaggatgtgatggtcccaatgtctctgtaggttatgttcggcctaatcatcgtggtatacttagtatcccacatgggtggctctgttcatggggaccatcgtcacctagttaggatgttgctgatgtacatgggatctctgggagctcagggagcacaggtcacaacagatgatggcacatgcagctgtgcctcagatttttcttttaatgcttgagctaatttaacttaatccctaaataagttttggttttccggttcacatataataaataataataacaataataatcttgtgacgagctccttcttgccaggcttcattctcatgactctgccattacaaaatatgccttttcttgaaaaaaattattattatcttgggaaatcaatgggtttagagcgaaataaagcaatcactcacacgtttaaactggatgacaggaggccggcatcaatggactcaacagcaaaacccacatgaagctgctgctgaaatggatgagggggagggaaatgctcaaactcttttgcactcagactggctccagtaagaaattccttcactctaccttgcccgaggacccccaggcgccccagaccgagaaacccccgccagcccccgagactccaaacccctccaggaagaagacccaccagaccaaacgatcccctttggggagctagagacgcccacaacagttcatccagctcggtacattctattttcgctctctttcatcgttccaggctggtgcccccccccccccctcgccaattaaaaagtcaaagcccctcgagaccgttgacttctagctgaggttggtgagttcttagaactgaacgttgctcctgcgctgacttctttatggtcttttttgtgtgtgatgattctgccccatgagccaaattgttcaaggtccaatgagttggatcagaccaggtctcctcccctttaatatggcatcatcctgttggactttttcaaatccataaacacccatcttgaaccgtttatggcatcctgttggtgtttatgtgattggagtcaatggattaaacttagttttcatccagccggcttttttgttccatgattttgagccaaatggggaagggaacgggggaagggggggcatctctctaataaaatgtcttgtattgctccgtgttcctcaccagattaaggaaaagatgattatctgggttctttttttatcaaggggtgccatttattaaaatccatataatcgccaagaaaatgtttggttggtattttattaatttaagcccgttgcatcataaatttggccgctaattgatcaaagtcttggttttacagccaaaagagatttttcggtaatttttaaattaaatttaaaaactatttatcatatttttattattttaaataggcatgtggtcaattatgaagaacgtaggaaattttaccaatagaaatcggggaatccttcgggaaacgtttggccgatttttatattttcccattttattaaaaagtgagaatttattttcaagatgacgtaatcgattagccggttgtgctgaacggatagaagggggagcgatctgagtcggttccttcggtgtcagcccgagccggacgagtcataccgatcctgatcgagtcagtccgagtcaactcactgacagagcctctgtgaagcgtcggaacgctaactataaagaggcagccggcaaccgataaggcggccgcgcttcgtcgtgcttcccgctgcttccgcccccctcccgtcgccaggttcatcctactccccgacttcctcgtccccccgttttcttggaggactctgagcggccttcttcgaagcagcagcagcagcagacaagggcgcgcgaccttctcttccggtgagcatattgtaatcttggctgaggtggcctggccaacttttctctggcattcgtaatcttgactgagggatcgtgttctattccgctcctcatgggatttcgggaggtctagggcacactctggtgtgtagttttcctcctggagtccattttgtcgtctggattttaggtttttttttgctttccgactctttgttttactcgagttttgtgtttctcatacttgtggatgctgtgaattgtttggaaagggggcgggggtttgtgcttccatggcgggtggggttgtgcgcgagtggttcggtatccagcaattcccggctcccacacagaccaagcttcacgagtatctggggaagctcaaacaagaggttgctgttactcctcctttctccctctcctcgttctcgttgatttactttgcgacaccatttctggtttcccatttactaatcttattttccacctacagaatgtgaatacattgacaattcttgtgatggggaaaggaggcgtcggcaaatcttctacagtgaattccatcttgggggagcgggtggccactgtcagtgctttccaggtctgttggaatagcatccgtgccctgtttttaagggaagttttggattaaagttaattcacgaattttgtttcaactccttgctatgtttattacttttgcagtcggaaggccttaggcctatgatgatctctcgatctcgggcaggcttcaccttgaacattatcgacacccctgggcttgtagaaggcggatatgtcaatgaacaggcccttgagatcataaagcggtatgtctggaatcactaaatcaccgagggcagcgtttatggactctctttttgctggcttttcagacatacttcaatattattatatttgtacttagcttgctagaagaaattcttggtgtaactttctagattgaatgtatcctttggaacatttccccaaaggatgggtttcattccaagttctgtcaaaattttctggcaggtttcttttgaacaagaccatcgatgttctcatctacgttgatcgattggattcatatagagtagataacttggatcgacaagttattaaggctatcactgacagttttggtaaagccatatggaagagaggcttggtcgtcctcacgcacgcctacctttcacccccagatggattaagctacgatgaatttttcaccagacggtcagaaacccttcttaaaattatacgcttgggagccaagatcagaaaacaagaataccaggttcattcgctttttattttcaaattcatttgttatcactggaatcatgtatcttagttcatttctttgggcttgtagtatttttctggttgatgaatatctcatgcctgaccgtctgtaaagcttacctggcaatggatctactcagaggtgctaagatcttgcctaattaaatccaactccctctgatgtaagctagcaacctctagtctgtctaagctggccaggatcaatcttctgggttagcacactgcatttaaatcttcggtgtctagatactcagatgcctgaatatatgtttaaaaagtcatatgtcttgccattttgtatttgagtactctctcagtataaaatattatggagagagatcctcattgtgctcctttctcctcaatattttggtgtgagagagtgaaacagatggattttctgtaaaccgtaaacgtagattttctctgatatcaagcatggtcaagtaaattagggttcctggtcaaagaaatattagcaccaggcattggttacgtttatatgcggaagaagaatgaactactgtattccgccatgtttcttatcgttcacctttttatgtggtacttgtcatccccttcttttaaatcataatgaggaaagcatgtgactcatgtctgaaggagtgtattcaaagctggggacagaaggaataaattcaatatctgatttaggtatagatgaaaactatgatgccatgatcaatttttttttaatttctcttcccaccaatcaaatgtcgacgcatagtttttccttctcacctactgtattgtgtcctctggttctattttttctcattgcctgccggatggcgtgataatccagaccatcaccatcagttaaaatactatgatccggcagcttttatggaggatcttggaaaaccatatttaggcattttaaagacactgaaaggattctcattttaaaacggctttaaagtatatttttctggatttttttttagtatctattaacacgcctctatgccttactgtatgtcctgtcaccctttatcaccactcaactttctacctaattttgattcacatcagggtctgctcactatgtttataacacactgagaaattaatttttgaaaatttttcattgatgattcggagattgcagggggggggtttatctaattaaagctgtctttaaccctggggaatcgatctattccttgtcatcatcaatataattctatagagtctatacctccagtccaattcacgagaagtcttctacctcatcgtcagaccattgattacatcgaataatgaaacacgctttagttgcagacgaagacattgaccattggttgaaagaaaactcagcttcagcccttaacagtctctcaggtgatgctctgactttttggggcaatgaatgattcattccctgacgaacagagtaattggcttctaaaaattcctttcataattctggtgtctgctaggggctttcacctaattaaggtagatatttagcttctgcagccaatttcttcaccaaggttagtattattcttgagtctattaagttccttccctttgttgcgtcagtatgaaacaagtttaagcgagatgcaaagaccttcaggggatgattagaggcggaaagaaagcctgatgaattcagattatcagatttttcttttaatagctttcatggagttctgttgtgcgctgtctcctccacataagatgctaatttggaagactttcttctgtatatttgaaggactccgccatacccatagctcttgtggagaacaccgggaagtgcgccacaaatgagggtggcgagaaggtgtcctctctctctctctctnnntctctctctcgctctcgctcttaatttagnnntctcgctctcgctcttaatttagaaatcnnnctctcgctcttaatttagaaatcgtcgttggaaaccacccaggttctgccggatggcacagtgtggattcccagcctggtgaagaccatcaccgacatcgtgctgaacgggagcaaagccatcgtcgtcgaccagaagctaatcgacgggccgaacccgaaccagagggggaagttcttcatacccctcatcctcgctcttcaggtgggcgagccgccgcccccgatctcttcttcttcttcttcttgttgagaattccccgaccgacctccctcaacctggattctctcctcctctttcagtatttcttcctggtgaagccgatcaagcagaggatcagggaggacatcgcccgggagaagaagccgctctgggagctccgcgacatgggcctggccgacggcaagttctgaccgttggcggctggctgtggcgttctagggttcttgtaggaagagggagggggtgggggtgggagcgggagaggagctccctcccgcggcttcagggcgagatgccccgcgtttcgggaaattttcatcctttctgcttagattggagcttcctctcctcttagcggaaccctgcggaggtgaggtgggggggagtaattagttgaacacacttgtttatcgagaatctgatcttcttctgcagatgttgcctttccctttcttctcctgcagattttgctcctccgtcctctgtcatctctctctctctct

SEQ ID NO: 149 - DNA, 1007 bp, Taraxacum officinale
cctatattggtaaaaagagtaaaacaccattaatattctatccaccagaattttcccttgattttatctgttttgcatcaggttcttccaaatggaacagcttggattcccaacataattgaagttattacaaaagttgccactaatgaaagtcaaagcattttggttgaccaaaagttgattgatggcccaaatgcaaatgaaagagggaaacccttcattcctctcatcttggcattccaagtaagttactttattgtatttgttaaatttgttaatttattgttttgattcttatatttatatatatttatattattcctttttttgcagtacttttttgttgtgaaacaagttcaaaaatggatcaaggatgatattgctaaagcacccaagtcttcatgggaatgagcttttgtcgttttcctgtttttttattattgtggttaatgtttttgtaagttaagagacggttgtttggggctttttttgtctaaattttgtgtaacttggaagatgatttaatattatattagatgtgtttttttgcctaaatttattgttctttttaaagtcttgatgttatactattagatagtgaaaattttaatgattttcttgtgttgcatgtttggttccaataaacattttaagctgaaagaaagattaagaaaaaaaaaacaagaatttagttttaaaaatgtaaaagtagtaagtttgatttcttatatttgatggcaaagtaaatattattgatattgaaggaactagtgttacttaaattttgagcatcataaagtttgtgttaaagaatgaaatttagtagtgaaatatgtatttaagccatgaaattagtttctagactacatgcttttttaatatgttttatatcatttccaaacttgtaatctttaaatatgactatgacataatataaaccaattttacaaaaagttaaataaagatacaattacaatcattccgtggtcacttccaaaatacatctt

SEQ ID NO: 150 - DNA, 1602 bp, Taraxacum officinale
caactccaagctacaattgttaaacttaatggaatctcacaaaactgaatgtaacttagctcaattatagagcaagacgagctgtttggcgttgcttttgacattccttcattagggtttatggtttatgggaaattgagttttcgtagtagtttaattaagtttttcttcctgcagtttccatggcttctcaatttatccgtgaatggagtgggattcagcaattccctcctgccacccaagacaagttgctacaattgttgggaaaactaaaggagaaggtccatctctgtccgtaattccctctatacattacaagcaatgttatataaaattaagcttatgtaatccctgttcatgcaataattgtagaaaaaagataggttaacgatccttgtaatggggaaaggtggagttggaaagtcttcaactgtgaactctatctttggtgagagagcagttactgtcagtgcctttcaggtacctaaaaagtttctgaagatgttttctagacttaatttgttatatatgttgaattacttatacaccaacatggatctttttagtcagaagcattaagacctacaatggtttcacgagagaggtcagggtttacattgaacatcattgatacaccaggcattgttgaaggaggatatgttaatgaccaagcccttgagatcattaaaaggtcacctttactttcactggcttttaatataatgatacaactgaaaagttatcctttaaaacaaatttgattttacccgactttctcgattaagtcatcctttccacattaagtcaaaagtgacacccatacatagcttatcaaatgaaaaagaaacaacacctaaaagatttctttttatatggctgtttaaacaggtttcttttgaacaagacaatagatgttttactttatgtggaccgtctggatgcatacagagtggatacattggatggccagattgtgaaagccataacaaatacttttggtcaagaaatatggagaagggcaattgtggtactcacacattctcagctttcacctccagattgtcttacttatgatgactttttggctaaaagatctgaagcacttctcaaggtcgtgtataatggtgctaggttcactaaacaagatatacaggtgaatcttttttcttttcaaaattactcccttgccctttaccaccttttatatgtgattctttgagtaaactgcaagattggtccctgtgggtttcagtttgcaattttgtttatgttggatccaaaaaagagtattttttcattttttggtacttatttagggtttacatttttgttctgattttggtctctcatttgaactacataaattgtaaggtgctaggttttgataaaaggacaattctatccctgttatgtatttgggttagtaataatataaactagatcaaattacatttttagtccctgggtatagctggattgttaattttggtcaccagaagttttcttttgcagttttggtccttatttgaggtttttgtaacactctcagtcctgtttccaagcgaaataactattttggaccaaaattgcaaaagctagcgc

SEQ ID NO: 151 - DNA, 400 bp, Trifolium repens
tgttactgtcaacgcctttcaggttagtatatttctcctggcattagatgagttagttgattaattttatatgcttcgttgaacgttaaatttattagtcgatattgacattgttttattacttttgaagtcggaaggactaagtcctgtaatggtgtcgcgttcaagaacaggattcatactaaacctcattgacactcctgggctcatagaagaggggtacatcaataatcagacaatagaaattattaaaaagtgtgttatttttcagatgattatatccttattcaatatatatgtttctgtagaagttttcttaccctttcttttcattggtttgttctttgcgcattggtggttgtttgagtagtttccttctgaacaagaccatagacattct

SEQ ID NO: 152 - DNA, 322 bp, Trifolium repens
tcgataatgacgtctgcaataacccgagaatgggtaggattcaacacatttgcagctgcaactcaaacccaattgcttcaattgttgaaaagactaaaagacaaggttccattttctttaatttttaatttccaatgcaatctaaagttatatatatatatttttgtatatattttttgcgattttatttagattttttttttgtgttttattctgtatggaagaatgtgaacaagttaacaatactagtgatgggaaaatgtggtgttggaaaatcttcaactataaattcaattttaggagaaagagttgttactgtcaa

SEQ ID NO: 153 - DNA, 1034 bp, Trifolium repens
  unsure (1)..(1034): unsure at all n locations
  unsure (1)..(1034): unsure at all n locations
tcatgcaccatgcaaccagaatttcaattcaaaagacacatgataaatgttagatctttgattcgtaagtccagttggcacactcgagatcacaccaaacccaatcctctttgacagaaaacaccacttcaacagtgttattttccatgctgtgctgtgcctgcagatcagttaccaaattttgaaccacggacatgccttgtgttataaaaactgaatnnnnnnnnnnnnnnnnnnnnnnnnnnnnnnnaagtctattctgtaatctataccatgtggtataagtctattttcatttgggatatcttgattttgtgcttaattatatactgcatgcaatagtgtgttgctatctttcattcattattcaattctggttgttttataattggtttaactttagtagtttgatgtcttttcttataggcttctaccattccatttgttttggttgagaacagtgggagatgtaacaagaatgtagatgatgaaaaggttgacatttcttgtctttactttaggttatagtaaattgatcatggtcttttacttagtttttgctgatctctagtgtggttgttttacgacaggttcttccaaatgggattgcgtggatttctaatttggtcaaaacaatcgcagaagtggccatgaatggctgcaagtctatttctgttgataagaagctgattgaagggccaaatcctaatgaaaaaggaaagagctatattcctcttatacttgcattccaagtaagctttaaatatagaattttatggtcaaatccttctttcctttcttttggtcaagaatatgtatattgtaatataccctagtcattttcgatattttttaagttttggcgccctcccaaatgctcttcattgctttgtttgttctgtgtgcaagggttgttaaaatacattggctcttaatctctttatctttgtttatttgtgaacagtatttctttgtgataaagcctatacaacgatcaatcaagagggatatagcgagagacactaaacaatcat

SEQ ID NO: 154 - DNA, 2704 bp, Trifolium repens
aaactaatatcgaaactgtactgtctagcaggaggataaggtggaggctaagggcggttcttcctatcgttgctccttcccacctctctcttccggtactcctttttccatcttatcaaccgttctctttcttcactcccgttgccttcttatttccccaattttatattcgcatgaccaggttaattcgtgttaatgatacttcatatctgttttctaattgttaggtttcagtggaatatgcactaattaacggattttatttttatttttctctacgttttgttagtgaaacattatgggttctcaacaaggtgttcgtgagtggtctggaatcaatacatttgctcctgctacacagaccaaattgcttgaacttttgggaaaacttaaacaagaggtttttgtttcatttcccttttttcaattattgcactcattagaacaatttttcatgttttggttttgttcaagggtttaagaaattctctgcaattgtaactaataattatgtactatgtatctgtgagatgagaccgcgacttcaattttagttatatgattattatatcttatctcttgaattattgtatacgaaaacaattttaaggttttaagaaaatgtccgcaatcgtaattatggttgcgatattagggtttttaactatgaagcacgaaaactagacacgacacagacaaatctacactgataataatttgctaaaatgacataattcaatgtaatcatatgtgttagtgtcgtgtcggtgtttgacactcatgcatgtccgacaccgggacacgcctaatctgatgtgtgtctgtgcttaataggtttttaatgtctatgcgtgactgtgacagcaattttggccgcattggtcgaattgcctacatgtttttagcgagagtgagcatttgaaagaaggttttttgtttccgctttgtgaattttatgttggtttcttttggtatataggatgtgaactccttaaccatacttgtgatgggcaaaggtggtgttggaaagtcttcaactgtgaactctatcattggggaaagagttgtttcaattagtccctttcaggtatgtgatggtacttttcggtgatggtttttaagttggtattcttttatgatgattgtctgtgttgtaaacaacttttttttaatcttgaaaagtcggaagggccaagaccagttatggtatcgcgatcaagggcaggttttacattgaacattatcgatactcctggtcttattgaagggggatacatcaatgatatggcgcttgatataataaaacggtatgctcttatgtctgacatgtaacagtgctcccagtggaacatatttttgttcaatttttttaaccaaacaaaatgattgttttttctctttaccattttcttttgtttgggtttgtgtagtttccttctagacaagaccatagatgttctgctttacgtggatcgcttagatgcgtatcgagtagacaacttggacaagttggttgccaaagctataactgacagttttggcaaaggaatatggaacaaggctatagtagcactcacacatgcccaattctctccaccagatcaattgccttatgatgagttcttctcgaaaagatctgaggctctcttgcaagttgtcaaatcaggtgcctccctaaagaaggatgccgctcaggtatttgtctatataacatcaatcccatctttgaaatacatctcagggtaaaaagttgaatctatgatccttgaatgggaaacattggttggccacttagttgattcaatatatcccaaatgcactaactcttgtagggatctgttttcttgtgtttgtgatgaccaatatagttatctctgttactcttgtatgtaggacacttggccaatttatgtaatacatttgtcatgaaatgcggcattttttaaacccacacagaattgtccggctggacctggttaaccatgaattggtccagtggcctctctgcttttgtaaaaagtggatttgaaactgttgaatggtgaacgtgacaaaacttgacagttgaactggttaaaatttatttgagattttgtactgatagccgatagagtaaacaaagattcacactttgaaactgatgttcacccacttactaaagccatctcttaacgttatagctcatatgttttgtgtgatatgcccttttgaaattcaaagtttattaaaaagattggcaacgataataattgaaccagagcattcataaaacatgatgaatcctatcaccaagtcatatttatggatcactgtttcttagtagtatgtatttgtcttctattgtttgtagtccatagcatctagttactaactaatttattattgatttattgcaaatgtaatgaatcaatttcaatgatattagaaaaatcatttagtagtttccttcttactttactgatatattcttgacaagttattttttttacattgcattatttatttattggatatacatatatataatatatgtcaagttccaattcaacctcgattaaccacattccgacctcaatctttgaccttttcatctactaatgtggatgctgttcagttttaaaaacataggtacagaagcatagccttgatattcaatgagaaaatttctcatgtggtagttcataactgttttttttcctactac

SEQ ID NO: 155 - DNA, 570 bp, Xanthium strumarium
attttaagataaggttcaatggcccgtgaatggagtgggattcagcagtttcctcttgccactcagaccaaattgctggaattactaggaacactaaaggagaaggagagggacagtttgaccattcttgtgatgggaaagggtggtgtcgggaaatcatcgactgtgaactcaattttaggggaacgagcagttgcagtcaatgcatttcagtcagatttgccacgacccgtgatggtttcccgtgagcggtcaggtttcacattgaacatcattgacacacctggcattgttgaaggtggatatgtcaatgatcaggccttggaacttattaaaaggtttgttttgaacaaaacaatagatgttttgttatatgttgaccgactggattcctatagagtcgataacctggatggacaaattgtcaaggcaataacacagagttttggtaaagaaatatggcgtaaaggcattgtagtgctaacacatgctcaattcacaccaccggattgtcttagttatgatgagtttttcgctagaagatcagaggccctccttaaagttatagac

SEQ ID NO: 156 - DNA, 1371 bp, Abutilon theophrasti
aacaaacactactctgataagaataaagataaccttctcagactctcccgactcccacaattctcttttacttttcttccccatcaaccgccaccacaatcccccactgataattcttcctttctcaagttgcacctctcaagatagcccgttttctgtgatgggtacccctctgcctcgtgaatggctcggccttcaacaattccccgctgctacacaagcaaaattgtttgagttgttgggaaaattgaagcaagagaacgtcaatactttgactatccttgttatgggcaaaggcggtgtaggaaaatcttctactatcaattctcttcttggggaacaagttgttcgagtcacagctttccagtcagagggactgagacctgtaatggcttcacgcacctgggcagggtttacattgaatgtgattgatacaccaggacttgtagaggctggctatgtcaatcaccaagctcttcagttgatcaaagggtttcttttgaacaagaccatagatgttttgctttatgttgatcgcctggatgcctatagagttgatgacttggataaacagatcattaaggctatcaccaatggttttggcaaagaaatatggcgcaaaagtttgctcgtgctcactcatgcacagctttgtccaccagatggactgaattatgatgttttttcttccaaaagatcagagggtctcctaaaggccattcgcatgggagcttgtattagaaaaaaggagtttgacgattctctcattcctgttgttttggttgaaaacagtgggaggtgcaataaaaatgacaatgatgaaaagatacttcccagtggtgatccttggattccaaacttagtaaaagccatcacaagtgttgcaacaaataaaagtaaagctgttgtagttagcaagaagttggtagatgggtcggacgctaacgatagaggaaaattgtggattccggttattcttggggttcagtggtttgttatcaaatggattcgaagctcaatagcaagggattttgcaactggcaatggacctatgtgagaggcacatgaaccagatgtgctcgaacgcaagtttgatttggtcttgtgtcatattggttttccttttaatttttggtaaaattaaaaagaatcctctgaagttcgttttgctattgttatacgtatgctttgacaggctgagccagtagtgcttggatggatgggatactgttgagctcttttaggaattaagcggcgaatgttgcgttgttttcttctatgcattccccatccttctctttgtttgtttctcaaactacttgatcggagttttgttcagagacggatttatgattgaccccactgtaattt

SEQ ID NO: 157 - DNA, 266 bp, Abutilon theophrasti
ctcctattcctcgtgaatggctcgccctgcaacaattccccgctgctactcaaacaaaattgtttgagttgttgggaaaattgaagcaagaggtttttttattaaccctttaatctcttcctcttttttgagtgaataacatatttaatcaagattgtttatttggaaaaaaaatgcagaacgtcaatactttgactatccttgttatgggcaaaggcggtgtaggaaaatcttctactattaattctcttcttggggaacaagtt

SEQ ID NO: 158 - DNA, 1455 bp, Abutilon theophrasti
aagtttcaattgttattgttttttgttgctttgcagtcagaggggctgagaccagtgatggttgctcgctcttgggcagggtttacattgaatgtaattgatacacccggactcgtggaggctggatatgtcaatcaccaagctcttgagttgataaaagggtcagtactcggtacttgaattgagcagtcaaagttatcatcttttttgatagttgatcagtttagtatattgagtaattcttagtaaatgcttgtgatatttcttgtttgaattagttttaccagatggtatggttcattacttcattttggttatgaacaaaatcttgtaactataatgcaggtttcttttgaataagaccatagatgttttactttatgttgaccgtctggatgcatatagagtggatgacttggataagcagatcattaaggctatcagcaacagttttggaaaagaaatttggcgcaaaagtctgcttgtgctcactcatgcacagctttgtccaccggatggactgaattatgatgttttttcctctaaaagatcagagggtgtgctgaaggccattcgtatgggagctcagattaggaaaaaggattttgaggtatgtattctctttcgagtttatttatgtgggagacatgttggattgcccgaataatgatgttgaacaggttaacatgaagagaagcttatttgttgtcatatacattgtgtgatgtgctgactaaaatgttctttgtcactcacttctaatttgctgaagtcgagagttgaatgattccacacaatgggggagcaattggtatttggtagttatgagagagcagaggaactctgggtttgtcacctgttcctagaatttgcttttaatctaaggatatgctcatccagtttgctcattgagatagaggtgattaagctctttcaaactctaaccccaatagtttgcccagcttctgattgttgacacttcctgtagaaataaactctaagcttctccacttctttaattcaagccatcctgatcttccttctcatgcagtttctaatccaagagactttttattagttgatcatcgataagctacccccagtcaattataaagatagcaaaggattctgttcccatcacatggaagttcgtttgtcctcttatatcactattcaaaaactgagtgaatttaaattgaggggaggaaaatttttaggtggatgtatgtatatgctttcaagtatatatttcagacacaataaaggttttggacaggtcgacatgaagagataaacttatctgccatgttaacattgcctactgtgctggtcgagcatgccctttgttatttgtttgttttaagttgcgaaaattgggtggtcattggtcccacaaacaatttagttatgggagacaaagtattaggtgtgagtggtttcaatattagccttaaa

SEQ ID NO: 159 - DNA, 332 bp, Abutilon theophrasti
ctgaagttcgttttgctattgttaaacgtatgctttgacaggctgagccagtggtgcttggatggatgggatactgttgagctcttttaggaattaagcggcggtcgttgcgttggtttttcttctatgcattccccatccttctcttttgttttgttttctcaaactacttgatcggtgtttttgttcagagacggatttatgattcaccccactgtaatttaccttatctctatttgcaaactactgtgtaattttctttttacatatattttttgtgttagggaagaatatagctggtttaccttttgtttttcttggtgcgtgaattg

SEQ ID NO: 160 - DNA, 709 bp, Abutilon theophrasti
  unsure (1)..(709): unsure at all n locations
  unsure (1)..(709): unsure at all n locations
tgtaaggtgtattaaaaaaaagaaatgacaagtgtcacaatnntaaacccgctggtgtaaacattttttacacaggcggtgtatcaaataaaaactaggcactgaacagcgagagagcgcccttactgatccgccaaagaaccatttgcttgctgggcggataaaacaaacactactctgataagaataaagataaccttctcagactctcccgactcccacaattctcttttacttttcttccccatcaaccgccaccacaatcccccactgataattcttcctttctcaagttgcacctctcaagatagcccggtaaaacccaggtttctcgtccaatattttccttatttcattatctgtcaaaacagaaccgacccatctcttttttttttagctgcatttcaagttaggtgtagcattttagcatgttatccactcttagggtctagggtttatttcttcatatttttaaatatgtttttttttatgaaattttatgcagttttctgtgatgggtacccctctgcctcgtgaatggctcggccttcaacaattccccgctgctacacaagcaaaattgttcgagttgttggggaaattgaagcaagaggttttttttatttaaattaaacccttttatccctttcatttacttggacttaaataacatttttactaatggttgttttgattgttgcacaaaaaa

SEQ ID NO: 161 - DNA, 437 bp, Abutilon theophrasti
tcccagtggtgatccttggattccaaacttagtaaaagccatcacaagtgttgcaacaaataaaagtaaagctgttgtagttagcaagaagttggtagatgggtcggacgctaacgatagaggaaaattgtggattccggttattcttggggttcaggtaaagcgtccacagtctattggtttctgtttgggctgaacaggaatacaaattaatattatctaatgccttgtgattttgttgttccagtggtttgttatcaaatggattcgaagctcaatagcaagggattttgcaactggcaatggacctatgtgagaggcacatgaaccagatgtgctcgaacgcaagtttgatttggtcttgtgtcatattggttttccttttaatttttggtaaaattaaaaagaatcctctgaagttcgttttgctattgtta

SEQ ID NO: 162 - DNA, 652 bp, Alopecurus myosuroides
ggagtcctcttcctcgtctccgtccacctccgccgcttctagggtttaaccgtccgcctcgtcggtctccgcatctctaggaagcgggcggtgatggcggcgccgataccccgcgagtgggttgggctgcagcagttcccggcggccacccagaccagtctgcacgagctgctcggcaagctcaaggaggagaatgtgagcacattgacgattctggtgatggggaagggcggtgtggggaagtcgtccactgtcaactccattgtcggggagagggttgctaacgtcagcgccttccagtctgagggtctgaggcccatgatgtgctcccgcaccagggcaggattcaccttgaacattattgacactcctgggctcattgaaggtggatacatcaatgagcaggctgttgagatcataaagaggtttcttctggagaagaccattgatgtcctcctgtacgtggatcgcttggatacatatagaatggatacattggatgaacaagttataagatccatcaccacttcatttggaaaggccatttggcgaagagcattggttgtactgacccatgcccaactctccccacctgatggacttgactacaatgatttccttacaagaagatcagattcgctgttgcggtaca

SEQ ID NO: 163 - DNA, 466 bp, Alopecurus myosuroides
gaaatcactattgtcgtctcaaatgggagcaagcccattcatgttgatcagaaattaatcgacggtccaaatcccaacaatcgctggaagaagtacatacctctcatccttgcagtgcagtactttttcgtcgtaaaagggatccgaagggcaattcattctgacatttcaaatgggaagcttgatgactgggagcagcgttatagagacttggttggaagcggtaacccggtagatcagagagcttcgtcgtcccgcaaccccaaggcctgaactggccaatgggagtgcatgccagtctctgcatcatgttcccactcccggcgctgtttttcttttcggactcctaattccagcattctattttgggggctttatagagttctctgggacaacttgaataaagttgctagtgttttagttgccaagtgtatgtaccccatttcattatgttctcccaattttg

SEQ ID NO: 164 - DNA, 574 bp, Amaranthus albus
agagcaggattacattgaatatcatcgatataccaggtcttcgttgaaggaggatatgtgaatgaccgggctcttgacatgataaaaggctttcttctggataagacaatcgatgtattgctatacgtggatcgattggattcctatagaatggatacattagacaagcaaatcatcaaagctataacagatagttttgggagagggatatgggatcgtgctgcaatcgtccttactcatgctcagttttctccccctgatggattgagttacgaagacttcttcgaaaaaagatccgagtcttttctgaaagttgttcgttttggggccggaataaagaaacaggattctcttgcattctcaatgcctgtcgttttggttgagaatagtggtcggtgcaataaaaatgatgatggcgaaaagattcttccaaatggggtttcatggataccaaatttggtcaagactatcattgatgttgtatcgaatggaagtaagggtatcttggttgacaagaagttgattgagggcccgaatccaaatgcacgctttaagatgtggatacctttgatta

SEQ ID NO: 165 - DNA, 1361 bp, Amaranthus graecizans
gagaaagaggtaaagaaggcagaagtgagcgaacagaagaggacattgaagttgataagcctgcctggctggggttttagcttaaccccttatctttcttcttccttttgccgacttatttctcctttcaccctgcaacccaacaacttcagtcgtagataaaaatggctgcccaatcggttcgtgaatggactggaattcagcaatttcctgctgcaactcaaactaagttgcttgaattattgggaaagttgaaacaagagaatgtggattctttgactattcttgtactggggaaaggcggtgttgggaaatcatcaactgtgaattccgtcattggtgaaagagtagttgctgtcagtgcttttcagtctgaggtatcaagacctgtgatggtctctcgtacaagagcgggatttacattgaatatcatcgacacacccggtctcgttgaaggaggatatgtgaatgaccgggctcttgacatgataaaaggctttcttctggataagacaatcgatgtattgctatacgtggatcgattggattcctatagaatggatacattagacaagcaaatcatcaaagctataacagatagttttgggagagggatatgggatcgtgctgcaatcgtccttactcatgctcagttttctccccctgatggattgagttacgaagacttcttcgaaaaaagatccgagtcttttctgaaagttgttcgttttggggccggaataaagaaacaggattctcttgcattctcaatgcctgtcgttttggttgagaatagtggtcggtgcaataaaaatgatgatggcgaaaagattcttccaaatggggtttcatggataccaaatttggtcaagactatcattgatgttgtatcgaatggaagtaagggtatcttggttgacaagaagttgattgagggcccgaatccaaatgcacgctttaagatgtggatacctttgattatgttagctcaatattttcttgtgatcaagccgattcaaggacgaatcaaaagagatatatccaaagaaaagaaggctccatgggaactccgagatgtagttgcatccaaacgcagggtctaaaatcgatggcctcacaacgctatcaagtacttatcgtctctacttctatagaggttatagttagcattgtggtagcccggcaattcgaccgatcttcaagtttctaaaaagttgcctcttttattagtcatctgatctttgcaggcaatgaaatttctcattatagttctttcatctggtttttagtagcactactagtgtatttaatgatttatgagtgaacttttttgtaatgtcatatcgcaattttgtggcttt

SEQ ID NO: 166 - DNA, 1355 bp, Amaranthus hybridus
aggacattgaagttgataagcctgcctgcctggggttttagcttaacccctcccttatctttcttcttccttttgccgacttatttctcctttcaccctgcaacccaacaaatttagtggtagattaaaatggctgcccaattggttcgtgaatggactggaattcagcaatttcctgctgcaactcaaactaagttgcttgaattattgggaaagttgaaacaagagaatgttgattctttgactatccttgtactggggaaaggcggtgttgggaaatcatcaactgtgaattccgtcattggtgaaagagtagttgcggtcagtgcttttcagtctgaggtatcaagacctgtgatggtttcacgtacaagagcgggatttactttgaacatcattgacacacccggtctcgttgaaggaggatatgtgaatgatcgtgctattgacatgataaaaggctttcttctggataagacaatcgatgtattgctatacgtggaccgattggattcctatagaatggatacactagacaagcaaatcatcaaagctattacagatagttttgggagagccatatgggatcgtgctgcaatagtccttactcatgcacagttctctccccctgatggattgagttacgaagacttcttcgaaaaaagatccgagtcttttctgaaagttgttcgctttggggccggaataaagaaacaggattctcttgcattctcaatgcctgttgttttggttgagaacagtggtcggtgcaataaaaatgatgatggcgaaaagattcttccaaatggagtttcatggataccaaatttggtcaagactatcattgatgttgtatcgaatggaagtaagggtatcttggttgacaagaagttgattgagggcccgaatccaaatgcgcgctttaagatgtggttacctttgattatgttagctcaatattttgttgtgatcaagccgattcaaggacaaatcaaaagagatatatccaaagaaaagaaggctccatgggaactccgagatctagttgcagccaaacgcagggtctaaaataggtggcctcacaacgctatcaagtatttctcgtctctacttctatagaggttttagttagcattggggtaatccggcaaattgagcgatcttcgagtttctaaaagttgcctcttttatttgtcatctgatctttgcaggcaatgaaatttctgattatagttctttaatctggtttttagtagtactactagtctactagtgtatttaatgatttatgagtgaacctttttgtaatgtcgtatcgcaattttgtggctttgaaatgtcattttactcttccc

SEQ ID NO: 167 - DNA, 1323 bp, Amaranthus lividus
agaaggcagaagagagcgagcagaagaggacattgaagttgataagcctgcctgcctggggttttagcttaacccctcccttatctttcttcttccttttgccgacttatttctcctttcaccctgcaacccaacaaattcagtggtagattaaaatggctgcccaattggttcgtgaatggactggaattcagcaatttcctgctgcaactcaaactaagttgcttgaattattgggaaagttgaaacaagagaatgttgattctttgactatccttgtactggggaaaggcggtgttgggaaatcatcaactgtgaattccgtcattggtgaaagagtagttgcggtcagtgcttttcagtctgaggtatcaagacctgtgatggtttcacgtacaagagcgggatttactttgaacatcattgacacacccggtctcgttgaaggaggatatgtgaatgatcgtgctattgacatgataaaaggctttcttctggataagacaatcgatgtattgctatacgtggaccgattggattcctatagaatggatacactagacaagcaaatcatcaaagctattacagatagttttgggagagccatatgggatcgtgctgcaatagtccttactcatgcacagttctctccccctgatggattgagttacgaagacttcttcgaaaaaagatccgagtcttttctgaaagttgttcgctttggggccggaataaagaaacaggattctcttgcattctcaatgcctgttgttttggttgagaacagtggtcggtgcaataaaaatgatgatggcgaaaagattcttccaaatggagtttcatggataccaaatttggtcaagactatcattgatgttgtatcgaatggaagtaagggtatcttggttgacaagaagttgattgagggcccgaatccaaatgcgcgctttaagatgttgttacctttgattatgttagctcaatattttcttgtgatcaagccgattcaaggacaaatcaaaagagatatatccaaagaaaagaaggctccatgggaactccgagatgtagttgcagccaaacgcagggtctaaaatcagtgacctcacaacgctatcaagtatttctcgtctctacttctatagaggttttagttagcattgtggtaatccggcaattctactgatcttcaagtttcttaaaagttgcctcttttattagtcatctgatctttgcaggcaatgaaatttctgattatagttctttaatctggttttaatagtactactagtgtatttaatgatttatgagtgaacttttttg

SEQ ID NO: 168 - DNA, 1394 bp, Amaranthus palmeri
aattgaggagagagaaagaggtaaagaaggagaagagagcaaccagaagaggacattgaagttgataagcttacctgcctggggttttagcttaacccctcccttatctttcttcttccttttgccgacttatttctcctttcacccggctacgcaaaaacttcagtggtagattgaaatggctgcccaagcggttcgtgaatggactggaattcagcaatttcctgctgcaactcaaactaagttgcttgagttattgggaaagttgaaacaagagaatgttgattctttgactatccttgttctggggaaaggcggtgttgggaaatcatcaactgtgaattccgtcattggcgaaagagtagttgctgtcagtgcttttcagtctgaggtatcaagacctgtgatggtttcacgtacaagagcgggatttacattgaacatcattgacacacctggtctcattgaaggaggatatgtgaatgatcgtgctattgacatgataaaaggctttcttctggataagacaatcgatgtattgctatacgtggaccgattggattcctatagaatggatacgctagacaagcaaatcatcaaagctattacaaatagttttgggagagccatatgggatcgtgctgcaatagtccttactcatgcgcagttctctccccctgatggattgagttacgaagacttctttgaaaaaagatccgagtcttttctgaaagttgttcgctttggggccggaataaagaaacaggattctcttgcattctcaatgcctgttgttttggttgagaacagtggtcggtgcaataaaaatgaagatggcgaaaagattcttccaaatggagtttcatggataccaaatttggtcaagactatcattgatgttgtatcgaatggaagtaagggtatcttggttgacaagaagttgattgagggcccgaatgcgaatgagcgctttaagatgtggacacctttgatgacgttagctcaatattttgttttgatcaagccgattcaagcacaaatcaaaagagatatatccaaagaaaagaaggctccatgggaactccgacacccagttgcagccaaacgcagggtctaaaatcggtggcctcacaacgctatcaagtatttctcgtctcaacttctatagaggttttagttagcattgtggtaatccggcaattcgaccgatcttcaagtttcttaaaagttgcctcttttattagtcatctgatctttgcaggctatgaaatttctgattatagttctttaatctggtttttagtagtactactagtgtatctaataatttatgagcggattttttgtaatgtcgtatcgcaaattttgtggctttgaaatgtcattttactctt

SEQ ID NO: 169 - DNA, 2639 bp, Amaranthus palmeri
cttccctctacgtaatacatacacattggacgatgctcctctatccctttttgagtgtactacatcggaacacttgagaattgtctagttgcaaattcacaatttgcgcaaactttaaagacacagaacgagtaatagtagttgtgtaaaaattgtgccttttcccttttgttcttctatcgtttaatggttctgtttgattaaaacgctttgatgtacgcttctttgttgccgcaattagccttgcatcggatggttacttgtgttttctgcttttgttttaggtgaattacatggagaagcacacgtcctttttgcacttcgtgaccaacgtctgtgcaattatcggaggtaacgttcttcctcttatctcttaaatgttaccagtcctgcgccgctataattaatctaacgctgcctcgtgatatgaaacttatatgtggtttttgtttcctgtctctggatatcgcccttgttttcctcccccctctgcccaaatttagtatcataagattgggaaaaaaatatccttgaataatattggtctatgattgaatttgtcgaaggtgggcgaatggggataaatgtagcacaactactatagcagacgcttctgtagatgtctttattttcgagaggttaaaagaaaagttaatctttggtcatggcctcgacttgtgagttggttatgcctctactgaactgaatatgtttgcactatgtttttctattctatatatgatccgttcaacctttatcattatggccatgaattctgaatgacccacgccataaaaaaataaggtcgcattgcatcggtcgtgttgtaaaggttttcaaaataaacgaatagatatttcccgcgttataaagcggtaaaatttacgaagtgggccgtttcaagggatatcttatggttttgaccgatataggtgctatgattaccgcatcagcgttgtgtaactacgatcgcgactgtaaccacatttttacactgagtcccacaccaaatccatatttgatcatgaaatcttttcttatcaattgatgtttgtgctcaaattcagtttccacttgaaatgctgcttgtcgcattcggcaagatttctaataatatcaactactgaaagaagtgtgttttctctcaggtacttttacagttgccgggattatagactcgtttgtttatcatggtcgtaaggctatgaagaagaaaatgtaaaagaaatgtcattgcaacttaagcaaaaggtttaatatcctcgaccctcctggccaaaatacggtgtgaattctaccgagtttacttctagagtgcgacttgatcgtgctgatataggcaatgatatgttcgagaatttttggtctacaacttcgcgcgattatcgagtagttagcgatttttattcaagcacattgtcattaaattgtgtagttataattgatgatgtagatgtgtcgaggggttccctttaccacagtccacgagtcgtatatgaatagccgatatttgattgcaaagtttttatccgcaaagaagtacaccaatcttgtcttctttctagtatcgatgtgtaggttatgtagacacattacggatttttgaatgcgaatggccgttggaagctaagctccttggtcgaaagcgaaaatgtattgctctcttactcttcttgcaattttacatttgtttcttcacttatttcactccaatcttcttgattacctccgttttatatagataaaaacttaggatgggtgaattgaattgcattttattctagtttgggatttaattcatacttaagcagtttgatttgattagcaaattttaatttttggatgagacgatcttaacataagatgagtgcatatatgctttaaaataatctaataatacaaattattagcatttaaactttttattgagatcatctacccgcaaaagtatctctttagaattagttcaatttatcaaagtggatttgtacttaattaatgagaacatgacttacatagctacattgaatagaatttgactaactttttgatttagttttttttggtaaaataataaaaaaaagtgtattaaatggatttacaatagccgaaaaccttacttttacgcccaatagtttaatatcatatatttgattcgacttgggttttttttaatagtttttggctttttaattcacttttctcataataatatgtcgacaatctaataactaatttcttttaaacatctcgataacaactttgttaaacaattaatttaacatgctaacaataaagtaaatactactatttaatcaaataaatcaactagaccagcgattaaagaaaaagagtaaaaataattgtaaaactaaaaactattagtgttcaaatagatccgacaatcatagattcatccgaccttataataaaacctaattttacccaacatagtaaaaaaaaaaacaatataaatacaaaatctgattttataccgatctgaatcactggacacccggtaaaaagggaacgaaactttggctaaatttagaggatagtattggttaacaattttggagagagaaagaggtaaagaaggagaagagagcaaccagaagaggacattgaagttgataagc

SEQ ID NO: 170 - DNA, 9418 bp, Amaranthus palmeri
cactacacaaccacataatcatcctaactcatgtacacacatttaccaaaccatatgaacacactttgggctttattgagtcacaacaacaacaaattttttgatgggtctgtttgtattttacatgggtgttaacttttttttgtaattatatttttgcttcatgaaattgttccaagtttccaactttatggtttgtttttgaagtgtgatttattagtttcagaagttattcatgtttattatgtttggagtaggtggtagattgaaatggctgcccaagcggttcgtgaatggactggaattcagcaatttcctgctgcaactcaaactaagttgcttgagttattgggaaagttgaaacaagaggtttggtcaaattattttacatttcagcaatcttttgaccatgagaatttgttttgggtgattattgaatgtattttagttacattttttcatttgtaattttttggttgtagaatgttgattctttgactatccttgttctggggaaaggcggtgttgggaaatcatcaactgtgaattccgtcattggcgaaagagtagttgctgtcagtgcttttcaggtatgatttcacattccatgtatgaatgaatgtttggatgtgagggatgagaaagtctacataatgactttaatgattacttgtagtctacgtccttgatttttgaaatggtaacaaattttgatcgtgtaatataaggaagttgaagtttatgcattgctatattgcttttgtcgcggcataatatgtactctatttgtctccataaatttcccgcattgacgttccttatgtgagacagtgaaagcttttcaaggtcaatagagaaaactaatggggatagtgggagtaactatatagttggaattcatttaatggatgaatgtaactcacgatttttctattgtatgatagtcagaggtcgctttaggttgaggatatcatccttttttgaaaaggattaaattttttatttgattctatgttctatgcaaggaattttgtgtctaaagcttctttatattagattgggtgctcaaatcatgaaacttcccttagacatttgaggtggtttcttaaagaatgaaaacacatacttctataagcctctaattttttgacttgagataagcatagatttgatgggcttcttggttatttgagtgacacatttttagttttcttttgaccaagatactgtatattatattttattgacttttgtttgtagttctgcattgacgtttgcgggggaggacatggtgttgcttcttttcttatatagcatcatgctaggcaatttttgccaattttctgatgcacgtttctttttaaatttatatagtctgaggtatcaagacctgtgatggtttcacgtacaagagcgggatttacattgaacatcattgacacacctggtctcattgaaggaggatatgtgaatgatcgtgctattgacatgataaaagggttagtgataaatgatatcatctttcctgttattcatgaaagtccttttattctttgtattattatctatggtcataaatgatacatgccaagtcctttcagatttttgtaataagtgttttgcaacttagtcctttctttcaaatgcgtgccttgttctttatcatttaccattttcttcatttgaattgttgtggcacatgaacacttgcactcagtccagtttggtttggaaagattttgtttgaaagacatggtgtctatgatatgaaaatttttgatggtattgtagtgatcattatgttctttctcctatttttgcctttcgtttgatgaccctcattctatttttgtttactgtttcatttgattggagcagctttcttctggataagacaatcgatgtattgctatacgtggaccgattggattcctatagaatggatacactagacaagcaaatcatcaaagctattacaaatagttttgggagagccatatgggatcgtgctgcaatagtccttactcatgcgcagttctctccccctgatggattgagttacgaagacttctttgaaaaaagatccgagtcttttctgaaagttgttcgctttggggccggaataaagaaacaggattctcttgtacggcatcttcacctgctttgctttagtccttttcttctgtctgcttgcaatatgtgtttcttctaatacaatttttgggtgcgacttgttctgcacttttttcggaaaaaaatgacatgagataaaaactaccatacagtaagaagcaatcatttacaaatttcctgccaatagtctgaacccttataaactgtatattgtgtttttgcaatcttaacaagttaactatgaccttttattgtagtcctgctgcttgcattaggtattgctttttcaaatttttttccctccatgattgatttcttgggaatggggactcatagaacttgatttttctttcagtgaaaaacgagggcattagcagaccagtactagttttggtgtgaagctacatgcttcaggctgtgttggaagtgatttcctgaccattaaaacttcccgttttgcccctccaaaatatatatttatataaactgttatcttcatcctttggcattggcattgttgtgttctttccacgttgttgtcacatagagcctgtaggagggggctgttgggattacgaagaaaaatgattcataattacttcaattttttagaaaattgattaccttcaatcttatatcagtcaaatagtatctttgatagttttcttggatgaagggaaccaggaatttcttgttttatttcagtgacaatcactagcttatgtgatgattgttataagacctttacggcctatttggttagtggtactaaatagtggtaatggaaatgattaatagtgtagatttcatgaaaagttccatgtcattcccatggtgatggaactttaatcacaaaaagtgtttttttctttttcttttctttttctttttttttttacaaatttccattaccatctaatatcatccctctcaatggtaatgctttggaatgaaattcacgaaaaaaataagatcattgaagttggacaaacatggctggccatcaaggtagccaagagatttttcaaccagattacactagttttcattctcattaccaccccgttgatgtctattgtaattctcaatttaaaggaccccggcccggatatgttcctgaattgtgaacactgtttactatgcactatatagtatgtggtatttaccaaggggcaaagaccatcggctaaatagtgaactgttcaaggttggtagagaacctttgtgccatgtactatgtctccaaattgaactctctttatattttgctttattaggttaactttaagctttcttgatctaagcattttttttcttttttgttttatgatctcctaggcattctcaatgcctgttgttttggttgagaacagtggtcggtgcaataaaaatgaagatggcgaaaaggtcagtggtttactagtcttctaatcggtaattgctttcatcttgtatttactagatgttcaatataagatatttcactgataattgctgtcatcattatagattcttccaaatggagtttcatggataccaaatttggtcaagactatcattgatgttgtatcgaatggaagtaagggtatcttggttgacaagaagttgattgagggcccgaatgcgaatgagcgctttaagatgtggacacctttgatgacgttagctcaagtaagtttcttgatttacaaaattagtttattatgtgttgatcgctgatatactatgtttaaaattgtttgctctcgggatctaaagagtcattttaaatgaacaataacaaacatcattctattatctcaacactgctatgtggctctcgcttaaatggggttaggcgggggtcaatgcacgcagtcttacccttaacaaagacgttgccaatcaatgtgtgactgcacacatcatatgtaatttcgaagactccgctgcccctgagatcgctcctctaggaaaatgcagaaccaagaataattagtggggtattgtagtgtggtcatattctttagtgaagtaattataggttttggtaaaagagggaaatgatttgtttgttttagtttatgataggtgggttatgtcccaaaggataatggggcaaactaaatggaacataccgaaatagtatataaagcaaaatctgggtacagagagagtaattaagaatttcacaaaattgtgctaataagttgtctaaaatagggtataaaatatgatacaaaatagtttggccttgtaatgtagagtccacgcataacgcattagcgttaattttgcatattcgccttagaaaacccaactaaaatggagtagaatttacgggcagtatttattcttccccgtatcgcccttggaatccctgaccataattttctatgagcgggatacactaggaataatgatgatgattatcgcccttggaataccctaaaagttttctactttttatgtagtattttgttttgatcaagccgattcaagcacaaatcaaaagagatatatccaaagaaaagaaggctccatgggaactccgacacccagttgcagccaaacgcagggtctaaaatcggtggcctcacaacgctatcaagtatttctcgtctcaacttctatagaggttttagttagcattgtggtaatccggcaagtcgaccgatcttcaagtttcttaaaagtttttagtagtactactagtgtatctaataatttatgagcggatttttttgtaatgtcgtatcgcaaattttgtggctttgaattgtcattttactcttcccatcacaaagttggcgagttttttggaattcaaacaaatatgaatcatacatagctttctaaagtaggaaataaaacacttaaaagtgaaattctcaaaaataaagtttacacttacattgtcgtcgttcccgctcatagaaaactatagacatggtctagggagggaaggacgacggcaattcatacccataaagaagagcatgatcaaaagtagttccctggcggcaacgtatattgttatgaagtatttattcataaattctcatttgagatagtctattcatgaaataattttagattaaactaaattatctgataactaaaatattcacttttaatattaaaacattcgttttctttaaatttatttgtttgtaatgatttattcacgtcttataaaagagttgtacgtatttatttccgtatttcattgagattgatgtattacatttttgaagtgtacaagttgataaatcactccattttgaattgagtgaatatttacaattgtacaagttatgaggttaaattttgataatgtttatttgataatttatacattgaattatataaatctaaaaattataaagaacttatatcataaaagtatgtgattagacgattcaaacaggatctcacttgactgtttttttcttatacattacattagccgcaatatataaaataaacttaaataatagatagtgtcaataaccataatatagtaagtgttccaagttgtatttttctggtcgaagaggttagcatcatttaaaacaaaatataatgaggaaataatattgacttcatagttttaggccatacttgtatgaaaatgacaatatgattttgatgaaaataatgtgaagtaaaagatatagagtagaccaatcaaatggtttggtcggttatgaaatgtttccatctgccaattgaaatttgtagatcatttgtgatgccaaagtctcaattcttgattgatgcaaattgtaataattattttgtctagcttgatatattaatagactaaataaatctacccgttaaatcatgtgcccttttatcttcttatcttgatcaaattacagatgcaatcaaatttaaataaaagattctttttatttttgtaaggatagaattgtatatatcaacctaaactcttgtctgggcgctaatgaaagttagtacttttaggataatgatagatgaatctacactcaaacatcaggtagcacgtgttacccatgaatatttttataaattagttttaatatttttcatttttactattttacgaaatagggtttttcacaccttaagattattaatgtattgttcattgtatgtgttaatttggagtaatgaatttttgtgagtgttcattttacaaataaaactctgcaaaattatttatattttttaaagttaacttttttgctctaaagaagtcacccaaaaatcgcgatctcttgtcaaggcactactaaagcttggtgttgatcaaggctttcctcctacttcagaccccagggtatttgctctaaagattactttttcctttttaggttatctagcaaacgatttttttcaggtttttttgttgacttttagcttttgctattaaattatgcccaacggccccaacattgaacttatgatttatttaaaatattgtccaaatattacaattttaaaaaatatcatcatcatcatacccaatataatataaaatattgctacataactagtaacaataaaaactgtctaaaaataatcactaacacaaccgggtactcggtgtccgacccgacttcataaattgggccgagacacaaaacgataaaaaggtaccccactaaccatgtactcgacttttcaaatacccgaaatgctaggtacccgctaataaacacccttacccacacctccttcaaacagagggcatgaagaatatggtaaaaaagactccaaataaatgctataggcctaattaccctcttaattagtccttgctttgaaattctctattggaagaagcaaactataaaaataaaacaaaacacaagcaattataggcccggcccaaaaaacccaatgatcatcccaaagatggcctcctcttacaattgcaggcccaatacaccttgctgggttaataattgcaccagtatatcctttcttcatggtcacagtcatggacaagtacatagtaagcccgactacaatacccgtaattgagcacattaataattggcccagttccttggcccgtttctgatcaaaagccatccaaactgagaataaaaagataaacgtgtaaatgatttcagcccataatccttgggctgtctcaatcccaattgtagtatgcccattcgggcttggagcaacaacttcaagtgtgcacccacctaataagtacgtcgaatttgttatggaccccataaccatcgcttgaagggcccaagcaccaagagtcgacccgatacattgggctattaagtagattatagcccgagagaatgagatcaggcccataaaagtcgcggagatggttattgttgggttcatgtggccaccggaaactgggtgtgttgcaaggcgaaggaaggctacgatgatagcaacaaaacaagcaagcaatatattgggcgtgtcgttgtggatcttagacgacatgataatgttgtcgaacatgaatactaggattgatgtgcttaagagttctgcaattgatgctcgccatacctgaaattatatatagttataacataaaaattgtgtaaaattaatattgacattaataaaatattaaattttactctacgtagtaagtattatttgtttgatatgacgaaataatgacttgatgtttatataagaaattaaaaatagaaatattaggtacaaagtgtttgcttgttattgtgcaaccactcaaccaactaatcgaacttgttgagtttttaatcttagaattgagcggattatttgatatttactctatcttataactgaatttacttcgatcagatataaaaattgattaagaaatatgcaaaagcaacacaacttgttttgtaggagaccgtctcactgtctcactatgagccagacccatatgattagtttatttctcttattgatcacttttaaattgtaagtgaccattttaacacactaaacatacatggactagtccaatagagatggtcttaccatgagatcgtctcatttaatactttgtacaacatggttacaagacctgattttatattgacccgaaacatctaacccaatattaacccgataacctaaataaacatcttaatgtaagattgtttttgacatgagaaaaaaaacctgtgttgagaagatttcctcgtagccaatccaatgaagaaatttaaccgaagtactaattattctcttctggatttcccttttcttgtaccatgaaaaccaacccctatacacaatttattttaagagtaattagaagggaataaagtgagactaatttatgcgaacttaagaccgtcttttgtaaaaacagcttttaaaagcccagtccaattttaaatatatattgttacaactctaaatatagatttggactggacttttgagagtcgtctttataaaatacggtctctcaagaaagcacctgattatagaaagacaaaattaattaataatataggagtaattagtgcataattatacatttaccaggaattagaaacattttgctgtgtaggagtgactaaaactggaagaattctattagaatttgttgcatcttcatacttattattataattataattataattataattataattattttcagtatccttaattgtaacaatactttcacccataattgaatattttaaaacaaattaaaatggcaaaagaaaattagttgcaattctttggtgtatttagacctctatatatagagttttattatgtgccccacttttaattataccaacattttgattggaatgagaatatatttccctttatatttattatttatttatttatttttcccttaatatttatgttattggttttgttaacccaattttgatagtgaaagattagtcgtattattttttttttcattgtcaaatacgagtacattttataaattattataaggattgcattacacaaatgtaataaattgtatattttttaattcgaaaatactaatatttactttatggagttgagatgtaaatatacaaaatataacatctaaaaaaattgcatatctatatgatttaactttcaattttataacaataataatttaatattagcgacaacaataacaataataatttaattaactattcaaaacaccactttagaaaaattgtactgtatattgagataatgtaattttatagagaaaattttgtaaacatagtcaagcacactacaacataatttgcttttagtgggatatattagcgacatttaattt

SEQ ID NO: 171 - DNA, 1205 bp, Amaranthus rudis
acattggttaacaattgaggagagagaaagaggtaacgaaggcagaagagagcgaccagaagaggacattgaagttgataagcctgcctggctggggttttagcttaaccccttatctttcttcttccttttgccgacttatttctcctttcaccctgcaacccagcaacttcagtcgtagatgaaaatggctgcccaatcggttcgtgaatggactggaattcagcaatttcctgctgcaacccaaactaagttgcttgaattattgggaaagttgaaacaagagaatgtggattctttgactatccttgtactggggaaaggcggtgttgggaaatcatcaactgtgaattccgtcattggtgaaagagtagttgctgtcagtgcttttcagtctgaggtatcaagacctgtgatggtttcacgtacaagagcgggatttacattgaacatcattgacacacccggtcttgttgaaggaggatatgtgaatgaccgggctattgacatgataaaaggctttcttctggataagacaatcgatgtattgctatacgtggaccgattggattcctatagaatggatacactagacaagcaaatcatcaaagctattacagatagttttgggagagggatatgggatcgtgctgcaatagtccttactcatgctcagttctctccccctgatggattgagttacgaagacttcttcgaaaaaagatccgagtcttttctaaaagttgttcgctttggggccggaataaagaaacaggattctcttgcattctcaatgcctgttgttttggttgagaacagtggtcggtgcaataaaaatgatgatggcgaaaagattcttccaaatggagtttcatggataccaaatttggtcaagactatcattgatgttgtatcaaatggaagtaagggtatcttggttgacaaaaagttgattgagggcccgaatccaaatgcgcgttttaagatgtggatacctttacttgtgttagctcaatattttcttgtgatcaagccgattcaaggacagatcaaaagagatatatccaaagaaaagaaggctccatgggaactccgagatctagttgcagccaaacgcagggtctaaaatcgtggcctcacaacgctatcaagtatttctcgtctctacttctatagaggttatagttagcattgtggtaacccgg

SEQ ID NO: 172 - DNA, 276 bp, Amaranthus rudis
agtattttcttgtgatcaagccgattcaaggacaaatcaaaagagatatatccaaagaaaagaaggctccatgggaactccgagatctagttgcagccaaacgcagggtctaaaatcgatggcctcacattgctatcaagtatttctcgtctctacttctatagaggttatagttagcattgtggtaacccggcaattcgagcaatcttcaaatttctaaaaagttgcctcttttattagtcatcttatctttgcaggcaatgaaatttctgatta

SEQ ID NO: 173 - DNA, 1780 bp, Amaranthus rudis
gatagtattaaacgatagtttaaacgtgtggatgagattaaaaaagttgcggggtttttctgtaaagaaggaaatgtggaaaaatagtaggataacccaaatagaatatgaggcaaattgagagggacaaatggagcatacatttatagattagaaggagaaaggtaaagaatatttcaagtcctaatatatctttcgttacattacaatttccagtcctaatatatttgctattctttaatctcctattgttttgcacttcgtaactaaactttcttgttggccacatccatcactgagccatccttatgtatgatctactaaaattgttcttccatgaaccatacaaaataaaaattgggtcttaagaatggaaagcacttaaattgggctaattcaccaagtttttgaacaaggaaatcagtttcatctttatgtttcattaattctgttgagaaggcggctcaccactctttctgtttggttgtcttttagccatatgttagaatatcgtaatattaatgaaatttcagtgtagttttgctaagataattacatgtgaaggtttgtgttcatgcttgtccaactccaaatgtgtgtttttccttatgaatttattctcattcgttactacttgaagtcgtggtattatggtattgaaaatttgtaaagaaaaacacatgtttgaggatagagtttcattcccatgagaatttccaatgctgttttttttatgaaaattcacactagattttttttcttaccattacctctatttatgacttgttatgaaacaggccattaatatgttcatttgctcaagttacttaaattacaaaatgaacaccctttcttgttgtgcctttttttctccctctcagttgatggtcattatttgtcttcccttcatacatttctcaatctgttaaaagttgatttcatgaaaaacaatgctagaagtctagatctcaaaagatttgagtccactatatgaattaatatatctgttccaatggtgtcaacataacatcttcattttgatttcctaccttgactagcttccttttattttcgtcttatctttttattgtatgatgttctctattcttgaaaatctcagttgcatttgaatttatgtgcaatgtgcaagttgggatttgattcatttacctttttcatcatttgaattattgtggcacatgaacacttgcattcagtccagtatggtttggaaagattttgtttgaaaaatatataatgtctacgatatgaaaatttttgatggtattgttgtgaccattttgttctttctcctatttttgcctttctttatatgatcctcattctatttctgtttactgtttcatttgattggagcagctttcttctggataagacaatcgatgtattgctatacgtggaccgattggattcctatagaatggatacactagacaagcaaatcatcaaagctattacagatagttttgggagagggatatgggatcgtgctgcaatagtccttactcatgctcagttctctccccctgatggattgagttacgaagacttcttcgaaaaaagatccgagtcttttctaaaagttgttcgctttggggctggaattaagaaacaggattctcttgtacggcatcttcacctgctttgctttagtccttttcatccgtctgcttgtaatatgtgtttcttcttcattttttgggtgcgactgttatagtgtgcatatattctgcgttatttaggaaatagaaaaaaggag

SEQ ID NO: 174 - DNA, 968 bp, Amaranthus rudis
agttgaagtttatgcattgctatattgcttttgtcgtggcataatatgtactttttttgtccccataaatttcccgcactgacattcctaatgtgagacggtgaaagcttttcgaggtcaataaggaaaactaatgaggatggtacgagtaactatatagttggaattcatttaatggatgaatgtaactcacgatttttctattgtatgatagtcagaggtcgctttagtttgaggatctcatccttttttgaaaaggatcaaattttttatttggtgctatgttctacgcaaggaattacgtgtctaaagcttctttatggtagaccgggtgctcaaatcttgaaacttcccttagacatatgaggtggtttcttaaagaatgaaaacacatacttctataaacctctaatttttgacttgagatgggacatagatttatgggcttcttggttatttgagtcactgcacatttttagtttccttttgaacaagatacttttttatactcctattttattaacttttgtttgtaattttgcattgacattggcgggggagtacatgatattgcttcgtttcttatatagcgtcatgttaggcaatttttgccaattttctgatgcatgcttctttataaatttgtatagtctgaggtatcaagacctgtgatggtttcacgtacaagagcaggatttacattgaacatcattgacacacccggtctcgttgaaggaggatatgtgaatgaccgagctattgacatgataaaagggttagtggtagatgatatcatctttcctgttttcatgaaagtcctttcgttctttatattaatatctatggtcagaaatgatacatgccaaatcctttcagatttttgtaataagtgttttgcaactaagctacctttctttcaaatacatgcgtgttccttatcattttagttatttggttgttgataaaac

SEQ ID NO: 175 - DNA, 781 bp, Amaranthus rudis
ttgatgggtctgtttgtattttacgtgggtgttaaattttttagtcatgtttattatgtttggagtaggtcgtagatgaaaatggctgcccaatcggttcgtgaatggactggaattcagcaatttcctgctgcaactcaaactaagttgcttgaattattgggaaagttgaaacaagaggtttggttaagttattttacattttagcaattttttgaccatgagaaattgttttgggtgattattgactgtattttaattacattatttcatttggaatcttttggttgtagaatgtggattctttgactatccttgtactggggaaaggcggtgttgggaaatcatcaactgtgaattccgtcattggtgaaagagtagttgctgtcagtgcttttcaggtatgatttcacattctatgtatgaatactcgttgtatacataatgattactcgttgtctacctccttgattttagaaatggcaacaaattttgattgtgtaaaataaggaagttgaagtttatgcattgctatcttgcttttgtgcggcataatatgtactctatgtgtccccataaatttcccgcactgagcctcctaatgtgagactgagacggtgaaaacttttcaaggtcaatagagaaaacttatggggatggtgtgagtaactatatagttggaattcatttaatggatgaatgtaactcacgatttttctattgtatgatagtcaagaggtcgctttaggttgagtatctcatcctcttttgaaaaggatta

SEQ ID NO: 176 - DNA, 1983 bp, Amaranthus rudis
gcctcgtgttagcccttagtgaaaaattcatcgacttgtgagttggttatgcctctactgaactgaatgtctgcacttatgtttacctattttatggccatgaattcaaaatgaccacaacaaaaagtaaaaataaggtcgtatcgcatcgcatcggtcgcattgtaaggtttttaaaataattgaacctatatttcccgtgttgtaaaggtgtaaaaaattacgttttgggccatatttagggtttatcttatggtttctaccgatataggcgctatgattaccgcatcactcccgttactgcatcagcgttgcgtaactcgatcgcgactgttaccgcattttgcactctgagtcccacaccaaatccgtatttgatcatgaaatcttttcttatcaattgatgtttgtgctcaaattcagtttccacttgaaatgttgcttgtcgcattcggcaagatttctaatagtatcaactacagaaagaagcgtgttttctctcaggtacgtttacagttgccgggataatagactcgtttgtttatcacggtcgtaaggctatgaagaagaaaatgtaaaagaaattcgttgttgctgctaaagcaaaaggtttaatatgctcgactctcctggccaaaatacggtgtgaactcaactgaggttaattctagagtgtgacttgatcatgctgatataggcaatgatatgttcgagaatttttggtctacaacttcgcgtgatgattgagcagttatcgatttttattcaagcacattgtcattaaattgtgtacttataattgttgatgtagatgtgtcgaggggttccctttaccacagtccacgagtcgtatatgaatagccgagatttagttgcaaagttattttccgcaaagaagtacaccaatcttgtcttctttttagtatttatgtgtaggttatgtagacacattacggttttaaaaaaaccgaatggccgttggaatctaagctccatggtcgaaagcataatgtattgctctcttactcttcttgcaatgttacatttgtttcttcacttatttcaatccaatcttcttgattacctacattttatatagtagataaaaactaaggatgggtgaattgaattgcgttttatttaagtttgaatttaatttataatttctagcagtttaatttgatttgcgattaatcacaaatttttgtagacggtcttagcataagacgcgtttatactgtgttaaataattcaataatacaaattattaacatttaaacttttttttttgagattatctctcaatggtccaaaatcaatacttgctcctttttttggctttttaattcacgtctttctcataacaactttgttaacacaattagtttaacatgctaactattgacaaaaaaagtcaatactactaactagttaaataaatcaactagaccggcgaaacgatcaaattaacttctacaacaatttggataacaattttaaattaaagaacaaagagtaaatagctttaaaaactataagtgtttaaaatagatccgacaatcaatattcatccgacttttaacaaaacctaattttaatttttaccccacttaaaaataattttacaattatataaaaacaatatgaacaccaaatctgattttaaagcgatcccaaacacataatttgaagtaaaatccaatcacacccggtaaaacggagctttggctaaatttagaggacataggttaacaattgaggagagagaaagaggtaacgaaggcagaagagagcgaccagaagaggacattgaagttgataagcctgcctgcctggggttttagcttaaccccttatctttcttcttccttttgccgacttatttctcctttcactctgcaacccagcaacttcagtaagttatctttttctatttgaattctgatttcttgtctcagttttagggttttcttacaccctttg

SEQ ID NO: 177 - DNA, 1278 bp, Amaranthus rudis
tatttactatgtactatatagcatatacccggggacaaaaaccatcgcctaaatagtgaactattcaaggttgatagagaacctattgcgttaaagaaaacacatgtttccaaaattgaattctctttatattttgcttgattaggttaattttaagctttcttagtctgagcttttttttgtttcataatctgctaggcattctcaatgcctgttgttttggttgagaacagtggtcggtgcaataaaaatgatgatggcgaaaaggtcagtggttaatagtcttctaatcggtaattgctttcatcttgtatttactagatgttcaatttaagatatttcactgataattgctgtcatcattatagattcttccaaatggaatttcatggataccaaatttggtcaagactatcattgatgttgtatcaaatggaagtaagggtatcttggttgacaaaaagttgattgagggcccgaatccaaatgcgcgttttaagatgtggatacccttatttgtgttagctcaagtaagtttcttgatttataaagtttgtcatgtattgatcgcttatatacaatgttttaaactgtttgctcacatgatcttacgagtctctttaaatgaacaataacaaacatcattctattatcccaacgccattatgtggctctcgcttaggtggggtttggtggggatcaatgcacgcagccttatcattacagtgacaaaacttttccaatcgtttcgtgattgcacacactatatgaatttcaaataatccgcttctcctcgctcctcaagggggttgcacaacaaccaagaaaaaaggagtaattagtggggtattgtatgttggtcatattctttaatataagaaagaaatgaattgtctgttttagtggagtattataggtgggttatgttcgaaaagggtaatggggcaaactatatggaacggaccaaatagtatataaagaaaaatttggggacggagggaataattaagaatttcacaaaaatgttgtgttaacttctctgaaatagggtctaaaatgtgataggaaatagtttgcgcctcgtgatgttgagtaaggccattagcgttagctcggtttccatttccctgcaacttgcttcaatatgattaggagatttggcttttgcttattcgccttattaaacacaactaaaatggagtagaatttacgggtagtatttattcttcccggtatcggccttggtataccctaaaacttttctaccatttatgtttg

SEQ ID NO: 178 - DNA, 1406 bp, Amaranthus spinosus
agatctactgacggttaacaattttggagagagaaagaggtaaagaaggagaagagagcaaccagaagaggacattgaagttgataagcttacctgcctggggttttagcttaacccctcccttatctttcttctttcttttgccgacttatttctcctttcacccggctacgcaaaaacttcagtggtagattgaaatggctgcccaagcggttcgtgaatggactggaattcagcaatttcctgctgcaactcaaactaagttgcttgagttattgggaaagttgaaacaagagaatgttgattctttgactatccttgttctggggaaaggtggtgttgggaaatcatcaactgtgaattccgtcattggcgaaagagtagttgctgtcagtgcttttcagtctgaggtatcaagacctgtgatggtttcacgcacaagagcgggatttacattgaacatcattgacacacctggtctcattgaaggaggatatgtgaatgatcgtgctattgacatgataaaaggctttcttctggataagacaatcgatgtattgctatacgtggaccgattggattcctatagaatggatacactagacaagcaaatcatcaaagctattacagatagttttgggagagccatatgggatcgtgctgcaatagtccttactcatgcgcagttctctccccctgatggattgagttacgaagacttctttgaaaaaaagatccgagtcttttctgaaagttgttcgctttggggccggaataaagaaacaagattctcttgcattctcaatgcctgttgttttggttgagaacagtagtcggtgcaataaaaatgaagatggcgaaaagattcttccaaatggagtttcatggataccaaatttggtcaagactatcattgatgttgtatcgaatggaagtaagggtatcttggttgacaagaagttgattgagggcccgaatgcgaatgagcgccttaagatgtggatacctttgatggcgttagctcaatattttgttttgatcaagccgattcaaggacaaatcaaaagagatatatccaaagaaaagaaggctccatgggaactccgacacccagttgcagccaaacgcagggtctaaaatcggtggcctcacaacgctatcaagtatttctcgtctcaacttctatagaggttttagttagcattgtggtaatccggcaagtcgaccgatcttcaactttcttaaaagttgcccctcttattagtcatctgatctttgcaggcaatgaaatttctgattacagttctttaatctggtttttagtagtatctaataatttttgatcgaatttttttgtaatgtcgtatcgcaattttgtgtctttgaaatgtcattttactcttccc

SEQ ID NO: 179 - DNA, 1376 bp, Amaranthus thunbergii
aaagaaggcagaagagagcgagcagaagaggacattgaagttgataagcctgcctgcctggggttttagcttaacccctcccttatctttcttcttccttttgccgacttatttctcctttcaccctgcaacccaacaaatttagtggtagattaaaatggctgcccaattggttcgtgaatggactggaattcagcaatttcctgctgcaactcaaactaagttgcttgaattattgggaaagttgaaacaagagaatgttgattctttgactatccttgtactggggaaaggcggtgttgggaaatcatcaactgtgaattccgtcattggtgaaagagtagttgcggtcagtgcttttcagtctgaggtatcaagacctgtgatggtttcacgtacaagagcgggatttactttgaacatcattgacacacccggtctcgttgaaggaggatatgtgaatgatcgtgctattgacatgataaaaggctttcttctggataagacaatcgatgtattgctatacgtggaccgattggattcctatagaatggatacactagacaagcaaatcatcaaagctattacagatagttttgggagagccatatgggatcgtgctgcaatagtccttactcatgcacagttctctccccctgatggattgagttacgaagacttcttcgaaaaaagatccgagtcttttctgaaagttgttcgctttggggccggaataaagaaacaggattctcttgcattctcaatgcctgttgttttggttgagaacagtggtcggtgcaataaaaatgatgatggcgaaaagattcttccaaatggagtttcatggataccaaatttggtcaagactatcattgatgttgtatcgaatggaagtaagggtatcttggttgacaagaagttgattgagggcccgaatccaaatgcgcgctttaagatgtggttacctttgattatgttagctcaatattttgttgtgatcaagccgattcaaggacaaatcaaaagagatatatccaaagaaaagaaggctccatgggaactccgagatctagttgcagccaaacgcagggtctaaaataggtggcctcacaacgctatccagtatttctcgtctctacttctatagaggttttagttagcattggggtaatccggcaaattgagcgatcttcgagtttctaaaagttgcctcttttatttgtcatctgatctttgcaggcaatgaaatttctgattatagttctttaatctggtttttagtagtactactagtctactagtgtatttaatgatttatgagtgaacctttttgtaatgtcgtatcgcaattttgtggctttgaaatgtcattttac

SEQ ID NO: 180 - DNA, 1380 bp, Amaranthus viridis
ggcagaagagagcgagcagaagaggacattgaagttgataagcctgcctgcctggggttttagcttaacccctcccttatctttcttcttccttttgccgacttatttctcctttcaccctgcaacccaacaaatttagtggtagattaaaatggctgcccaattggttcgtgaatggactggaattcagcaatttcctgctgcaactcaaactaagttgcttgaattattgggaaagttgaaacaagagaatgttgattctttgactatccttgtactggggaaaggcggtgttgggaaatcatcaactgtgaattccgtcattggtgaaagagtagttgcggtcagtgcttttcagtctgaggtatcaagacctgtgatggtttcacgtacaagagcgggatttactttgaacatcattgacacacccggtctcgttgaaggaggatatgtgaatgatcgtgctattgacatgataaaaggctttcttctggataagacaatcgatgtattgctatacgtggaccgattggattcctatagaatggatacactagacaagcaaatcatcaaagctattacagatagttttgggagagccatatgggatcgtgctgcaatagtccttactcatgcacagttctctccccctgatggattgagttacgaagacttcttcgaaaaaagatccgagtcttttctgaaagttgttcgctttggggccggaataaagaaacaggattctcttgcattctcaatgcctgttgttttggttgagaacagtggtcggtgcaataaaaatgatgatggcgaaaagattcttccaaatggagtttcatggataccaaatttggtcaagactatcattgatgttgtatcgaatggaagtaagggtatcttggttgacaagaagttgattgagggcccgaatccaaatgcgcgctttaagatgtggttacctttgattatgttagctcaatattttgttgtgatcaagccgattcaaggacaaatcaaaagagatatatccaaagaaaagaaggctccatgggaactccgagatctagttgcagccaaacgcagggtctaaaataggtggcctcacaacgctatccagtatttctcgtctctacttctatagaggttttagttagcattggggtaatccggcaaattgagcgatcttcgagtttctaaaagttgcctcttttatttgtcatctgatctttgcaggcaatgaaatttctgattatagttctttaatctggtttttagtagtactactagtctactagtgtatttaatgatttatgagtgaacctttttgtaatgtcgtatcgcaattttgtggctttgaaatgtcattttactcttcccatc

SEQ ID NO: 181 - DNA, 1464 bp, Ambrosia artemisiifolia
gtcccaactcaatttgacccattatctaacttgcctggccattttgccacctcttttagttgtcggcaagcattttgcatctctgcaaccgcaagttatttggcaaacgaaaacgttccaattccatataagtgttcaactatttaattgtatggttatgttatatcacaggagagggatagtttgacgattcttgtcatgggcaagtgtcgtgttgggaaatcttcaactgttaactccatttttggggaaacagtaattccaatccctgcattaaatgaggtatttatcagaactttatatttcaatttataagtttctggtttgatctatttatttgattttgcagtcagatgaaccacgacccgtgatggcttaccgtgtgcggtcagggttcacattgaacattattgacacacctagcattgttgaaggaagacatgtcaattatcaggccctgcaactcatcaaaaggtctggccactcatttgaattttgaacgtttggtattcggaaatgaactttcttttcgtcaagtttaagatacgcttttactttattagtattctatcacaaagcttagattacttagttgaatgttttattttcctacattgagcattgcctatgtccggaggacattttgacgattctttgtgattttgtggatgtttgagcaggtttagttcgaacagaacaatagacgttttgttatatgttgaccgattggattccattagagtggataatttggatagacaaattgtcaaggcaataaccaagagttttggcaaagaaatatggcgtaaaggagttgtagcattaacacatgctcaacttacgccaccagatggtcttacgtatgatgacttttatgcaagaagatcacaggctatccttaaagttgtacactccggtgctcagttcaagaaacatgaaattcaggtacaaaatctatatgcttacaaccgtcaattatagttgctttgtgattctcagtgttgtggttgcttcttgtaggatcatgcaattcctgttgtcttggttgagaacggcaacaagtgtaataaaaacgacaacgaagaaaaggttagtcatcctgttttactagagcaaattctttttactctgcttaaatttttaaacattcatgtaatgcatcagattctcccaaatggaactgtgtggattcccaacgtcgttaaaaccatcataaacgtcgccacaaatgaaagcaaaagcattttggttgaccaaaagccgattcatggtccgggtgaaaatatcttagcatgtttcagttttctgaaagccttatatagagacttggcacattggcaggttggaaggcgggtcaaaacgggttagggtcaagacaagtattttttcaatatgggtcgtgttgggttgacttgaaacaatattttagtcacaatctaattatcaatattcgatatgtatcag

SEQ ID NO: 182 - DNA, 944 bp, Ambrosia artemisiifolia; identical to SEQ ID NO: 129

SEQ ID NO: 183 - DNA, 355 bp, Ambrosia artemisiifolia
ataataatattagccaatttatatgtcaacttagaagttataaggtgtatttggaattaaatgttttaagttgtttgttatagtgagaaatatggagttgtatttggaatttatagtttaattggttctgtttgatgttatgtaatctatttggtgagaaatatgaatgtgtttgtttctaaagttttcatgagtattaatattaattgggttggattaaagtttgagttttgtttgttcaggttcgatggcccgtgaatggactgggattcagcagtttccgcttgcaacacagacaaagttgctggagttactgggaacattaaaggagaaggtcgaattcggttcctattta

SEQ ID NO: 184 - DNA, 1046 bp, Ambrosia artemisiifolia
atatttttgtttatttttctgaatttgtattttttttaatactttataagaaatctaatcagttagcagtcaaaagtgaaatttcaagttatgttactcaaggtcaaaacactcgggtggcggctttgactcgtttacttataaatgagttgcgttttgttatatcttctctctaatgggtcaaaatggttaaggtaaaagatccaaacaaaggaacggctaaaactagccaaacacggtaaaattaagtcaaagggtattcaaatgatgcttcaaaagtcatgcaaagtggctatactgaaaaaagttagttgatgattgttatagtaggttttctaatcatatttatcatgttaattatttgataaatcttaaagcaatggataaataggttttttatgggccgagccaacccattttgacctgtaaacttatgttatttgggataggaaacattgaaatcctgtacaactacaagtttaccactttaattgtatggttatgcgatataacaggagagggacagtttgacaattcttgtgatgggaaagggtggtgtcgggaaatcatcgactgtgaactccattctaggggaacgagcagttgcagtcagtgcatttcaggtatatattaaaacgtcatagttgtagtcttgtagattgatgtataagagagttacagttttataaattttttatttaatttattgttcacattttgaagtcagatttgccacgacccatgatggtttcccgtgagcggtcagggttcacattgaacatcattgacacacccggcattgttgaaagtggatacgtcaatgatcaggccttggaactcatcaaaaggtctgttattgtgttttgtacttgcaaacgtaaaataagtgtagcataatgtgttattagctaatggctatgtgtgtcagcctgtcggtatatatttggtaacgggtcaaaacgagaatcagcgattgtgttgaaacaggacaggtaaggttgacccacaaaacacttttttcttccattttcttacaaatagttaac

SEQ ID NO: 185 - DNA, 440 bp, Ambrosia artemisiifolia
ttttttatttttcttatggattttttttaatcttgtgttgcattagattctcccaaatggaactgtttggattcccaacatagtggaaatcatcacaaacgttgctacaaacgaaagcaaaagcatttttgttgaccaaaagctgattgatggtccgaatgcaaatgaaagggggaaagcattcattcctctcatcttagcattccaggtaagctactaaacctgttttagtttttctctaagtcttataatagacatggcacatgagctggttaggcaggttggtaacgggttgtggtttaaatgggtaaattttaacatgggctgggccgctgggttggggtctaaatgggtaaaaatttcagtatgtgctgctgggttggggtctaaatgtgtaaatttcggtatgtgccgcaggatgggttcacaatgagtaattt

SEQ ID NO: 186 - DNA, 1467 bp, Ambrosia trifida
ttacatacaattttgaactaataatcatcagattgttgctaacaacaaggtttgatggcccgtgaatggactgggattcagcagtttccgcttgcaacacagacaaagttgttggagttactgggaacatttaaggagaaggggagggatagtttgacaattcttgtaatggggaagggtggagttgggaaatcttccactgtgaactcaattcttggggaacgagcggctgcagtcagtgcatttcagtcagatgtaccacgacctgtgatggtctcccgtgagcggtcagggttcacattgaacatcattgacacacctggcattgttgaaggaggatatgtgaatgatcaggccgtgcaactcatcaaaaggtttcttttgaacaaaaccatagatgttttgttatatgttgaccggttggatttctatagagtggataatttggacagacaaattgtaaaggcaataaccgagagttttggcaaggaaatatggcgtaaaggagttgtagtgttaacacatgctcaacttacgccaccagattgtcttagttatgatgacgttttcgctagaagatcagaggctgtccttaaggttgtagactccgcggcgcggttaaagaaacatggacttcaggatcatataattcccgttgtcttggttgagaacagcagcaggtgtaaagaaaatgacaatggtgaaaagattctcccaaatggaactgtttggattcccaacatagttgaaaccatcacaaacattgctacaaacgaaagcaaaagcatttttgttgaccaaaagctgattgatggtccgaatgcaaatgaaagggggaaagcattcattcctctcatcttagcattccagtacttctttgttattaaacaacttcaaaaatggatcaaagttgatattgctaaagcacccaagtcttcttgggaatgagatcttcttgctgtggccgcttgttccttggttaaaccttgttcttatctttgagttaagagagttctttgtggcggttttagcttggaaaataatccgggtgtccatttagacgtttttttttgtcgattatctgttttgctggtgttaacatgttttgttctagtttatccgagtttgtcagggaagatggtacttggcaccacacactgcagttaagtagtttctgtggaggtctttacaaccaaaatagacaagtggtaaaatgttgagggactgaaacagtgcaattttataagttcacatagttttgcaagggtaaaaaaatgaacggtgttaaagactgaagttactgaaaccgtgtagtatctaaagattgaagttctttttaggatgaattacatggtttacgtgatggtttacgcatattacgattttgatacatattatagggactaaccgtgtaattaaatctttatgaggctatttatgtaaacatgataattttatcaaacataa

SEQ ID NO: 187 - DNA, 784 bp, Ambrosia trifida
tgttcttatctttgagttaagagagagttctttgtggcggttttagcttggaaaataatccgggtgtccatttagacgttttttttttgtcgattatctgttttgctggtgttaacatgttttgttctagtttatccgagtttgtcagggaagatggtacttggcaccacacactgcagttaagtagtttctgtggaggtctttacaaccaaaatagacaagtggtaaaatgttgagggactgaaacagtgcaattttataagttcacatagttttgcaagggtaaaaaatgaacggtgttaaaggactgaagttactgaaaccttgtaatatctaaagattgaagttctttttaggatgaattacatggtttacgtggtatgtccatattacgattttgatacatattatagggactaaccgtgtaattaaatctttatgaggctatttatgtaaacatgataatttttatcaaacataatcaaatatgtatgtttaaatggaataattgaaggattaataatatagaacaagaagaggtagagttaaagattgaaatgagtaattttcaaggctaaaacaagctgagtttgagcatagataaaagtagaggtgcacagaaaaactggttaacaaaactgctataccagtagtatatcccctgggtggggagggtactccaggctactagccttgtcctgaccaataatattaagtaatctcaaattcaacccaaagtggactagaatacccaaattattggtatggttactttttttttttt

SEQ ID NO: 188 - DNA, 417 bp, Ambrosia trifida
cgacaagctaccgatatgctatgggggttagtgcttctttttctggtagtagtactcttgtgtggtgtttgctctattttcttagctacattttatgttatatgcaattccataaatgtttacaacttgtttaattctatataacaggggagggatagtttgacaattcttgtaatggggaagggtggagttgggaaatcttccactgtgaactcaattcttggggaacgagcggctgcagtcagtgcatttcaggtatttactagaacttcatagttgcagaatgatgttcaagtgaatttcaatttataagcttttgatttgatatgtttatttaatattgtagtcagatgtaccacgacctgagatggtctcccgtgagcggtcagggttcacattgaacatcattgacacacc

SEQ ID NO: 189 - DNA, 287 bp, Ambrosia trifida
aataaagcgatttagatttttaaattgtttttagctgatttttagtatgattttattgcctagacaattactatttattctttctttaagctgctttttttaactatctgattgttgtacatcatctgcattttttttgcagtacttctttgttattaaacaacttcaaaaatggatcaaagttgatattgctaaagcacccaagtcttcttgggaatgagatcttcttgctgtggccgcttgttccttggttaaaccttgttcttatctttgagttaagagagttc

SEQ ID NO: 190 - DNA, 592 bp, Ambrosia trifida
ttctactaaatacaaacccttgggctctgcgagtcactgtggaccaccttctgtacccgctccaaaaagcgaaccgcctcaggggctagggttctaaattgtagttgggttgttttcatgagtattaatattaattgggttggattaaagtttgagttttgtttgttcaggttcgatggcccgtgaatggactgggattcagcagtttccgcttgcaacacagacaaagttgttggagttactgggaacatttaaggagaaggtcgatttcggttcctatttattctctttactctttgttatagtctgtcaatgtaatggtttatttgtaattttgtatatatgtgtgtgttttcccttttttttgtgttttttggtactttcatacgaaccctagttagtttggtactttcatacgaacagatttacctaaaaggtaaggattcgggtcaaatggtaaacgtatcgaaaatcatatgaaatgtacttaaatgcataaagctttcggtatgggtcgatcgaaatagttagattataattgtatatgtacttatagtatttcttagccttatccttagccttgccttagtgc

SEQ ID NO: 191 - DNA, 487 bp, Ambrosia trifida
tcccgtgagcggtcagggttcacattgaacatcattgacacacctggcattgttgaaggaggatatgtgaatgatcaggccgtgcaactcatcaaaaggtttgctattgactttctgtacttatagacaaatacttacgatgtgtgcgtgagtgtgtcatatgtggtttgaggtgttagaatgtacgggtcaggtggattggataagccgtaagcgtctaaacaggtcgtttttagtatgggctgaaacgtgccagattggattgacctgcaaacacatttgtccatctttgataatttaatagctgattaatgttaagttatgaggttgtatgtgttaaagttgactttgggcaactttcaacgtgttggacctgtttgaccactcgcttttaggtactctttattttacccatttttttttaagtaaagccgacctaatcatctaaatataccaatttataggactttatatatattacctatgt

SEQ ID NO: 192 - DNA, 639 bp, Ambrosia trifida
tctttatgttgatgaaagtttagtatttggaaataatctttcattttatcaaatttaagataagcttttactttattagtttttatcacaagcttggattataaattttaatgttctccttttctacatcgagcattgtttatgccaaccggatattttaatgacatgtgattttgagcaggtttcttttgaacaaaaccatagatgttttgttatatgttgaccggttggatttctatagagtggataatttggacagacaaattgtaaaggcaataaccgagagttttggcaaggaaatatggcgtaaaggagttgtagtgttaacacatgctcaacttacgccaccagattgtcttagttatgatgacgttttcgctagaagatcagaggctgtccttaaggttgtagactccgcggcgcggttaaagaaacatggacttcaggtacacatttctgtatgagtactgtcaaatttatcattcctgtgtattctattcgtatacttctgctgaaattgaaatgggatacaagttggtgatacttcattttcttcaattagattgatttttgaatttgctattaatagatgacatgtgattggttcggtttgggcaacctgtcaagtttttctttctt

SEQ ID NO: 193 - DNA, 866 bp, Chenopodium album
gcgagagaaagagcgaaacaacagggcattgaagttgataaggctggggttttagctaaagcccttatctttcctctttctctttgacgccttctttctcctttcgcccttcaacaccaatatactctgtgaaagattaagatggctggccaaatagttcgtgaatggagtggaattcagcagtttccgctcgcaactcaaactaagttgctcgaatatttgggaacattgaagcaagagaatgtggattcactaactatccttgttatgggaaaaggcggtgttgggaaatcgtctactgtaaactcggtcattggtgaacgagtagttgctgtcagtgcttttcagtctgaagcatcaaggcctgtgatgatatctcgttcaagagcaggatttacattgaacattgttgacacaccaggtctagttgaaggtggatatgtgaatgaccgtgctattgatatgattaaaagcttccttttggataaaaccatcgatgtattgctgtatgtggaccgcttagatgcctacagagtggatacattggacaggcaaattatcaaagctattaccgatagttttggaaaagaaatttggaaccgtgctgctattgtcctcactcatgctcagctttcacccccagatggcctgagttatgaagacttcttcagtaaaagatctgaggctcttctaaaagttgtccgccttggggggcgaataaagaagcaggaccttgcattctccatgcctgtaattttggttgagaacagtgggcgatgcaataaaaatgaaagtggtgaaaaggttcttcctaacggaatatcatggataccaaatttggtagaaaactatcatagatgttgttt

SEQ ID NO: 194 - DNA, 478 bp, Commelina diffusa
gggatcgtctctaaatcccttctttccaatccatcagcagggcacgaagtcgatggcagggcagttggcccgtgaatgggttgcaattcatcagtttcctgtgaagacgcaggagaaattgcttcaattgcttggaaagctcaacgaagagcatgtgagtacacttactatcttggtgatgggtaaaggtggtgtcgggaaatcgtccactgtgaactccttgttaggggaaagggtagtgagtgttagcgcatttcagtcggaaggattgagaccggttatgtgttcacgcactcgagcggggttcacattgaatgtaattgacaccccagggatcgtggaaggtggatatgtcaatgaacaggctcttgaaattataaagaggtttctcttgaacaaaactatagatgttcttctctatgtggaccgcttagatatatcgagtggataatttggataagcaagttgttaaagccat

SEQ ID NO: 195 - DNA, 1235 bp, Commelina diffusa
aaggaagaaaactactaacattagaattatgttaaaaggataatctgcaaacatagccacatttacagaaaacaaacactataatagggaagaaaaagaaaaactagcataactagtcaagacactgctttacaatccacatggaaaacaccaatccctactcttaaaacctaaatcctaatcacctaggccttcttggccttcttagtagcgggggacttgatagacttgggctgcttgggcttcttaggagtcaccttcttcaccttcttgggtgacttcacagccttcttcggcgacttgaccaacgaagcaacagcagcactcttcttcttcttcttggtaggagcagcagaagcaggggccttcctcttgccagcaacggccttcttctccttaggcttcttctccgtcttcttggctgctgttttcttctccttcacgaccttgggcttcgccgcagcagcagcgccatccttcttcccggcctcggacaacttgaaggacgccttgaccttcacaagcttccccctcagcgcagaattcttgagttgggtggctaggatcttcttgaagttggccgggaggacgcccttgtggctctcctcgatgtacttggctatggcgtgcgggctcgatccagtcctctccttaagggcaacaatcgcctccttaatcatctgaaaataggggggatgggcgggggatacggccttggccgaagaactcttggccttcttctgctttggcactttagcggcctttgccggcgctgctacgacttctgtcatcttgatatttttgggaactgaaaacttatcgaagttgcgagtgtcagcgcttttcagtctgagggattgaggcccatgatgttttcccgcactcgggctggattcactttgaatgttattgacacaccggggcttgtggagggtggatatgttaatgagcaggctctcgagctcataaagaggtttctcttgaacaaaactatagatgttcttctctatgtggaccgattagatacatatcgagttgatagtttggataagcaagttgttaaagccattacagaaagtttcggcacagggatatggcggagatctttggttgttttgacccatgcccaactgtctcccccagatggaatcaactatgatgaatttgttgcaaaaaggtcagaagtagttctgaaatttgttcgcctgggttctagaatcaagaagcaggacttt

SEQ ID NO: 196 - DNA, 376 bp, Commelina diffusa
tgcttggatacctaagttgatggaagaaatcacagttattataggtaatgggagcaaagctattaaagtagaccagaaacttattgacgggcctaatccaaataacaggggaaagatgtttatacctcttatgttggctgttcagtattttgtggtgaaagtaattcagggagctatcaagcaagatattgcgaatgaaagcaaacccctctgggagcttcgggccatggggtcagaggataaaaaattttaagtttctgaacttgaaatgcgtagcaatcttgtctggagctgagttgggctaaaaatgattgaatttttcgtagataagatcatgccacaatattattttcctcttctttttgcattttgtatg

SEQ ID NO: 197 - DNA, 1221 bp, Conyza canadensis
gggtttcttcaacagtctttctttacttaacatttttagggtttttctttccattatcacattgccattttacatacaatttcctctccaaaaacttcatattatcactaaacataaggttcgatggcccgagaatggactgggattcagaattttcctcttgctacacagaccaagttgcttaaactactgactacactaaaggagaaggagagggacagtgtcacaattcttgtaatgggaaagggtggtgttgggaaatcatcgacgataaactccattctcggggaacgagcagttgcggtcagtgctttccagtcagatgtcccaagacctgtcatggtttcccgtgaacgctcagggttcacgttaaacatcattgacacacccggcattgttgaaggaggatatgtcaatgatcaagccttggaactcatcaaaaggtttcttttgaacaaaacaatagatgttctgttatatgtggaccgtctagattcctacagagtggataacttggataagcagattattaaagcaataacagatagttttggtaaagaaatttggcataaaggcattatggtgctcacacatgctcaactcacaccaccagattgtctcggctatgatgagttttttggaaagcgatctgaggctctccttaaacttttggactctgggtctctgttcaggaaacgtgaagttctggggcatcaagttcccgtggccttggtcgagaacagcagcagatgtaataagaatgacaatgaagaaaagattcttccaaatggtactgcttggattcccaagatagttgaagttatcacagaagttgcaaccaatggaagtaatagcattgtggttgaccaaaagttaattgatggtccgaatgcaaatgaaagaggaaaagtattcattcctctcatcttgactgcccaatacatctttgtcggtctagttaagaaatggatcaaggatgatatcgctaaagcacccaagtcttcttgggaatgagatcttgttgcgctgtagtcatctaaggataaatcttgtttgagttggtgagttagagacagttgttttctggcaggtggttttcaatcttttgtaacttaatatgatgctatattaaatgtttttgtcaattaatgatatgtgaggttgcattttgtcaaaaaaaaaagaaaaaaaaacaaaacatgtcggccgcctcggtctcta

SEQ ID NO: 198 - DNA, 23271 bp, Conyza canadensis
  unsure (1)..(23271): unsure at all n locations
  unsure (1)..(23271): unsure at all n locations
tactcggtttttatccatggagtaacctcataggacataaccatgttaacttacgatgttcttgtccgtgtaataacccgatcacacctatcagacataaccacattatgttatgatcttttactgtttcatttatatatatgttgcgcaacataaacaagccaacattgtcacatttatgatactatagtgttttccattcttggacttaagattcatcctatagtgtttactcaaacctttacaccacctatcaagttgagtgagtttgtggtgattgacttgtaagataagcaatattaaagtgaaggtgctaatatagctttacttgttggggtaaaaaagtgggcatgttacattctttttagtgatgcaacaaacatgatttaacaaagtgtttggctttaaaaaatgatggtggccaatggtggtgacggttgtggtggtactccaccggccgacacatcttttttactagaccctattcggtattcctatactatttccattgtcacaactcacaacaactccacaacttatttaattaacttattaatatttttcttttccttttaaccatgtcttatcaagtatataagtaacactagcaacaaatgtcattggttcaagtgtaaaatgtatacataaaatgaaaacggatattatgaacaaggagaaggttacctacgatttgtagaaaaaataacgtaaatgcccaaaaatcatagaaaacatacaataaaacctatttttccccctacaaaatatcaatcaaaatcgcaagttttgcgattctgaaaatagtaaaccaagacctgcattcggaaaagagcaaaccatgcttgcagcactgaaaatcgcaaaccattgcttgcatttttgtaatattgcgaatcatggctttcatgagtctaaaatttaaacaaattggcatcccattgccccgttggtgattggtaaagcttttatgaccttgaggtattccacttgattacatcctaggaattcgtgtagtttaaaaataggagttggataaattgagtttttaaaaaaaatatggaaaatgataaattcttctaaaaaacagcctaaaaatcctactaaaattatcagaaggtgacacgtgttatccattaagtctctttgctaatcttgccccctgtttttttccaaattttatcatctcatgattaggaggattaattatttccatatatatatatattaattagagatttaaaatagtttaaacaatcttgttttgagtctacaataaattttaatcatgcacaacaaacatataaatttacaactccaggtaaataatccaatgataaaaaaaaatcttttaaatgaaggcttgaatttagaaaaacttacaaataatttaagtcataaggcataaagtttatatctattcttttagacaaattaattaaaaaaatttctcctactagatattggatgaaaaggtatattatgaatcagattaaaaaacatagtataaatctcgttttccctattattttagcaaaggaccaaaatgtagaccaatcaacttttattcaaatccaaagtttcaaaaaatgcaaactatttatttaataaatttgattgatcccctccccaccttaccttttcttttttaattattcattcaaaaagatacaccacgcgccataaaacacactacacaacaaacagctctctatctctgtctcctttctatacttccctgcttcactttcaaacgcgccaccgcacgtcgccgccgtacaccggacaaaacaacacacattttattacaactctcaggtatcaactttcacgatatgtttgtatctatacatatattgtatttctttcaatgagattcaattttcatttatacatgtcagtgaaaaacagtttaattggctcatgcataatgttgtaagtttatatgaagaatttttattaaaaaaatgttggatattattactaaaacattattgccaattttctgtgaattaagctgaaattgtttttatttttagggctatagtgtagctggatctagtttgtaactgtagatgaagttatatgtattgattatgatcatgttttgattttttcgaggtcggtcgctttttcgattattatctttctggagaatacttggaaatttgtagtgcttttacttttgtatgttttgtacaactatttgaatttgaattttggctcttcattaaaacagattcatattttaaataattttttttttatgagcattgggatgtaacttagggtttttcggtttgttgtatcagattgattgatgatgaagttgaagggaagaacaatagatcccaatgcgccactcgattacgttaaactacaaatttttccaagcaagaacaggttggtttttttccttttctttaaaaacttattgatgaattttttgttacaaattcatttgcattttttttttttatgtttagctcattgatttgcatacgtatggcatgactatgtaataatatattgcgaagtgtatgtaaatcgaacttgtaaaatgttctttcaatgtaatgaatatccaaattgttaacatatgatgtacaaatgtgatcctcattttgatatacaaatatcagttattacttagaaaaatcatcaaagttatttaccgcttttacttttttgtagtacgttggcatatcgatactatttttcttttgtttttaactaactagtattaattaataataagaaactaaagaaaatcaaaagaaatacaaagtaactagtgatatttatgttcttgacatgaaatgaacgttttgaaggttcgttatatacatataccaattcagccaaagttcaatacactcacatggcattagcccatagtccccacatgaccgtattagaaggccgagtttgtatcacattgttttcgagagaagttataagaagcattagaaatgcatattgtgcattaactctcatgatttgacagattcaattttggtttgtttggctaagtttttgaagtattacataatataataaaaaggcacttatattagttattaagtattaacaagaatctattatatgggtttactcatatgttcacttgtttctttgtttgttgtaagataattatattgaaatttgagctgtctagccggtttttcgtttagcagtagggttatgtacataactatctcctcgtataacattttttaggtatgagacatttgtgtgtagtcgcaataagactgagaaagtagcatctgggacgttgaaacagctattgttgcattcacctcgtgtaaaagatttgtcctcgaaagggttaaatataaatttcaaaattttaccgcctggcaatgtcaaggatgctgggtggtttacagtggcaacattgacaaggtatcatggtgtattttcaaccaattaaaaagcttttgttttcgatttgcttactttaataatctataacttgtcagatttctacgcattattggttcgccagacatttttagtattggaaatgaaattgctcaactagaggagaccagaaaattccaaatttcattgtctatgaacgctggaattgatattacatcatcggttgactccaagtatgtgtttagtgttccttgctatctatgatttactcactgtattccatgcaatttcttaatcattatattttgtcttttgataggaatgaactactaagagcagttgatttaaggctcacagcattgaaagacgaattagtttctgcctttgacaaggttactggtcaaatctgttcaactaaggacatcttggatttggaaaatttcgctcatcatgttggagccaaagatataaggtacctataaccttcacatgagtaaattctccttgtgttttgctttcctgtttacttatgttagaaatcaattagtcaagtatctgagctcctggtttagtaattgcaggtaggaaccaatacatttaggtagacagtggactgttaataatgctctttaggaatatgtttgttgcttttctcttcctgtacctctcatataaaattcctaaagatggcacttttgacccgttttcttttgaatgggtgaatttgggttatggtttatgtttatccgaaatggctcaaattgaatattgtgagtatagagccaacgggctaaaagtttcccaatttgtatttgttatgcatacaatctattgaattgttttattctgaagtttagatccttatcataacagtacggtttctataatcatgttgaagttgaacacataaattagttatgaaaattccaacaaaaagacaaaaaaaaggtggttgccgagctatcctgacccattccaacaaacagtagaatacatgatttgatttgttgccctaccttcctgacccgccatcatgccgtttctaatactgtaattcataatgagaggattatcacattaacacttgttattaccatactttttccagggattcatttcagaaatttgtagaaatggcccttttccccacagttcaagacttgaggaatgatgctttcaataagactgaaagaaatgcccctgctcctcacctttcgctgtcagacccatccataacgtattgcgtctctccaacgcaagctgctcaactagaacaaagttcaactgacaatcattcttgtatttcaagtgaggaggaccaaccatctattgagagaagtcgtactcgtatcagatctgcaacaccaagacgatcagcatctcctatgaggcgaatacaaattgggcgatcaggatcacacagggcaactgcactaactattaagagcctcaactattttcctgctagggaaaaggtattgtttccgagagatctagatggcaacagtagtgatgaggaagaggaggacccagaaaaacctgcaaagaaaaatgtactaaggatgagtgtacgagataaaatcagtctatttgaaagcaaacagagagaccaaacggtagacgttttgaagacaaagaaattgttaaatggaattgctggttcgaaaaaagctgtactgagaagatggagttcaggaatgggtgacaatgttacccaaaatcccaacactactaccgagacttcgcctatcattcccaaaaatgaaccagcagaagcagagtctgatatatttatttatgaaagtcaagtttcggctgagttagagaatattaaaccagactcacctgaaacagaaacagctgaagaaaactgtgaaaagcatccttcatccattgaatggaatcaacagaaggaatcagaactggatgatttattcatacaaatgatggaaaacaaaaataagccagttcgacatcgaaatcccaccagtgatattaccaaaagtaagatatctttggtgccaagagaggaaagagctgaaattgttgatgattataaacaaatggggggtgaaaagcgaagagggaaagcaccccaacttaaagtaactcaccaaatctttaatgagaaaaaatttgagataaattccaataatgtcaataaactccagaaagagaaggttcgcaaaaactcaaccccgttaatgagttccagaaaggaagcctcaaagccttctcttatgaagaagattccatcttctttgtctgctacacgcaagtcatgcccatcaacaccctcaccaagacccacaggtgcatcacctactagaaccacaccaccaagcaaaaaccctcagtctgcatcatcaactgatctgttaaccacaaaaagtgagataactcaatcacgattcaagactacaaagtcaacaccaccagataccaatagaaaacttaaaactgataatgagaagaaacaggcaacagtgacaaaagccaagaagccaactaaacctaatctccagattcctgaagctaaactgagattatataacgaagttaccaaaaaaagtggtgtggttgcattagaaactaagccgtttcttcgaaagggctctgggatcaggtctggtgccagtccgggtattaacaagacaaaagttgtggatcagcctgaggaaacatctaggagcgctggaactctaattcaagctgaggagaatgaggtagccatgactactgaaatagaagtaaatcagaaggaatgtgaacctcaggtggttagccccaccaaatgcgaagaatcaatgagtcctaatcaatctagtgttacagttgaggacgtgcttaaaaaggtaccatcaccagacattaaaaatgatgatgaagtagaattgatgatttctccaaatgcatgggttgaagtagaagatgatcatcaagaagagatcattccgtgcatggaatgtgaaagcccagtgaaaattgtgtctccagtgaaagttgttgagccgtgtggaccttcaagtccacaggtacgtcactctttatctcaaatgctttctgtggagagcagtgaagaagctagtattggtgagtggggaaatgccgagcacccacctgctttggtctaccaaaaagactcaccaaaagggttcaaacggctcttgaaatttgctcgaaaaactaaacctaagtcccatacggctagttggtctagcccgtcagcactttctgaaggagatgatgaatctgaagagtctaaaggtaataagatccttgctgattactgatggtaaatgtgctggtctggcagtttcaaaagcataatcctttttaaagggttgaaacagtccgtagacactcattgttcaaaccatcagattagaaaaatgttttaaaaacacactgtaggtgacgattgacctgttttcttcgaagttatgtttctcacttctactcattagacatacaagatcatccaattaaatcgaaccatttatttgtgaactgaccaaaactgccacctctagtgctgatcatttttttgaagttcctgctactacaatatgtcgaatctctgaaaagaaacaaacttctttatctgtgtaacttgtatgatcaatgcaggtcaatcaaatgttggcagatttacatcccacaatcacccaaaggtatcggaaggccttgtctctgcatccatgagtacaacaaaaggtagagtttctgtgaaatgtttgcaagctaatattttattctcaaagaaaatgcaactactaataatattttatacaaattgactcacccatctaaaacccacaagaggcttcacaattgttattcattatgcaagataccttagattagttttaacgaacagtccaccaccaaggtgacctagtgataaggcgtcctcgtgtcctcacaagaggtctcagattcaaagatcactaagtaaacagcttggggaggctaggaaaaggttcgaaaaaggtcacgaggatatccaggttaggctggtgtaaacctgagtcaacaactcgcctttcttgggtaacctgaacagggaaaacctcaattttttacccattcacctcaaataagttttatttatactttatttgtatgcattcctagtttccatcacctcattgtttttgcctttttggataccctttaaatttcattgttttatgctatttttctttttcagcaacaaaatcattcttctccattccagtatttaggggaagcaagctcccttaacaccaaagagccttaatgatcataaaggaccgagctgtaaaatatacacatgacctgctgcgatactttgggtgaaatttagctaataggccagttcagattgttattccttccatttgtattggaacaacttctcttcgatgttataagttacatgtaaattgtgctcatatatgctacaagtaagaatccttacttgaatgtgtacattagagagttagtcgactgaatgaggatggattacgagcctagcctgcattttgtatactacatacagttcttgactcattttttgtatgattgctattgtattattgttttaagccatgaaaacagtcgttcagtaggaatcgatgacataggtgtatatttcattgtttggcataaaccataataccatatgacatgtatgtatgttaacttcttgtaatcacatcacttgtgttctttgttattaattaaggtgggatgaatttgatttcttctgcagagggacaaagtttgaataatcatttttgtagcaagtttatttcaaaatgcgattgaaaattcaagattttcttaagctttcaattggcaccatggatgtcttctttttatttattttattttacttttttattttctaatattgcatcctgattcctgaggtacaatgttctaaatacagtatattcatgaaatgtatcatgtttgtctttttcttgtatattatataatgatgatatgatatatctgacgaacttctataaatacttttaactcgcttggagtgcatcgcaactcacaagtccacattcaaagttccatcatgcactcataagaaggctcaaaatcatccacaaaatcaacgtaactttttaaagctcttcttgcattcgaacatttttctaactaaactcaaatcgttgcgaaacgtctaaagagaaaagtactagtagtatataaactttaagaatgcaacaaccacaacagcaaacctttggcaagttatctatttaaacttaaatatttatttatttcatattacaagttatttaatcggtacaactcgcgcttcaattcaagctttgtggaattatggtcatgttcttcccgagatataacttctcgagtgccttccacaagctagtcgcggttgtctccccactgacattgttaatgatcttgtcactgatgcaaaagcaaatggtactaccacattattcctcgatgtcattccaatcatcatccgtcatcttttatgacttgccattctccttacccttcagtggctttaccaagccttgttgaacgagcatatccttcactcttggttgccatagagtaaaatttccggttccatagaaaggttctaccttaaaatgtgtacaattatttcctgccatttagatacaaaaatatccttaaacctaggtgctctgaaacctgttgtgacaaaaggtcacactttcacccacacgagtggaagtagggatatgatgtatcgagataaacttgcaagatataatatgagaaaaaataaagtaacaattagacaatgatttatgttgttcggttcaatcctcttcctacgtccaccccaagagtcttctttattattcaaagtgataaataaacaccgtacaagaaaaaagtattactatgagtttacctaaacataagcccctttaattttgagttaaaatctaataatccagtacacatttttttattttccaccttacaaaaataaaactcctaatatctcacaaaagaaattcaattagttttctctcggacccccaatttgctttgtaagtttccctatggttcgaatcatacatgatactactttgcatgtatacacaaagcttcatgtgaaagtctatttccgacaaacttgttgcctcatttcttgactttcttggcatttaatattgataaaaaataatccaagttgtattttttttcccgttgtttattcacatacattaaaaacatgtctacatgtaacatagtaaatgtaagtcatcaaaatttgactacaaatctacaacatttaatcatttataacctgtaatttatacgtaaaagcataaatccaataaatcaatttggtctaaatccaaccaaaaattcagaaatccaacttcggtttattttattttcgagattttttaagcttgaatcttgaatcttgaacacgatgtcacctaacaaagtaacaagttcaaaaactaaagtttcaaatgtgtatctaatagaaaggtaaaggaccatttatacaaaatatatatatatatctctcttacaaattgcaaaaaccctgttgttgataagctcgtctggtgggtttcttcaacagtctttctttacttaacatttttagggtttttctttccattatcacattgccattttacatacaatttcctctccaaaaacttcatattatcactaaacataaggtaatttccaacacccatctttttcttttattaaattttcttactttttttaatctttattttaaaattgatgtttatataaattatgtgcaaagtttcaattctaatcatttctataaaaaggtttaagcttgtggttaatgatgtattggggtttgtttgataggaatatatattgatttatatgtttgttatgttatgtgaaatgtgaaatagtgataaatttgtgtttgtgaattatggttttgattgtatggttttttcggggttttcactaggttcgatggcccgagaatggactgggattcagaattttcctcttgctacacagaccaagttgcttaaactactgactacactaaaggagaaggttgaactctttcaccaaatgttgtatctactttttgttattagttttagttaataggaaggctgtaatattattttaagccatcgtatttgtctcgttttagtaaaatgctaacgaaatgcgtcattttgtttttgaaatgagtgggttcaattttgtatgcttatccaatgtatgttgcttttcggtgttcttatgagaacggtggttagtttgcagtgaaatgtaaaaaacaaagtagtgttgtttcaaagagttgaacacgcaaccttttttcagtttcaaagtgcattttggacgtttaagtatcattaaaatattttgtacattgtgtggtaaatgaaatgttgcagtttttttttttgtaagtttatcattttttaaattctatggttatgcaatatcacaggagagggacagtgtcacaattcttgtaatgggaaagggtggtgttgggaaatcatcgacgataaactccattctcggggaacgagcagttgcggtcagtgctttccaggtaacttctataacctcttagctctaggatgatgcttaattgggtttttactctatatgtccaagcttctgacccatttacatacaaatctgttgatttgggttatgttttatctcttaggagtcataaaaagtagctagaaagaaattgggtctagatttgcccaaagtggcagcttgaacttttaatgcataaatattcaatcatttcattcaaaaaattggatcatcactgaaaacattatttttgtaatcatatatggctctttaattgtttgttaaaaaaatagttaagaaatggtgatttggctagacccaacttgacttttttttttacctgcatataaattgagcattttgacctattgcacatttgtttatacgttcttttgagttcttttatttttgcagtcagatgtcccaagacctgtcatggtttcccgtgaacgctcagggttcacgttaaacatcattgacacacccggcattgttgaaggaggatatgtcaatgatcaagccttggaactcatcaaaaggtctataccgagtcttaatactaatactttcagaaatacaatagcatatcacgttactggcaatgtttgtgtgtgtgtgtgtgtgtgcatgtgtgccaatatatggttccagattccagagagaggtggaattctttttggaaactttcatgtgggtgggagggtagaacttagaagtagatggcggagggacaaaatgagaggtgcaaattgttttttttttctaggtttacgttgtgtgtctgaaacaggatgggagggttaagttgatcatacaattcatgtcgagaagttcataaattttcgaataaatatttaatgtgtcaaatgcaattgcaaaaatcaaagtaatgatctagttatctgcattaagttatttaggatgttttgtgaatctgaaagacattttgggtgacgttattagttttatgtgtttgacttgtttcatgcaagtgtgtctttagcttgacttacacgttacacctactgaccttccaagataaaataaacccaaattgacctgtttctacttaaaatgattgaagtagccacctctgttctaagttagtgtgtttttgggagaagaatgttactttcttaacatcataagcctttcagaaatcccctatatttgtaatctagcttaatatcgatgccacatcttcaatttattagaatgtcacaactcatgtgatacatgggacgttaccctttttgaaatttgtagctcaaaggaacctcattgggcattcgatgtgttggtccttaatacatttccagtttcatcgtcaagggtaattcataaggttggaaagtgggttattgggaagatggttcaagaacacttaattttagtgagaattggagtgggatggtcttggccgattcacaaacaaataagttttccagttttataagtcttttattagtaaagtgatttatgatggtttaagcacctgaatatattttggatggcttcaaccccccgtttttaaattttttagtttaatattttagcttaatctgtttgacttgttagagatgaaccatcagctgccacctgtagtatttcagatacattggcgaaaacaattccaataatttacggatgcaaaaaaatgttgcattcaattttaaaatgaaactaccccacttttgacgaatcctttatttatttatttatgttggagtatgtagttttgtagaaaaccgtcgtttaatgggatctgagactagtttttagtttattagttctgtatctcattttgtggttaaatttattaagtgtagacctgtagtagcaatatgtatgttaacttgttaagttttgtttatgttaacagggtcttttaaagatttgtaattttgtgactatttgaacaggtttcttttgaacaaaacaatagatgttctgttatatgtggaccgtctagattcctacagagtggataacttggataagcagattattaaagcaataacagatagttttggtaaagaaatttggcataaaggcattatggtgctcacacatgctcaactcacaccaccagattgtctcggctatgatgagttttttggaaagcgatctgaggctctccttaaacttttggactctgggtctctgttcaggaaacgtgaagttctggtattatcctttatactaagcttgcatcatttgttcttctgtgtgtatgttataggtggaaacagattgatcaaaacaggttcaggttgaaatgggtaatttctttaggacaattagaagagagctaatcattagaagtcctttaaggtgattgttatgattacaaagcattgctataatccaaattattgaagaaaatgatctatgcggttttatgcatcaagatgggctttgggtgattttgacttgtttgaactttcttccgtttaactaatttgacccatatgagatgacacatagcccaaattgatctattcattaaccaatgggttgaaattgtcatctgttcttgtagactagttccaaattattggctttactgtagatacctatgctactatataaagcttttgcctaagttttttaagatttcaattgttttttttagaaaagcaagggccggatcacaggtatccggactggataccgtggacctacccgattccctccccccgcccgccccacccggtaaaagctccacgaaagccaggacaaaattctggcgggtaatcacaggccgagagtatcgaacctgtgacctcttggacaaaagtccgggtgtccaaccactgaggtaatcagtgaaggactttaagatttcaattttaaccacactgaaattaccattatgccacttgacttgacaattatcaatatggtaagttcaataatatgtattagtgactacaagcagttggcgaagccgggtaccatcacccttagccacgtctgtcgctgaattttttgattctttttgatcaagaaactatccccctctacccatagcatgggtgcaattctagttaactattaaatttcttctgcatgtggggcttatagtggggttgggattttcttttagctttcttttttgtttttttattttggaagtataaacaaccatctggttaaaagtcttctggttatgaaattgttaacttaagacaacaaaagtgaaagtttttatattagtatgtgtacgtccacggaacgctagaaacttgatattcatgtatttattatgctgttgctgcttcttgcaggggcatcaagttcccgtggccttggtcgagaacagcagcagatgtaataagaatgacaatgaagaaaaggtaggtagtcataaaaattatgttatgctcgagcttatccaaatttatctgatttttttttcttctgcattagattcttccaaatggtactgcttggattcccaagatagttgaagttatcacagaagttgcaaccaatggaagtaatagcattgtggttgaccaaaagttaattgatggtccgaatgcaaatgaaagaggaaaagtattcattcctctcatcttgactgcccaagtaagctatcaagcttcctttcatttggttgaatgtttttcacactcattcctcatttgatttctgtacatattctctgcatgggtggtaaaaggggtagtaaaggttgagtaacgaaatgggctgggcggatcagcacctttttttctttgagtttatatgattacatgaactactgtattatttattaattacaatatgatttaacaaagagatatagggggtcttattcttttgaatacatttcgggtaacttatgaactttttgatctgatcagcccatctgacccattttgatttattttagtctttttgtttactaatttaagctgttaacagtatcccagcgttggtttacttccctaatcttatgcattcttttacagtacatctttgtcggtctagttaagaaatggatcaaggatgatatcgctaaagcacccaagtcttcttgggaatgagatcttgttgcgctgtagtcatctaaggataaatcttgtttgagttggtgagttagagacagttgttttctggcaggtggttttcaatcttttgtaacttaatatgatgctatattaaatgtttttgtcaattaatgatatgtgaggttgcattttgtcaaacttcaaagttgttcattatgtcttataccggaaaggcggaaacggatttgtgttgatgaattaaaaagcaaggcccgtttgaatcggtctgcttgctgtttataactgatgagttattaaaacagataatgaagcaatcacaggcttcagttttactacaaacttcttggtatcaaaacagaaaacacccagtttccttgggtatagaaatagaactagcataagaatcttaattggaaggaatggtgtgactttattattgtataatttgggtcaatctgtatatgtagtcgcttgcagctgcaaggacttgtgtgaatataatttgcatttcaccgaaagaaatcaaatccaaatacaggctttatgctatcaaaagactcacacgagactcggaaaaaaaagtcggcatgtgaagttgatgcgtatgactttacaagtctgggtgtaaaatatatgaacatgaaacatttttgtttgtaacagaaccagggtgaacgtggtagatgagaccaagaataaattaaggatcaggtttaagattatagaatcatatcatgccgtcttttccagttaatagcatctctaatactcgtatctatttctaattttctaggcattacaaacatcttttaacccaagttactaaagatgcaattacataacttgacaactctaatatatctatttctaagcaaaattgatcatcattcatcatcatctataaaatcttcaccatcctctgcttcactttcaaaatacatatccgtatcatcaggttctattgtgtccaggtcatcgaccgcatcaatttctgccatctctttttccctctctgctactagaaccttggctgcttcaagcctggaactaaccgtttcccatgatacaagcttattgaggaaagtcgatatataatcagtcctacggttctgtagcaaaaacaaagaatcaaatataattagcagtcacataaaataccgcagatgcatttggtgcacttttgcagtttgaaattgcaataatgatactagttgtcaaaagtgtttggcaaaagctgtgattctgcactagacagttttttttacatattattgaagtaatcaaaatcaaaaatgaaatattttagttagctctgacttattttaacttttgctaataattttatttatgtatttttcagtagtatcatttgcaaagaaaagtaaataatcagttttgctgaagcatatagaaactgataatttccacttttccaggtaccaattaatcataataaagatcataataacatgtcaaactggttattataaaatcaagctgaaatatttagaaaaccaacttttataacccaaaaccaaacaccgcctatataatgcatgggctaatggggcaaacaagttcttacctcaaagtcgaggtagtatgcatgctgcaattaagattcaaagtgaaattagtaaatacatcatgaacaaagtttatgtatgatggaaaatgaaagtgaataagatttacctcccagacatctaaagtgaggagtggctgcatgattgaagaaaaagaaaccagttataggttaatagaaagcaaatgatacataaagagcttatataaggaactaagaatgggttttggtatcatggaatggaaatgaaagtgttcggggatgtttgtttgaaagtaatgggtttaaggaaacccacaaaccataggtaataaaggacacccacaaaccatatacaacataaacagataaccaaaatacctactacataatgcattacttattcactttcattttccatgatacataggtaataaaggacacccacaaaccataggtaatgcaggacacctacaaaccaaaatcaagtcatattttaagactttcagattccaattccttcaaattccaattttcatttaacaaattccaattccttcaaaaacattctgtgaaccaaactgcccctaaagtaataaggttatgttgcatatattcatacaaaaaacaaagggttaagtgacccggaatgtaattaactaatactgaaaagttatagtgtgcacaaattcaagtcgacctttattgtatgcacgaactttgtaaaaatgttcaaatcatgtaactttttgtgaccgaccaatcaaaacttgcacgtggcagcttatatgggttgccacgtatgtcatgttacataattcaatcatttttactaagttcgtgcatacaataaaggtcgacttgaactcgtgcacactataacttttcagtattagttacttacattttggcgcacttaacccaaaaacaaatattattgcactttcctttccaaaaggatgttgttactcacatgatactcccacacaagaggattaattgcatttgggctcttcacaacaacaagcttcttgtcctcctctgacggccgtggattcctagcatttggtatgtcgagtttatgctctttatctacaaagaaacacataaataaagacatcaataaacagctcaaccttatttcgactttgaacttgttaagtaaaacaagcacttacatgcaagccatgcccacccagaaccgaactgagtagtggcagctaacttaaactcgttgattaagccttcaaatgagccaaaatctctgttaatcaattctaatagttcaccagaaggctttccaccaccaccgggtttcatagactcccaaaaaaactcatggttccaaacctgtgctgcattgttaaaagtcggaagaatatctcctttgttgtatgaagccgatattattttttctaatgtcattccatctaattcggtcccctcaatttgctggtttaggtttttgacgtaattcctctggtgctttccccaatgatactccaatgtctctttgctcatatgtggttctagagcatgctaccacacgtgacagaaaacataatatttattacagaattatatagaaatgtcacctatcatagtttccagttatataactatgagcatacataaatttactcgtaccagttcataaggaggaggcttcagaacaatgctggcggatatagtcccgtgaccagatctcctagcacaccatctctgtaccataaaaatagcttcttcgatcaacaaaaatgaagataactattagcaacagaaaattcacagcacatggacagcaagattattggctccaaatcattggacatttcgagaatcaatctctcaaaatcaccaattaatgtggttgtttgtaaattgtaatcgtttctatatttatattgtaacccatgtatatttatacccgattgaaatgaaagggcagacaactttgaacccaatcttttcataacaccgcacttacagcacaataacatctttacgtaaagttgtttatatcattaaccttcatttagaaaatcggatacactcaagagtcataattcgaagctacgtaagtatgttcgaaactacgtaaacatgtttgaaacattctctaacagatgttcatgttctttatctcaagtcatacagtcattaccgataactcacttatcaatttctgatcaactggaaagtaaccattaacatcaaaacatggacataatcttgtaaacatgactatatgaccaagaaaattacttcttttcacggaacctgcttcttctagcacagacggaccttactagctaaaactggctaccattttctcacaccaaaaaaaaaaaggattgaaaaatcgaatcaggcatttcgtcgaacactatgtctacatcccggaaactcttgtataaagcaacaaactttattcatgttatatcatctaagacagtaagaattgtaaggaacaattgaggagatacaactgacctgcctttgtgaagatcttaagcttctatttaatccacaaaattctgcaatttattgaaatttcagtattaataagcagtaaaattcagtagcatatgatatagatatagatatagataaagatacagatattaatgtagatgcagatatattgatacagatagagatatagatatagataaggtggtgggtgatataaacctggagtggaaagaaaaggggaggttgtgacagaagccattaacatatcactgcagcagagcttgtaataaaagatgaagataattttggccttttgggttgggttggggtttgggagggtttttgggtttcaaacactatggtggagttttgggcaaattctattagtagtagtttatttagttagttttgttgtagtaggtaaaatataacacaaacaagcaggaggtcttcaaggcttgagaaatacataggtattttgatgaagacttggattgggtatactcaggttcaagtctgaggaggcagggtttacccttattgatcgtcgtacctttggacggattagtagggggttttcnnnnnnnnnnnnnnnnnnnntaggcatttctacttcgaggaagctctctaacgcaaacccggttaagacaacgtatgntagacctcccgctgtcgaatcatgacacgaagttctcaagcgaaattcattttaaaaaaaaaagaaaaaaaaaaagttcatgaagtttttttctaaaagtatggaagatagctttttaacattaactttaaacaaaaacaattaactaatctggatgctaccacttccactatattttgataaagttaaggttaacaataaatgcatatttgttaaaaaaaacaatagacttaagattagaaaaagcacatttgtttttaaaaaaaaaaccaataagctaaccaaatagggtcgtatgtgctaaatctagtcttaggtaatgtttggtatgcctgaattggacatgcaatggaaaagaggattgctttcggttcgaaaagtgtatttagttaggacatgaaaaaagaaaagtccattactagtctttcataaccgtgtttctcacaaggtcatgatttttgtctcattcaccacatccaacaatgacaatttaaacacaatgttatctttattatttactagctaattatcccgggtttaacccaatattcttaaacaagtttcgtaaatacatgnntattatcataatgaaacataaaaaaaatatatcgtaagtaaaaatgtctatattttagaggcaagtaaacaatattattatacattaggcttatattacattagccttgaaagatttaaaaactttcaaatgaagggactaaaaatttaaattcaaaannnnnnnncataaattaattagataaaaaaaatacataattaataagaaaaagtctaataatgccaaataaattttttttaaaaagtattatatcatcacaatcttcctttatttatatataaaagattagttaataattaataattaataactaaaagataacatacaaatgcaaattttatctttcattcaattactttatccatttcattaacttgtaattccattagaatcaaccaaacgtatcttttatcaaattatctcgtccatttcattcttccgttacaatcaaccaaacatatctttcttttgaaaggtgaatttagcttgaaacttcgtgtcgcgatttgacagcggaagacctagcatacgttgtattaaccgggtccgcgctagagagctcactcgaagtaaaaacatctatttcaaatacctgatggagagaaaccccatactaatctgtctgaaaatacgacaattaataagggtaaaccctgacctctcatacttgaacctagatatacgagaaccaagccctcataaaggactttttttgtccttcccatgacttgaatacaactattgaatgaaaaatggtcattaaaccattgaactaatgctcaaggacaaccaaacatatccagcccctttaattttttttttaatcaaaaaagtttaatttatttggtactttgataagtttaaaaatgtattaacactaacatttatagcccatatcccatttcgcagcctaatgccctaattgcttaagccaacccatcgcaagtccaaacatttaatttttgatccatcctttttaggccttttcttgcctacgtcatcaagtcgtcaattgcatagatgatagaagaaagaaaagaaactttacttatttgtttatcaccatgacaccatccctccaccattctccggccagccaccctacggtatgttgtttatcactagcaattgaattagttttgttatcattttgctctaaatccctaaatatattgctgtaattttgtgttgactccttattccttggttatttacatagatagagaaattgctgaaaaaattgattccatatctatagtcggcgagctcaaagagtttaaaggtcgtcggctgagatgttaaatttactatcaggtactcaccttttttcccggtatattcattagtaatttagttctttgtttgtttaaaaactatttgtttttttcttttcttttttttttgttagaacggtaatttgaattattgaagaaaacttagatttctagtgttattattataatacttgaaatatagtgatagaaaaaaatgtttaggtcctatgcttttacttaacttcaagatctgccactaatggaaagtttcggttgagatgtagacaaacttacccctaccaaaggtagagaggctgcttccatgctcaaccaaaggtagcaaaggacctctggttttgctgggcatgaggatcgcgcccttgacctctgtttccaaagacaagatctccaaccacttgatccagcccagttggtattcgattgaactaagtcaccaattgaaattattcaggattaatgttttcaatattagtttggtacatgccctcaatttcttgattgcctaaattttatggtagaattaccttatactttgatgaagaaatcatgataggcaaacattaccataagctacctatatgcatgatagataaaaggaggccgtcattaaataagaataaatacattagatttaggctcgagatttgaacaaaacacaaatactccccacgaggcaacccgtgaactttgcatttaagtaatttagtaataataaactcaacttgttccaacttaaaaattctttaaaccattatagtgcatgattatctttgattggatattaagtatgaatgattgagtgagtgtaggattgggccaaaccagtttcggattggtttacttggtccagactgttggttttgtgctgcagttagagagtgatctgctgctaggctcaatgtatgtaatttaatgtatgtatgttggttttgggcttcctttttttttatgtatattgcaaaacaaaaaagatctttgcctattatatgttttgaacttgttggatagcagagagtattagctatacgataatcggttcgtattccgggttggccggtcggaccgagtttttctgcgtttggaccggaccggacctagaccaaaatcaggggaaaatatgtatctaagactggatcttttaggcgggttcagttttccgattcggtcattcgggctggtagtgcacaacacctgcaatgtctagagcacaacatgcatcaagaatggagggcataatgttttgatatgcatggcatgacacaacgataatatttgatgtagaatatgcaaacaagacacgtaggtcaactaccgacgtgcaatctaagttatggaaatatatgctagttgcaacatgtaccgggaaacttggaaaatggtagttttaagtccacatgacgtgcacattgaagtctaaggaaagtctgatctcttggtggataattgttttttaatataaatacagatgtacaatgctaatgattggaactttatattgcattgtggaatagtgaaatattcatttgaaaattaaattttttgtgaaaactagaaaactgaccaaaacacactnnnnnnnnnnnnnnacacaatgtgtttttataaaacacaatgtgtttttattgtgtaacctaaaatacgttgtgttaagttttaaatca

SEQ ID NO: 199 - DNA, 956 bp, Cyperus esculentus
ttgtatataatatgtattatatttcatgaagctagtcatacaacgtactgaatgttttatatgatatattgttattttattgccaggatgtgaatacgctgacaatcctagtgatgggaaaaggtggagtcggaaaatcttctactgtcaattcccttctcggggagagagttgctgctgttagtgcgttccaggttaacttcccttccttcttgttttttctcataatttgtttatcagactgtctagtttcaataattatagtttcagcaattcttttctgccaacaccggtatgtttaattatttgtgggtacttctttgctttattctgagttttaacttaaacaatgaatttagaactgttctgaaatttcctgtgactgaacttcaacatgtcaatgcacagttggaaaccaacataaaaatgttttggttgattgtagttgatttgtctttaaagatcttcaggactaaatacttgtcagtgcctgtaaacgcataaatttaattttttgccaaggactgaagtagataaacaatcagcatcatggtactgggcagcctctaacttcagtcttcatcttctttccctatttccatgtagtctgaaggattgaggcctatgatgtgttctcgaacaagggctggcttcactttaaacatcattgacacaccaggcattgtagaaggaggctacataaatgagcaagcccttgacatcattaaacggtataccttgaattggattgtcttttttagtaaaattggtacatatccagagtccatatgaatctaattcttctgttggtgacttgggttaacttttgagtaaattaagccaaaaagcaactctacttttgcaattgtgcgcttgcatttctgagaagttcaccttgaacaaaattgtaactgcactaatttgacatacgacatgcccaaaaaaaaaaaaaaaaa

SEQ ID NO: 200 - DNA, 542 bp, Cyperus esculentus
taaaaaccttatccctctttctttctttgtactaaaccttccttccttccttccttctcccccaatccgaaacccttgtttctgcaattggtcgaggtttcgctctacttaagctgtcgagtaagtaagtggttgctgaattcaagctcggttcttttgggttgggttgggttggtgctagctaggtagctagctaaacccttgagaaattgggcgttaattggtgtttcgtctggcaatttgagattaatgtctgtaattgttggcattgattggtatttcttgtaataaaaattgtgggttttttgtgaactaggaaatggcgatgccgcttgctcgtgagtggattgggatccagcagttccctgtagctactcagaacaagcttgttgaattgctcgggaagttgaagggagaggttagccttttgctcctcatccccttttcctccctctttgccgtcatgttattgtgctgtacaattaagtcgcagtgaggttttaccgagttttccatttgtgcatcaggaaaatctcagtttt

SEQ ID NO: 201 - DNA, 1225 bp, Cyperus esculentus
acttttggtggatcttaattttttcattttaaatctgaagtacatcaaagtaaaaaaggcactatgttcagcatggcaatatctatctatgaaggactcccggatctgcctttacaggtttttcggttttttggtgatactgatgcatatcttgacaggactgaacttgtcaatcgaaaaaggtgtttcgagtcaataacagaaaaggatatataaatttggatatactaattacaatttttttttttcatttttaatcaggcaaacccgatccctgtggtattggtagaaaatagtgggagatgcaggacaaatgagttgggtgaaaaggtactcattttgattaaatgtgtaggctttatttactgcccaacaccagaagtcgtaaaagactagtataggtgtggtagagtcaattggcttcagtagtacagttatgcaataattttactcacttaaccactacgtcaaggggaatcggccattttttaatccttaacgccacaatgaatttcaattaagaagtatcgtatcatcccaattcttagttaggaactgcaaacttggctgcccctgatgcaagtacccttgatgtgcttatttagacagcagacttaaaaaaaccattagttttagtgaaaatatatcggtaacagcaaagactttagtccagacaagttagggtaggctagaaatgattacccaacccgagtcacaaaaaccaatgtagattgtaataatggtatcaacaacaacaacaataatagtatgagttaagataaaagctatttaagtttgggcaaccagtacgcgaggatgttgattcgattatgcctacacgttgcatttcgtaagtttgacttcattgttgtttgaacaggttttgccggacgggaccacatggatcccgaatttggtgaaggtgatagtggaagtagtgtccaacggaagcgagcctattcttgttgaccagaaattgattgatggacccaacccaaataactggggcaaacggttcattcctctcatcttcgcattgcaggtttcccttctcccatcctgatggttaatacttttgccattcatgtaataaatgatccaccagcattataatcaagaagaccggtgcataattgggcagtaattatgcttgaaatcgttatattgtaatggaaaagactcagctcgtttttattctactgtaccactaaaattaaattcatat

SEQ ID NO: 202 - DNA, 528 bp, Digitaria sanguinalis
gttttctttacaatttaaagccccaaatatcaaattattttaagataaggttcaatggcccgtgaatggagtgggattcagcagtttcctcttgccactcagaccaaattgctggaattactaggaacactaaaggagaaggagagggacagtttgaccattcttgtgatgggaaagggtggtgtcgggaaatcatcgactgtgaactcaattttaggggaacgagcagttgcagtcaatgcatttcagtcagatttgccacgacccgtgatggtttcccgtgagcggtcaggtttcacattgaacatcattgacacacctggcattgttgaaggtggatatgtcaatgatcaggccttggaacttattaaaaggtttgttttgaacaaaacaatagatgttttgttatatgttgaccgactggattcctatagagtcgataacctggatggacaaattgtcaaggcaataacacagagttttggtaaagaaatatggcgtaaaggcattgtagtgctaacacatgct

SEQ ID NO: 203 - DNA, 1320 bp, Echinochloa crus-galli
ctccacgccccccctccctctccttatcctccccttcgcataaaccccccggcgccgtcctcaccctcgccgcgagaccccgcctctccgcttctaggtctcaaccgcccgcctcccggcctccgcgtctcccgggtaaaggaagggaagggaggggatggcggcgccgataccgcgcgagtggaccgggctgcagcagttcccggcggccacccagaccaagctgcacgagctcctcggcaagctcaaggaggagaatgtgagcacattaacgattctggtgatggggaaaggtggagtggggaagtcatccactgtcaattccatcgtcggggagagggtcgccactgtcagcgctttccagtctgagggtctgaggccgacaatgtgctcccgcacaagggcagggttcaccttgaacattattgacactcctgggctcattgaaggtggatacattaatgaacaggctgtcgagatcattaagaggtttcttctgggcaagactattgatgttctcttgtacgtggatcgcttggatgcgtacagaatggatacactggatgaacaggttataagagccatcaccaattcatttgggaaggacatttggcgaagagcactggttgtgttgacccatgctcagctctcaccgcctgatggaattgattatactgatttctttacaaaaagatcagaggcacttttgcgatacatccgctcgggtgcaggaatcaacaaacgagaatatggggatttccccttgccgatagcattggtggagaacagcggaaggtgcaagactaatgagcatggggagaagattcttccagatggtactccatgggttccaaatttgatgaaagaaattactgttgtcatctcaaacgggagcaatcccattgatgttgatcagaagttaattgatggtccaaaccccaacaatcgctggaagaagttcataccgcttatccttgctgtggagtacttcttggtggtaaaaggaatccggagggcgatccatgctgatatcgcaaacgggaaggtggacgactgggagcagcgttaccgggacttggtcggaagcagggatcccgtagagcagaaagcttctgcatcccggaaccgcaaggcctaagttggtgtactggagcggatctcatcccatcgtgacccattcaattatcttccgttccttttcctaattctgtgttgggggctttatagagttcgctgagacagcttgaacaagtttgctcgtgttgtagttgataagaatatgcatttcatttgatgatgcttggccctcaacacaatttt

SEQ ID NO: 204 - DNA, 486 bp, Euphorbia heterophylla
gcttggttgagaacagcgggagatgcaataaaaacgagagtgatgaaaagattctcccaaatggcgaagcctggattccagcgctagtaaaagaaattattgcagttgctacaaatgggcataaagcaattgttgtcgatgagaagttgatagatggatcggagtcaaatgagagagggaaagtgttgattcctctcatccttggggtccagtggattattgtgaaatggattcaaagagcaatcaaagctgatattgcaagaggagacaagggtttgtgattgcgtggcttgtaccctctttttggtagtctcttgagattttaattgcatcaatgtgttttgtttttttttttttttgctttggtagtaacggaattcaggagaaaaaactaaattccttgcgcttctgttgagtgtatttcttatttttctttctgtattggaggttgatctaatttacgtttgttaaaatttttgtattaat

SEQ ID NO: 205 - DNA, 2659 bp, Euphorbia heterophylla
ctttttactcttgtcaatgaatcttaaggacaactagtttgcttggttgggtttataagtgaggacaagtcaaggtaatttatgaaaataaggagtctgcctgttatatgatagcctgtcaatgcaatgaggtgttgtggttgaatggccttactaggcccatttaggtttctctgatctggtttagaatctttaatttggtaaaaagcttatggatgtttattgataagatagttaagggtcaatttgtgtagttgatccatcgatacgaaagaccctttttgttttatgcttctaaatagttgatagcttgtttgaaaataattagtacactataagagtcattgttctgtttaatttttatgttgcttttggtacttataggtatctgccattccagttggcttggttgagaacagcgggagatgcaataaaaacgagagtgatgaaaaggtttttgtctcaatgccaaacttaagagcaagcaattgtaatagtttgacatgctaatatatcgtagcaattttagtaactagttacattttggatttacagattctcccaaatggcgaagcctggattccagcgctagtaaaagaaattattgcagttgctacaaatgggcataaagcaattgttgtcgatgagaagttgatagatggatcggagtcaaatgagagagggaaagtgttgattcctctcatccttggggtccaggtaaaaccttcttgggtaccatgactgttgtgcattatataatcattgttttcttatggtgagttttaatattgcagtggattattgtgaaatggattcaaagagcaatcaaagctgatattgcaagaggagacaagggtttgtgattgcgtggcttgtaccctctttttggtagtctcttgagattttaattgcatcaatgtgtcttttttttttttttgctttggtagtaacggaattcaggagaaaaaactaaattccttgcgcttctgttgagtgtatttcttatttttctttctgtattggaggttgatctaatttacgtttgttaaaatttttgtattaatatcatacaagactcctttaactttggtagcttggagaaatatatatcccaggcttcaagtatagaaatacaacaatgcaattatatcttcaaggctacgccaatgaattctttttgcgagtttttaacatgttgatgtgagtagggaggcaatagaggtgagtgtgaatgtgaagttagaataatgtccttaaagtagcacctatacatggtagcataaattatatagccgacctaagcatgctaaagaagaatattaaaagaagcaagcctgcattatttgtaattgtaggtcttgaaattggggagattataccatgttcgacaagtgtccggaattgaataaaataacaagttcgtaattaggagtatcgaatcaaaccaaaccaaaccgaaaactgaatggataaaaggagggcaccgaatgttgaatcaaattaattttggtttggttcaaatcgaagtgaattattttggttcggtttggttttgaaacaaacaattttttattttcagaatataaatttaatatgtaaaatgataaaaaaaatcaatataaatatctctcaatctctcaatacaaataaattattattaatttgaatttgaaaatttgaaaagaataagaatagctttattgtcaagtatattgtgtaaatcgaattaaaaatataaataaattaacataaaataaattaaaaattaaaaagtatccaaattttttcggttttcaccaaaaaaatcgaacagaaaatcggattgaataagtttggttcggtttgtgctgttttggtttgatttcttgtttcggtttcttcctctaccctattcgtaatagtataaagtaattttgtgacatttgttcagggagcaaagagcaatgttttgggaacatggtataatcttcacttagaaattagagactatgggcccttttacattgttggcaatggcatggcatggcagcgtggtgcttgtttttttgtgcggagattgcggatgggaagtggcgtggggggcaccatttgcataatagtttattgttgatgatggcgcatttataattaagtagacacccccattaggcagcaatctatcattacagacaccctcaatcattatcactctcattattacatcttatcagctcgcttttgatgcttatttgttttctttaggtaaaactttattctttttcttgattaattattggttttactagtttattactagtatcaatagatttggtgaaattatagtcaacaggctgaaatactgttaattaggtgtttacctgcgtatttgaaagaaaaaaaaaatactacgtggactcgaatatgtgatttctagaattatagtttcaagattcaataagtaggttaaataatttctaaatttcaatttgcacttaaaaacttaggcaaaatgaaattaatcctaccacctgcttccaaatctgatgccatggattttttttataataaaaattacatgcaatggaactcatcgtggattctctccgtttttaagttatgatccttattttgaattttcgaatccaatatttttttgctttactcgttcaatttcgctaaa

SEQ ID NO: 206 - DNA, 252 bp, Festuca arundinacea
atgcccaactctctccacctgatggtcttgactataatgatttccttaaaagaagatcagattctctgttgcggtacatccgttctggtgcaggaatcggaaaacgagaatctgcggtaatgtgcatattcacttgctacattatcattcccatcatactttatgcaatatcagcatgccatcaattggttgcactctgtgtggagcatcctctgcctaaactacatgggttctgctccttttcatttgaaa

SEQ ID NO: 207 - DNA, 606 bp, Festuca arundinacea
ctaattaattgaccatggctaggttctgattgtgtatgtgttgtgagttttgacgaaaattgatggaattttgtatgttttgcttatattgtgatttttagaatgtgagcacattgacgattctggtgatgggaaagggcggtgtgggcaagtcgtccactgtcaactccattgtcggggagagggttgccaacgtcagcgccttccaggtttcacatttatccctggccctgtttctgtttgtgcctctgttttgggttacttatgtgggagtgcatccttatatgttatttctttgcagtctgagggtctgaggccgatgatgtgctcccgcaccagggcaggattcaccttgaacattatcgacactcctggcctcattgaaggtggatacatcaatgagcaggctgttgagattataaagaggtatgtgcacgttgagtggcaaccatgcttgttttgcaactgagcaattgattgtcggtactgtaacttgtaaactagctaggcttcgtgtggcgacgagggttgccattttcaaattaagaaataaaacataagggctttgggtggtgacccagggcaagtgagcagttgattgtagat

SEQ ID NO: 208 - DNA, 853 bp, Festuca arundinacea
gtctacatgggtagaggcgtagatttcgacaacataaaagaaactaaacaaaaaaatgaacatttgcattcatgttcagattgaaatcttgtgttcatgaacggacttgtttttgttcttggtttctctcttagatcatcatttgtctttcttggtgctataatcctgtccatgatgtagcatgtagaaccataattagaagttgaattccataatttgctctgcaagtctttaacctcttagtctatgcggatatatttattttactctggtattgaattttttatcttagtactatatagtgaattgtggtcagctggtggtcactccaccttaagcgcttgatagatacatatatgtgctatgtacgatttatcttgttgatttgcatactctgtatcatatttgggattccccttcagactttaatatgtcaaatactgacctggttaaaccgctaatacatgtgtggttgtttatggaagataatactcagttttccttggattgattttcctttctcttgaactattttactgctaacaattgaaacaacaacggttgttaagaatgcagctcattcgattggtgtgtgtagaaaagtttatggtccttccattactgatcactagtgttgttatccatttatatgcaatataaatatatcataagatttttctcttcttgcatcttacatgttatcaatggtattgcaggtttcttctggagaagaccattgatgtcctcctatacgtggatcgcttggatacatatagaatggatacattggatgaacaagttataagagccataactacttcatttgggaaggccatttggcgaagaacattgg

SEQ ID NO: 209 - DNA, 1596 bp, Festuca arundinacea; identical to SEQ ID NO: 140

SEQ ID NO: 210 - DNA, 742 bp, Festuca arundinacea
gaatctttgtttctgtgtatgaaatatgagtattaattcttaatggaagcacattggtgtgatttatataggattatcccttgccattagctttggtagagaatagtggaaggtgcaagaccaacgagaatggcgcgaaggtttgtccgtttcatgctgtgtatttgacttgcatttggttgtccctagcttcttgatttaataaaggatttcatacaactgtgtccagattcttcctgacggaactccatggattccaaacctgatgaaagaaattactatagtcgtctcaaatgggagcaagtccattcatgttgatcagaaattaatcgatggtccaaaccccaacaatcgctggaagaagtacatacctctcatccttgcggtgcaggttagctcttcacatgataataactgcaaaatcccatcataaaattggcatattatttgtactgagaactctaacctgatatccttggtgctcttctccagtactttttcgtcgtaaaaggaatccgaagggcgattcattctgacattgcgaatgggaagctggatgactgggagcagcggtacagagatttggttggaagcggtaacccggtagacctgaaagtttcgtcatcccgcaatcccaaggcctgatctgtccaatgagagtgaacaccagtctcttcatcgtggcctgttcaaactctccacattgctgttctttttcgggctcctagttccagcggtctat

SEQ ID NO: 211 - DNA, 259 bp, Festuca arundinacea
gcacattgacgattctggtgatggggaagggcggtgtggggaagtcgtccactgtcaactccattgtcggcgagagggtcgccaacgtcagcgcgttccaggtctcaccttgctcccggccctgttttatgtttgtgcctttatctgggttgctttgcttatgtgggagtgcattgttgtgtgtggtttctttgcagtctgagggtctgaggccgatgatgtgctcccgcaccagtgcaggattcaccttgaacattat

SEQ ID NO: 212 - DNA, 1260 bp, Ipomoea hederacea
gagaggagcccttccttaaacccttctctctcaagtctctgctctctattttttatcgctctccgccattaaaacccctttctttcagattgcaacgagaagccgtctatctccggtgacctgcaatcctctccatggctgcacaagtagtgagagaatgggctggtattcagcagtttccggctgccactcagaccaagttacttgaattgttggggaaattgaagcaggagaacgtgagcactttgactatcctggtggtggggaaaggtggtgttggaaaatcgtccactctgaattcaatcctgtctgaaagagtcgttgctaccagtgctttccaggcagaacctccaagacctataatggtctcacgagcacgggcaggattcactttaaacattattgacaccccggggcttgttgaagcaggatatgtgaatgaccaggttattgatctcataaaaaggttccttttgaacaagacaatagatgttttgctctatgtggatcgcctggatgcgtatagagtggataacttggatttacagattgtcaaagccataactgatagttttggcaagcaaatctggcgtagaggcattgttgcacttactcatggtcagatgtcaccacccgatggattgagttatgatgagtttgcctccaaaaggtcggcggcaattttgaaggttgttcgccagggaataggaatgaggaaatcagaatttcagaaaactccaattcccctcgtcttggttgaaaacagtggacggtgcaacaagaatgaaagtgatgagaagatccttcccaatggagaagcttggatacctggtcttgttcataaaatcacggaagttgtcttaaatggaagtgagagtattttggtcgacaagaagttggttgatggaccaaatcctaatgaaagggggaagttatttatccctctcattttagctttccaatacttctttgttgtgaagaagattgagaactggatcagggccgatataaggaaagatcgcaggtcaaagcgtttctgatgttctctgtcttcgatgcatcgatttgttctaataccgtagaatcttttgtagtagttgtctatcactctatccatcagaggcaactgaaaagttatatgcggctgttgaatttcaattttcttcaaagagcttagattctgtactaattgttaactcagatttctcactctctttctgggattgcttgaatttattctccattttcattctcaatttc

SEQ ID NO: 213 - DNA, 12125 bp, Kochia scoparia
aaattaatttaaattaaattaaaaaattaaagaaatgaaaaaattaaaataaaataatgcaacctttataatttttattttattcttttacgtctttctatcacttttcgaacccgcgatctcttgcacaaatttagggtcctcgtaccactacgacatcatatatttaacatatacacattaatttacacgttttattcttttcacttatactacactattgttttagttgtctgtggtaaaatagttcatcatacaattatgatttatcttctataaaaggcggattactctttcccttttcaccacaaaatgaaggttggtgaatatccaccgccaaagcttactgttctccttgtgtgtgtactagcattaaatgctaggcacacttgtcttctaagctacaatgtagctttgcagtatttcgggtgaaacctacgggtttgttgtaattgtaaaatgcacaacaaatcaatactgatacatcttgtatatttctcacaacaaaattactgggtttgttgttgacatctgtgaacattttgttcttccttttccttctatttcccctttgtcctcatcatcttattctaacttattttttttatttggctggcacagctttttgttggataagaccatcgatatattgctgtatgttgatcgattggatgcctacagagtggataatttggacaggcagataatcaaagctattacagatagttttggaaaggcaatatggaatcgtgctgctgttgtccttactcatgctcagctgtcacccccagatggtttaagttatgaagaatttttctctagaagatctgaggctcttcttaaaattgtccgtgttgggggccgaataaggaagcaggattccctggtatgaaatctttatggcgttcttcagtccattctcgtcttttgtgcagcattttccttttaatttttaaggaaaattttccattaactatccgcatttttcatctgtttagaaacaactacccgtttttttaaatttttttaaaaacaactagccaatttttaagttatgtttgcgatttgcaaatcactacccaatatgaatttccggccaaaataaggaatatttcgatcgtgggtcccagctgcatgcgttttccctccaaattaacctgattatacgcaattacccttataccccccatttacttcaattaattccctcatttattactccaacccacccaagtcacaatcaaactccctctttcatcgcttcttctctttccttcggactcccctttactttatttcttttttcttcatccttgataccaatttgatgtggatttataagcaagatgctcactcctaactggaatgagcattatgatggtgattatatggtgtatcagtcatgttctgatttccgtgatgaggttttctcaaactgtagatgctcactcctaacttcttatgctatatccttatccttaaaacattgcttatggttcctgtatatttggaatgttattaaatgcctggacttctaaattgtgtaatgtgatggatatattctgaaaagttgaaatcctgtttatacatctcttgcatattctcctctctctttaccactgttgcaaacttgcaatgatgtttatgtaaagctattcagaacctaccactttaaagaattcaaattgtctctgaattattttttcatttgattagtttgtgtttaactgtttttcctgaacattaaatctctttttaattttctatatttcacctaggcaaactccatgcctgttgttttggttgagaacagtgggcgatgcaataaaaacgagagtggtgaaaaggtcagttcttattatttccgttgcactattgctcttagcattcgctttaagcttgatgtaatagttttacacctttagcttcttttttacaattggtaattgctgtcaacattatagattctaccaaatggaatttcgtggataccaaatttggtgaagactatcatagatgttgtttcaaatggaagtaagggtatcttggttgacaagcgattgattgagggacctaacccaaatgcacaaaacaaaatatggataccgttgattctggcatttcaggtaactttttttttttatttctgaagcttatgtaactcttttgtttacttttgtgatgttttggggtggtttcttggacgaatattagatatatctatctcacaaaatgaaggatagccccattttgccttgtgagaactagggtaggatatagtgtgtgccttgtgctgtgtagggaacactttgtgttaggaaccaacgtggctgatattttgagagtagaattataggactgaatgatggttaatggctatatttgtggattaatagatgaacgaacattgaaagctaatgatgaatattatgaatgatgagatgagattaagcaaactaagatagttatcaagcattcgagaggattgattgtctcctaaacatgagcatttgagaggctcatactctctcccaagagttttcactcaattacaatcgacatgcttcttctctccctaattacctctacttacagaatttactcataactaatctcatatgttactcaaactctttcatttacctcacgtgtccgtttcgacactgtcacttgacactttacacttcattttttttaactaaaaacactacttttttcaagaaaatgggcgagtccaatgcttggacacccgtgtctaatttgacacttcatccgagtccaagtaacatagctaatctctattagcttccataagcgcctttttttttaaaaaaaaaaagctttcaaaaaatcttctacaaaattttaatagcaaataattattatttacctaaattacccttcctccactcatattaattccttgactttgcgaaccccatttgcatatacctccttttcagttttcttgatccctgtccacttggaatttactgtgttctgttttcattcattttcattgttacaaattgcttgatgtaaatatccttaaggtttaggtgtgaagttgttctccagttctcttgttgtgaatactcttgatatagattgatagaactcatagaagagagagattgtaaatatttatcacttgtcttaccaccccttttgagggagagaacagaaaacatttatggtatgttctcttcaccttaaaagaatgagttccaccctagaaaagtttagataagttcatattaagtccaattagatttgataaatgcttgattagcagaaatggtcatcgtaatattggttccttgcaggttcttatttttaaccactgagctgatgtttattgttttactgtattgctatgtgcatttctagacaaagtgaggcctaaagaaattcagcactcgtgcctcacagattccttatgcccttaagaccttaacccatcttatgttactgtttgtctaaggcaggggatgcatagactcacgactcactaagaggattgatttgtttagtcaataggattagacttttgttcttttcacctagatgacactaatttgaatttgtttgtctttatttattagtccttatctcaattatttacgtaaatgttagttgtaaataaaacttttggaagactggaagtactcttcgttatccatgcttgtatagttgtattgccctaaaagttatcttggcatgggaatcaatttctcaaaaaaacctgactggagtacattgtctattttttttcatctgctgcagtatcttgtggtgaagcagattcgtggtgcaataagaagagatattgccagggaacccaaacctgcatgggaaattagggatattgctgctatgtccaagcgcaagaaatgatgggtttcattctgcttcctgtcttcttccatctgacactatctcaactgtgtttctcatcactactactatagaggaagtttagtggtaaccttcggcatcatgagcgattttgagcatctaagagggctagctcttttatcttatcttcctatttcatttatttcaggcaacaaaagtgcactctttgattttattccagtctggtttggtagaagatctattattgtatctaataatgaattactgagtaattttcgtttaaagagaaagctcattttgtgttaaaattctggcagtctgcagaaccgttgtgacttctttcatttttattttcgttcttcgcttcgtggttgaaaaaggcagcatctaacaacctgcagttgacagaaatgattgcacagaatttgctagattgttctggtctaaaaggtccaccttattgcaattgatggtggtgcttggagaaccatgttcatcgttgggtcccacttgtgaacatatcttttcttttttctttttaaaaaataaaacaatcatcatgtgttgaagtacctgattattataggtaaatatgagagcttacatccgagtttatgcatcatctgctgataacgatcacgattacttgcatcatcaaaagctggagtctgctatacttttgtgtgttcgagcacattcgagtaagggaaataatggcagtggattgcattttgtggtgacaaaaaagatcttaaagaagagttaggcctttttaaggcatgaaccaaaacaagacgaataacagttacggcgcgaaactgcaactcttatggatcctgaaattcagtgtggtgggtaagattgttccttgtcaatcaaattatcaatatcaagagtgccacatttgttaaatcattagcaccaaagatattacacttgaatgtgattcttaggaggttgtccatttcatacatctatgaaagatctcaaatgttaacacaatgcatgtcttttgtctgtttgaataggattcttaattgacagtccttgtcatttttgaggttactttggtagcatgaaaaaagttgatcttgtatgcttatctagtttgaactattgctaaccaaatcggtttgctaaggctagtttatatatgactagtattagctgacacttgttgcaaaattgttcatgtaagaaggaacaacaaaaaggggttcatattatacgatgaattcacataattgaaaataaactctagactctatttttgttcacatgtaatgcacgatttttaatcttaaaaaaggtttgaaaataaagaaagaaacaaaatagaaatgagaaatgaattggaagactcaaataaaattggggtgataaacaacttttgctaaaaagaacgctaaaagaattacgtagtgaaaatgttgattataatggtgtgtaattgtggatgaacgtccaaaataatattgacgaagaattttaaattagataagctattgtgtgatgcacaggtgacataaaaaagtatttatcaatatatataaaatgtcattttgatcctactaataatatttgtaaaacattttttttaatgaagaaaaatttgccacaattatgttataattatttatagacattaaaaatcttaaaagaacgcatttgaaaaattaatagataatttaagtactaagttaaaaaggacatcatcaattgcatgaaatgatgacacgtgtacatgaatgatgtaagtatacactgtttaatgtatagttccagattctaaatactcatagattatagatgaggacataagatgagatgatgaaatggaattagtggatcgaaatggctgctaaatttgacctttgctttagagaagctatcagcctatcatagtagtaattgatgatatgtcctcaccttgatttaccaagtatttgttttttccccacatttgtcacattttttttatagcttgctttcacttcaatatctttagttctcaaaattataaactcaaaatattattacaattatttaaacaaaatccaacatgattatgttatttaatgttgcctagcctcgatgagtttacccttagctccttttttgtctatttcgctacaaaccaccgccaccattggcatcccctagcaaccattgctcgtacctttattaaaccacctccatctcctcctcttcacttgtccttctcacaactcaccactaccaacacctcatactatctttctatgttcattaatttttcttttaaaatgacgaaacacatatattacgcgctacattaaattatttttaacaatttagtgaaggtgatagtgatagtgataattttggatagtattgatattgaggtcctgtggattgtgaaaatgagaaaaaatacaataatgaaaatatagaaaattcaatttaataaattagcgaacaataagtaaaattgttgacgaatatcaatacctttctcaatacattttttgacgcaaatacctttctcaatatataggttcaaattggaacatttctttactacgtaatattaataaatccaaaaacttgaataaaaagagcaaaccaatactaacaacaataaagaatacataatacgatcaacaatttaatacaaaaaatcaattaaattagagaactgtcaattcttccgatctaatcaatgttaaacacggagtagtttaattgtttaaagtttaatgaaatggtgttcaagatataagattagtctatctcttttacattattgtccttaattagttgctttatttccaagaaaaaaatttaacccgactcaaaatcaaaccgaccataatagaaagaccacatttacaaagtacaaggacaaaaaagcaatgaccaattttgtcaaccctaattaaaaaaatgtcgaccattaatgaggtggtcccacaagtgtaattaggaaaaattaccctaatccagttcccactttttgtaggccccacgtgtcactctctcaccacactttcgtgtcacaacactcctctgtttctgttctccttacaatcacccacattcatagtattataaaaagaggtgttttgatgcacgagcagcagctgaaaacacagaaagaaaagaagctcagaattcacaagtgttgcacaaaaaacccgccttttcatttaattacaccaccaaatttgcgattggataactcaaattaaaattcaaaattgtgggtttttctgggtttttttgtgggtgtctaaaaaagttgtctttttttaaaaaaaaaaaattaaataaaaatggaagggaggaaaaaggggttggaaggagggcaggtattggacggtacagatataatggagttggttgagaataaggaggtgttcagtaaatatgtggatcacaagtttaaacaacttgattgtgataatgatggtaagttgtcagtgaatgaacttcaacctgctgttgctgatattggtgctgctcttggtcttcctgctcaaggctcttcctctgactctgatcacatctactctgaggttcgttctttctctctatgtctttcgcatcaacgatttgacattttttctatcgttgcaagaatttggttatgacataaagtatatttttatcttgcattggaaactttctaaaaaatgagtgtaaaatgggctagtgggaagcaaggtacgcgacacatgacatgttacgtgttacaagacgagggaaaatgtctgatttatgtgggacgaacaatagtttttgtccatagcttcatatgatgttaagatgatgtatgttttttttttttttggtgtgtgaatatgtataatgcaatcgtggacgcttgctatacagaatagtaacgcgtattatgtaagattattacatttgtcttcgagattgtcattttcttgtttgcgttacgtataatatttgtatctgtgtctttatccgtatttatcgagtatatcgatcgtatagggtttggtgcaatttggcataattagaactatgattcaacatttcttgcatcatttcttggagtgcatatatagttgggatagattgaagtgtcatgggagaataatgtaataaacgaggagtagttgttacaacttactagtgtctagtgaaaagattgtttagctagcttggttggtttataagtaggataatggagttatcttgtgaacacaagtttattaaaccttgattatgtgtgaggaagtgattcgacacgggacttaaataagtgtgttttagcacagttggggatttagggattgatacttggtccgctcttaaaaaatcagtactctttttggtcaaagtgtcgcaattttttacgagcggatggagtagtttctatgttactgttaggaaatgattggcaatttaggggttgatgagaatagatgatggtcggataataatgtggcggctaagaaaggctactctatcaaacaataccgttatgtgccccttgcttaaagactactttcttctgtctttttgttcttccttacttgatcaggcagaagtgtccagacaaattagattggctcctctgtttgttcttttttgatgcaattgttttggtgattgtgtgtttggggggtggggagagcgagaacaaacagaggagccaaaagacgaaagcaaatattaaggaagaacaaaaaagatagactgtatgaaatgaatccaagtatggtagaaattatctattcagaaccatagtcaatatttttgcggtgctagtctctataactttatactatgtgaatggaaccccatttttcgtagaagtaatcttttgggaaaggtatgcccaggggaaaaaaggaggggagcgaggagtgttcatgcaagttcgttacagtaggtaaattttagatttacttcaagcccacgagtccataaactaaccgtgtagcgtatgcctatgtagagtagctgtgtaggatgacatctttgttgcgattgattacgttggatgaccaagttgttggaagaaagagttaacagcaaaagataattttgattagttgtttaaatcatgactttgtggattgatagtagcataatctatatttaatggcaaaaggacataaaaagctaccggccttaatattcttttccctttgttctttttgaggtccctttctgatagttgttatattggttgaattctcgaatatcttatctaattgtgacattgaaatttgatgatcaatgtctgaaactttccatgtatatatcttgttgattggtaccttaatttccattttgatctttcaattcatgagtgcatcctgtagtggaagcgagatggctagtgacaacctcatccagaatgaaatatttctagagaatacaagtctgagacgcttagttttatatttttgtatcagaaacatgaagaatgagcataataaggtgtacatacatcaatgtccttaacatagcatattagcaaatcgtcctctagaaaattttaaggctcttacacaacttgttacaggattgctgattgcgaggcttttcttgcgttattctgtcttttgtcaaaacttaatttactagaggaagtctctcgtgcacgaaccttgtgctttgaggaatcttatctttgtttatgtaggaaatatgactaatcacagttaattaactgagtataatgttggaccagcctaccaaacgatcctcttaatgacctaaattattcttaacgagttcaatattatataccctgcagaccagctaaaaatgaaagtcggctgcatgattttttttctttgttattcagagtaaaaaaatgtttcttttcatcatacatacatcacatttcatcactaagattcccaaatattgggggattatggtaatggtggccggataaaaaagtgtccggtaggtttcaaatagtaatattgtattatacaaaacataagaatgacataaacatttactttggtggaacccttttataattttttgacctttgatggaatatgtagggggtaggtgtggccggttgggttcaaccccttcatgcacttctgtataatgttctacaagcatcattaaaaagctttaaaagcagaatagtatatgagttttattatgattaagaggtcaagaattcaaacattggctcttatacatttttcattttccggcatgcttttaggaaatcatttggtgacaaaaagggtggtcctttagttgtcttagtgcttccggtacactagcaaatgcttatgtaattgatcaagacacttaagtataaaattgtggctttcaaaactatcttgctttggccgaaagtgctctttcgagtggggacctcgaaaagagttgctagtcaattgtatctggttgaagaagtaagctaacctttcaggtcacatattttctgaggttcttaattttcttcatagtttagagttaagacattatattacggataaggaccactaatgaattgttaagacgagtactcataaagatatgagttgaggtataccaatagaacggcttggtcggcttttgaaatgtttctatctgccaatcaaaattgaaggacctctaaataaatgccaaaataaacaggtaatgggagaggtttagtttataagaggtcactgtctaaggtagtagttgtgatttgtgagattcatgttttttggatgtgagtgagattttaggctacaaaattaattcaaagatcaattatacggaaaattaagttattaatcgggtatactgtaagttttttcccctgtttgatagcagtgagggtggcttgtattgaggtttaggtgttcttaaaaatacaagtggcattagttacagataatgtgatatgatgttaaaactctctcattatggttggttgctataggttctgaatgaattcactcatggtaaagaagagaaagtgagcaaaagcgaattcaaagaagttctttcggacatccttataggcatggctgctggactaaaacgagaccctattgtcatccttcgcattgatggtgaagaactccaagaatatataaatggccctagttttgagtctgatatgattctggtgtactctgagactgcatcacctgatggaactatctgtgatcacattgttaaggctttgcaaaagcttggtgttgatcaggggttaccacctatttcagattcttgggtaacagctctaatgccacttattatcagttctatcatgtttcatgtataccattgtatcgttgatgttgataatcttagaatattcttgggttacatttgtaggtcatgagcaatattgtgcaaccagctctagagttgtgcactcgagactgtaacgatgatgaagaactggcaacatctcaggagattttcctggaggaactcaagaaagtactggaaaagatagttgagcgtctcaaagagcagcccgtaattgttgcacacactgagaacacctatgatggaagtgcaatcaagaatctgctagcaaataagtttgaaacagacaaggtattttagccatttcttcatttattatatataaaagcttcatagtgttgaggtcattgaagtaatttccccagaaacttaggctgttaatttttatgataactaggtgctgaattctgtgctggaaactctacctagagataagcaaggaagaatttcaaaggagtatcttcggttggcattagattcattagccccatctgctggtttgcctccctatggagctgttgctgaggtaatctagtttcttttgaaacatgtacttcgtatatagttttagtcatgtacatatattattgatatatgttcatagcttgtgatctcccaaacggtgtaatcgaaagtgttatgaaagatgtatcttattttctttgtgtccactgttgggcattttaaagataatgatccctgaccgttctttgctgatacatgagcagatggataagataatcaacgatgtatgcaagatggtggatgctgatgatgggaagtttgtaaaagaagaagagttcaagaagttgttgttggagatcttagggagtaccatgttacaattagaaggtaaccctgtatcaatttctactaactcggttgtgcacgagccccttgcagatccttcgacatttttgcagacatcgacttaatgaccctccctctgtcaagtcactgatattgcatataacaaataa

SEQ ID NO: 214 - DNA, 4228 bp, Kochia scoparia
agggtggtttggcgagtgggggtggggccggtggagagtggtggttgaagggtgtagtggagttggggtggtcgtcgaaggaggataggtgggggtggggtgatattattttttttgttttattttttttaaataaagttaaccttaatttaggtcaaattaattattaaggttaccttctaaaagattaataaaattttgggatatattataaaagcaaaaaaaataagaatatttcgtgaaaaaacaaaaatcacaggatatcccgtagaaaaacactttataatttaccatcacattaccaatttacctttcaaagtgtatttgggtccacgaattagtgcataattgcaaatctagtctatgtctatctagcagtaaaaaagagacatcacaagagtcgagacaaaggaggcacaaaaatcagcaaaacttcaaaccaaaatttcattcattcaacctgataaggcttgagggttttagcttaagcccttatcttcctcctttcccctttcgcaacatcccactttcacttttcacaccggcaattactgtaagttttctctcatcaatgtattctgtggtttttagggtttttttttttggacacattttgatgaataatattcactgattttgtactgtttttgttctaaaagattgaacgtttttgtttcaattgtgggaaattgtgatgggtttgtgttaatttaatgtgggcatttataattctgatgcctgaattttcaaaatttgatttgcaatatcttcggattaggttggtgaatgattgggttttgacatttgtttcaaagtttacaagttttagggttgtttatgaattagattatcttctgtcatattgtgcaatgcttttaatttattgatgccctttttcttctggaaaattgagctaagttttgtatgaattgagcaggtgaaagtttaggatggctggtcaaatagttcgtgaatggagtggaattcagcagtttcctgcagctacccaagccaagttgctcgaattattgggaaaattgaagcaagaggtttagcccctttatcctttttttttttttttaataatttttgcagtattgctgaattttgtcattgttacaaagtgggttttgataaatttgtatgtggtactgttttgtgcggtagaatgtggattcattgactatccttgtaatggggaaaggtggtgttggaaaatcctcaactgtgaactcagtctttggcgaacgagtagtagcggtcagcgcttttcaggtatggcttcatcaccctggcatgaatgtcattttgtcctattgtttttctctaatttcttttcattccatgtttttagattcaactagtttattgagtgattagtcttggtcaatatccaatatattaactatcttggtggattgtagtggtatttatatgcaatggttgtccttgctctctcattttagtatgcacttaaagccactctagtagtctagtgtgtcaataactgaagtagaagccataaaattgaattcacaatggtccgaataatttcagagggtctttttgttatcgtttttgttttaagctatttatttatttttttgaaaaaaaccaaaatagtaaacttggttgttgtcagttttcaaaactattatgattttaatatatttaagtaattcttgaccatttatatgctatataattatatatcatatattcatattactttcagaaaaaaaacccaaataaccccactctgatactaaacgggtgtacgggcctataagttgtaggatattgttgcttttgtttcaagcctccttattgaaaaaaagaaggatttgttttttaatcttaagttagtgagttccgaaataaacaaaccaaacacaacagagtgtttgacttgttaaggaatcaaattataatgttgagttttagaatggtttgtttgcaaacaaatcaaactcaaacgaaaccttgactaagtagatttcaaattattgatgaactatttggtctgtgtccacccttaggatactgcacacacttccttgtgaccaaaatcaaattgttgataattttttaataatcaatttaaaacatttactatgcatcaacttggaaagacgagaaaaaacattttttttcccagtcttttttttttttatatctatattgaatttttaattctttcatgttttcattgaatgtcagtctgaagcgtcaagaccttcgatgatatctcgccaaagagcagggtttacattgaacattattgacacaccaggtcttgttgaaggaggatatgtgaatgaccgtgctattgatatgataaaaaggtttgtgttggctaattaagttacacacttttatcttctaaaatcctcttatactcatgtaattctgtagtaagagtgcaccgataacctcttgagattcccttagggctattctttttgctcccttatgaaccctctaaaagaaaactttatgtgggaattatgggtcatagacctcatagtaagaggggatacttagacagggatattttcctttatctctcctgtcacttctatttttacactccattttttggttgattgtaatgtataaattataaaaagactcaaggcccaccaaggcgatagaggttagtgtgcggctgtgcgccttgtgttgtgtctcattgaagtgaggcacactaaagaaaaatgaggaaaataattgaaaaatgtttgtgaacaaatcaggtgcgcctcattgaatgcgtcttgcattgaccctaaaaggtgcctacccccttgagcctaaggcgcagttttttaaacattggttaattaaatgaaagcagatagatggatcaatattgacacttgtaaaggcaaaaatagggtgaacctaagagtttgagacatcttttgagctttcagttttttctagttgttacagcatgctgctttatgtataatttaggctcaggtgaccttccagtttcacaattttccattgaaattggagtttggaagttttgggtctggactttatggaccataataggcttggggaagttggacatttctaacaggatggtgtgaaattggaaatttttaaatggatggtgtgaaattcgcttaaatgctgcaactggaactaattttttattgcctgtttgccttggcaaatttttgagcggattgtgcgtcttttaagtgtatattgtcttgtattttggtaaactttagttgaatcttcattttcatgttgtgcgaatataagaaatttgtttccttcccattcctgtttgagcttttggccttgttttctcttcaacttatttttaatacttattgaaaaagaaaagttcaattaagtaataagttgaaaagaacatacttattaccactcataataagcattaataagttcaaattaaagaaataagttgattagtcgaagagaacataccctttgttttacttgagcactcgtctatatatacccttctattgtaattgtaaaattcacaacagatgtgtggaaccctattctatatttctcataacacgaacacgtacattatcacccgattatctgttataatataaattaagtgatagttatttcaccaaaatgtttttggggagtatgttgtatagttgccaatgtataaaaaagcgtaaggcgcactaaggagattggattttctagagccataggcacgtcttagtgtgcctcattgaagtgaggcgcacctatgaagtaattggaaaattctgagaaaaaaattgggaaagaagctctagtgcgcctcacctgcacctagccacaaacgcctcgccttggccatattaagcgcttaccacctatcgcctagtgccttagtgctaaggcgtgccttttcaaacactgatagttgttgcccaaatttgggaacctctatatcaggaactcgcaaaggaaatatttatcactttgtgactatcgttatatatatgtttgttctcttttcttccttgccctgcaaatttatttgggtatgattactttggttaatttctcaaatacaatggacttattatagtatctaaacgtaatattatgcatacctaattagctgtagtatgggtgatgctatgtaaagcttaataccccctttcataattttcgtcctttcagctttgattagactaaaattaaattaatttaaattaaattaaattaa

SEQ ID NO: 215 - DNA, 400 bp, Lolium arundinaceum
acatttatccctggccctgtttctgtttgtgcctctgttttgggttacttatgtgggagtgcatccttatatgttatttctgtgcagtctgagggtctgaggccgatgatgtgctcccgcaccagggcaggattcaccttgaacattatcgacactcctggcctcattgaaggtggatacatcaatgagcaggctgttgagatcataaagaggtacatacatgttgggcggtaacttgtttgcaagtgaataggcgattatagatactgtaacttttttaaaaaaaggcattgggtttccctctcacgtgaccgagggttgccattttcgacttagaggctcatagtatctggttactctgaattgaatgttctatttgtttcgtcaaattggcaaaatc

SEQ ID NO: 216 - DNA, 397 bp, Lolium arundinaceum
tcctctgcttgcatttacatgttatcaatggtattgcaggtttcttctggagaagaccattgatgtcctcctgtatgtggatcgcctggatacatatagaatggatacattggatgaacaagttataagagccatcactacttcatttggaaaggccatttggcgaagaacattggttgtactgacccatgcccaactctctccacctgatggaattgactataatgatttccttaaaagaagatcagattcgctgttgcggtacatccgttctggtgcaggaatcggcagacgagaatctgcggtaatgtacatattcacttgctatgtaatcatttctgtcattctttatgcaatattagaacactatcatttatttgcaatttgtgtggagctt

SEQ ID NO: 217 - DNA, 729 bp, Lolium arundinaceum
gatatgttctaattgcgaactatttcacaacaccttaaccaaatttgtcaatatacgacggactctgttctcatatagtcatcttatgaaatctttgtcttctgtgtatgaagtatgagtattaattcttaatggaagcacattggtgtgatttatataggattatcccttgccattagctttggtagagaacagtggaaggtgcaagaccaacgagaatggtgcgaaggtttgtctgtttcatgctgtatttgacttgcatttggttgtccctagcttcttgatttaattaaggatttcatacaactgtgtccagattcttcctgacggaactccatggattccaaacctgatgaaagaaattactattgtcgtctcaaatgggagcaagtccattcatgttgatcagaaattaatcgatggtccaaaccccaacaatcgctggaagaagtacatacctctcatccttgcagtgcaggttagctattcacatgataataattgcaaaatcccatcataaaattggcgtattatttgtacagacagaactctaacctgatatccttggtgctcttgtccagtacttttttgtcgtaaaagggatccgaagggcgattcattctgacattgcgaatgggaagctggatgactgggagcagcggtacagagatttggttggaagcggtaacccggtagacctgaaagtttcgtcatcccgcaatcccaagg

SEQ ID NO: 218 - DNA, 725 bp, Lolium multiflorum
tgcagcagttcccggcggccacccagaccagtctgcacgagctcctcggcaagctcaaggaggagaatgtgagcacattgacgattctggtgatggggaagggcggtgtgggcaagtcgtccactgtcaactccattgtcggggagagggtcgccaacgtcagcgccttccagtctgagggtctgaggccgatgatgtgctcccgcaccagggcaggattcaccttgaacattatcgacactcctggcctcattgaaggtggatacatcaatgagcaggctgttgagatcattaagaggtttcttctggagaagaccattgatgtcctcctgtatgtggatcgcctggatacatatagaatggatacattggatgaacaagttataagagccatcactacttcatttggaaaggccatttggcgaagaacattggttgtactgacccatgcccaactctctccacctgatggaattgaatataatgatttccttaaaagaagatcagattctctgttgaagtacatccgttctggtgcaggaatcggcaaacgagaatctgcggattatcccttgccattagctttggtagagaacagtggaaggtgcaagaccaacgagaatggcgcgaagattcttcctgacggaactccatggattccaaacctgatgaaagaaattactattgtcgtctcaaatgggagcaagtccattcatgttgatcag

SEQ ID NO: 219 - DNA, 1061 bp, Lolium multiflorum
gtaattatttagattaggtagacaaatactcaccttttggaatctttgttttctggttgcactttcatatatgttctaattgcgaactatttcacaacaccttaaccaaatttgtcaatatacgacggactctgttcccatatagtcatcttatgaaatctttgtcttctgtgtatgaagtatgagtattaattcttaatggaagcacgttggtgtgatttatataggattatcccttgccattagctttggtagagaacagtggaaggtgcaagaccaacgagaatggcgcgaaggtttgtctgtttcatgctgtatttgacttgcatttggttgtccctaacttcttgatttaattaaggatttcatacaactgtgtccagattcttcctgatggaactccatggattccaaacctgatgaaagaaatcactattgtcgtctcaaatgggagcaagtccattcatgttgatcagaaattaatcgatggtccaaaccccaacaatcgctggaagaagtacatacctctcatccttgcagtgcaggttagctattcacatgataataattgcaaaatcccatcataaaattggcgtattatttgtacagacagaactctaacctgatatccttggtgctcttgtccagtacttttttgttgtaaaagggatccgaagggcgattcattctgacatcgcaaatgggaagctggatgactgggagcagcgttacagagacttggttggaagcggtaacccagtagacctgaaagtttcgtcatcccgcaatcccaaggcctgatcggttcaatgagagtgaacgccagtctcttcatcgtggcctgttcagctctccaccttgctgttcttttttgggctcctagttccagcggtctattttggaggctttatagagttctctgggacaacttgaataaagttgctagtgttttgggtgctaagtgtatgtaccccatttcattatgctctcccaattttgcaaatgttattgattaagcttagttatttggacttcttgtattgcttttacgttcagagttg

SEQ ID NO: 220 - DNA, 260 bp, Lolium multiflorum
gagtgcatccttatatatgttgtttctgtgcagtctgagggtctgaggccgatgatgtgctcccgcaccagggcaggattcaccttgaacattatcgacacccctggcctcattgaaggtggatacatcaatgagcaggctgttgagatcattaagaggtacgtacatgttgggcggtaacttgtttgcaagtgaataggcgattgtagatactgtaactttaaaaaaaaatagggcattgggtatccctccaccgtgac

SEQ ID NO: 221 - DNA, 209 bp, Lolium multiflorum
cgccgataccccgcgagtggactgggctgcagcagttcccggcggccacccagaccagtctgcacgagctcctcggcaagctcaaggaggaggtattccccgtctatcagccccctctttactacctagaccagctacttaatccaccaggactatgttctgatgattgtgtctgcgttgtgagttttgacgaaaattgatggaatttt

SEQ ID NO: 222 - DNA, 752 bp, Lolium multiflorum
atatgtatgtgtgctactgaatgatgtaatgggtgcatctgtatgatgccttgtcgatttggatatcacatttgggtttcccttcagactttaatttctcagatactgatcaggttaagccgccaatacatgcctgcttgtttgccttgtttctcttcagtttcctaagaagatagtctgttgagagtgtagttcattagattggcatctgtagaaaagttcatgctccttcgtaactggtcactagtgttgtgatacaatctgtatatcataataatttattcccctgcttgcatttacatgtaatcaatggtattgcaggtttcttctggagaaaaccattgatgtcctcctgtatgtggatcgcctggatacatatagaatggatacgttggatgaacaagttataagagccatcactacttcatttggaaaggccatttggcgaagaacattggttgtactgacccatgcccaactctctccacctgatggaattgaatataatgatttccttaaaagaagatcagattcgctgttgcggtacatccgttccggtgcaggaattggcaaacgagaatctgcggtaatgtacatattcacttgctatgcaatcatttccgtcatcctttatgcaatatcagaacaccatcatttatttgcaatttgtgtggagcttcctctgcgtaaactacatgtgttctgcaatttttcgtttgaaatactcttctggaaatactactccctccgtt

SEQ ID NO: 223 - DNA, 1242 bp, Lolium rigidum
ttatggaatctttgtcttctgtgtatgaaatatgaatattaattcttaatggaagcacattggtgtgatttatataggattatcccttgccattagctttggtagagaacagtggaaggtgcaagaccaacgagaatggcgcgaaggtttgtctgtttcatgctgtgtatttgacttgcatttggttgtccctaacttcttgatttaataaaggatttcatacaactgtgtccagattcttcctgacggaactccatggattccaaacctgatgaaagaaattactattgtcgtctcaaatgggagcaagtccattcatgttgatcagaaattaatcgatggtccaaaccccaacaaccgctggaagaagtacatacctctcatccttgcagtgcaggttagctcttcacatgataataattgcaaaatcccatcataaaattggcatattatttgtacagacagaactctaacctgatatccttggtgctcttgtccagtactttttcgttgtaaaagggatccgaagggcgattcattctgacattgcaaatgggaagctggatgactgggagcagcgttacagagacttggttggaagcggtaacccggtagacctgaaagtttcgtcatcccgcaatcccaaggcctgatctgttcaatgagagtgaacgccagtctcttcatcgtggcctgttcagctctccaccttgctgttcttttttgggctcctagttccagcggtctattttggaggctttatagagttctctgggacaacttgaataaagttgctagtgttttaggtgctaagtgtatgtaccccatttcattatgctctcccaattttgcaaatgttattgattaagcttagttatttggacttcttgtattgcttttacgttcagagttgagtgtggtttgactatctgacgtgagagcctgatgcccttgagctgtgccacaggcgcatagtctactcacggacagcatggccattagcactttggcaatatagtttctggaaggcatagcccttcactcaaaaaattgtgtgtttcagcttaatttttttgttgctagctttatgtttgtatgctctctatttgtgttaatggtctaggaaatagttatctcccaatcaaccaagttacgcactagtactagtaaaattactaggaaatacatatgtgcacacaagcatgagtgtgggtgttagagcatccccactcgttggcgctc

SEQ ID NO: 224 - DNA, 375 bp, Lolium rigidum
ctgttctgggttttacttatgtgtgggagtgcatccttatatatgttgtttctatgcagtctgagggtctgaggccgatgatgtgctcccgcaccagggccggattcaccttgaacattatcgacactcctggcctcattgaaggtggatacatcaatgagcaggctgttgagatcattaacaggtacggacatgttgggcggtaacttgtttgcaagtgaataggcgattatagatactgcaactttttaaaaaaaaatagggcattgggtatccctccaccgtgactgagaggctcgttgtatctggttactctgaattgaatgttctatttgtttcgtcaaattagcaaaatcgtttcattgcatttcttga

SEQ ID NO: 225 - DNA, 846 bp, Lolium rigidum
ttgtcgattttgatattatatttgggtttcccttcagacttcaatttctcagatgctgatcaggttaagccgccaatacatgcctgcttctttgccttatttctcttcattctcctaagaagatagtccgttgagaatgtagttcattagattggcatctgtagaaaagttcatgctcctttcttaactggccaccagtgttgtgatacaatctgtatatcataataagttattccgctgcttgcatttacatgtaatcaatggtattgcaggtttcttctggagaagaccattgatgtcctcctgtatgtggatcgcctggatacatatagaatggatacattggatgaacaagttataagagccatcactacttcatttggaaaggccatttggcgaagaacattggttgtactgacccatgcccaactctctccacctgatggaattgaatataatgatttccttaaaagaagatcagattcgctgctgaagtacatccgttctggtgcaggaatcggcaaacgagaatctgcggtaatgtacatattcacttgatatgcaatcatttctgtcattctttatgcaatatcagaacaccatcatttgtttgcaatttgtgtggagcttcctctgcctacatgtgttctgcaatttttcatttgaaatactcttctggaaatactactccctctgtcaaatacaaggccactaccaaaactatattatctactccctacttcactaattaggatgcctatagtttttagtcaaagtcaaaaaaaattacaactatatacacaaaaatatccacatctacaattttaaatgcacataatatgaaaa

SEQ ID NO: 226 - DNA, 337 bp, Lolium rigidum
gccacggtgcgccttgaccgaattgggttaacgtttctgatttgtccgggcgggcgcgaccttgtgccaggggaaagcgcgcggtgatggcggcgccgataccccgcgagtggactgggctgcagcagttcccggcggccacccagaccagcctgcacgagctcctcggcaagctcaaggaggaggtatattccccgtctatccgcccctctttactacctagaccagctagtcaatcgacctgatgattgtgtctgcgttgtgagtttggacgaaaattgatggaattctgtatgtttcgcatatgttgtgatgtttagaatgtgagcacattgac

SEQ ID NO: 227 - DNA, 2394 bp, Portulaca oleracea
  unsure (1)..(2394): unsure at all n locations
  unsure (1)..(2394): unsure at all n locations
aataattcgttcaaaggcgatgtcttgtagttttagtaggttctttttatcaatggtgggtggattattgccattcttaacttcagactcgcccatgtggccatgcaagctcaatatgtgggaagatacgatcattttggcatagtatattgcatcttgcttctagtatgctcaaattcttttccctttgacattgatttcagtccgaaggatcaaggcctgtgatggtttctagatcaagagcagggtttacattgaacatcattgacacaccaggtcttgtggagggaggatatgtcaacgaccaggctcttgagagcattaaaaggttagtgatggctggtattatgtgagaaaacttgtgctgttttcatgtatgctatgctactaacattactcgttatgattgcaaaactttatgcattgtgcttgctagtaacctgtcgataatttgtttgtagaagttacatttgtttgtggccttgtcaaccccagtttctccgagtgaggtggcttgttttcaggctgcttatagttgggctctacctcttttcttttttgttgttggtgggggtggggaggagataatgatgaatccttctttccaaatgtccttggtgattttgtagctgtagtgggctttaatccttgtgcggactctgcagtactcctccccctccctcgtgtaaaaagagggcaaccatcatgtatgtgctggggatagaggaagagagtttgggcgtgttccacatgcaaatgtagtatctgttgattactccctacatccaatattatttgtctttttgactaactttttttaatcctgtagtatatcagtatatgtcattttagaatccctatgacgtatttccaattattttatttatctacccaactttatcttttctttttcaattttatagactattctctgtgtaagatactcccaaaaacatccaaactacccaaccatgttttattggtttttgagcttttctctgaagtgacttataatgtgggatggagggagtaccattcaacaagtgtcttgccagtgggagtacttttcttcatctattcccagtggatccttccgctcccagtacctccttttcttattgcggcaattatcatatagttatttgaagtggattttctgctctactgtttaacttgtcgccaatgcctgttccagattgacaagtaggttagtctcctggacttccatttgcttaccacaacatgtactgcacgttttttttttttttttttttttttttttttataaattgtcatgtgatacaacctacatttttcctgtctgtatactggcaagctgtcaggtctgtatgtaccagtcatctgggatgaaaattggttcagggaacttgaaaaactctgaaataaggttatgatattattaggatgtgtttttttggtgtgaatcaatctcaaggaatattgtactttcttttgccctagtgttttgtagttgcaaacttgaaataggattgtactgctgttattcatatgatctgttcaatgtcgaattgttggctgtgtcgttgcaattatgatatcttattccttttgtcatgttacatctgttattcagttgtctggccaatctccccactgaagtgaatgttttttcttaaccttgtactgtacatttgttgggcagattccttttgaataggacgattgatgtgctgctttatgtcgatcgattggatgcctatagagtggataacttagacaggcagattatcagagctataacagatagctttgggaaaggtatatggaaccgtgctgctatagtgcttacccatgcccagctgtcgccccctgatggattgagttatgaagaattctttactaaaagatccgaggctcttctcaaagttgttcgtctgggtggccgcataaagaaacaggattcccttgtatgacctcgttctccacttatcattgactttcttgtaattcatgctttttcaagatgcttttgtgatttgtgttggttctttgactcatgagcttctaatggttacttttcacctttttttatttttaattttttataatttttcttttttaaaatggtctctactctctaatttttagcgcctattttacgtatcatgaccaaaatctctgtttaaaggcataggatatggtggtgtttagaaagaattcaggttacttttagacagcagttcttagccctgctcttttatacggccggctggctggctgcagcgccacaacacaccgcactttgccagaacccaccacaacatnnnnnnnnnnnnnnnnnnnnnnnnnnnnnnnnnnnnnnnnnnnnnnnnnnnnnnnnnnnnnnnttacatttataaaaaacaaaaccca

SEQ ID NO: 228 - DNA, 670 bp, Portulaca oleracea
acctccttgaccatcctcgtaatggggaaaggtggtgttggtaaatcttccactgtgaactcagttattggtgaaagagttgtagctgttagtgcttttcaggtaagcttacatcaggcttgtgtctgatgcttttatgcattttcttgctaagatgatccatcgaggggcctattactcatgggacactacactctagtatccaggattggctgtgcccttccaacttgttatactagaaccgatgtttgaaccctagtgatttaactgtgggtcaattattgctggaacatctctgttgggagttgaaagatatggatttcatgtcattcatttgggaattacacctagttgtcttttggtacagtcattttctctttaatatatatatatatatacacacacacgtaaatatatttatggttataggtgcttgcttgcttggcttttcttattttccttcttaaagcatctgaactattcccctgttaacattaccgatcaagatagaaatctacaaatgggatatgaagtgtctagtgactctgcaaagaggaaaagatttttgcttttgaagaagggtatgagtctctgctagcagataagggtgcttcaactgtgatgctaaatagctgaaatggtttgcatgaagttcaatgttaaggtggaa

SEQ ID NO: 229 - DNA, 2254 bp, Portulaca oleracea
tacggcagtaacgcccaagttaataaaaagaaaaaaaagatgagacttccgctgttaatgttagtcaacgtttgattttgaccgttaagtttagatctgaaatttccggggcgttacattggcaaacaactcatcaacttcttcttcgtcatcttcatcgtcgtgcttctctaagcaatattatgcttctgcttctgcttggtcatcttcgtcgtcgattgctgaactctttggactgaaggactacctgccttttgtgtcgtatgtgcattcgccatcttcttgttcttcccccaacataaaattggggaatgatatatttatcggtacgtacatttaaagttgaatttttgaatcaaattgttcaagattccattgttgttttctaggttgaagcttgagagttgcagaggagaagtgagaaggttgaagcttgatagttatggaatgggttggaggagagagagaggaaaaggggagatggtgaggtgaaagagaggaaagaagagagggtgagttggacaagtcaaatgctgactagatacagtcaaaacaaaccccttcggctgccacatcagatcgccaccgagttaggttcaacttaactcggtggcgtgttgatgggggcaacaagggctcaaagttcgcattattaaccaccaaatcaaaagttcgtattattaagttttatatggccaaaagttcgtattattagaattcaatttccctaaatgtattgtcatttatgtctgtaatggaacaaacatattatgagaaaatagtgaaaaagtagagactatcagtggtcgaaaagtcactttgtattattcccaatcacaagccgctcattatggattatttgtagtcaaaatttttttttttctgggtgtaaaatcgaaccccaatgaattaagtttaagtagacattttacctgctcaccttttgaatgtattttttaaaaataaaagtacaagcaatatgggtgtggaatgccgactcaaaactttgatatttgggtccactcagcaaagcaagtggggggttgtttgcgaggaagaggccgagacattgagctaggggggtctgtagtagtagtagttgataaggctatcggaagtagtaacctcctcggcgcaacaaaaatcatcagtaagggttttgcataaccccttatctctctctctctctcgagataccctccatcgtacctttacctcatcaataccatcctcggtgagtttcctctcccctcctccccttctcattttccaatttagggtttttctcaagctttcggaaacatttaatatcatgtgtcttttagggtttatgcgctactttttatagtgagtccccagttatgctttcaatggttatgttagacaaacattaaatctatctctaccaaatgcttcaagttatttatgggttttggatgaatttcaagtggccactgtatttttattcaattttgcgatagggttatggaaatatggaattgctttggcacttacgagatggaggttttcatttgttgttgaaattgtaggactttcataagaatttgttcacaagggtattagattatcccctaacagttgtgcaatatgtggttttttttttgcccccccccttctatttttataagaatggtcttcaacttcggtcttgtggtctcgttatccttaagttttatttcccgcaggttagaggtattagggtgcttatttaggtgaaagatgaggttcttatgttacaagtgcttgaaactttggtgggtttggcattaatttaaacgggcacagtaaatgagcctgcttttgcatttagtttcttagattgcttaggcatgcacaaagtggtaagtttcatctgtagtttgggagtttcgttgatatttttcagtacagtggaagaatttatccttcagaatgtccttcaatttatgattagttattttatgaagggccttcagcctaactgttcagcaatggttctatcgttttgagcaggttagaggtaaggatggcgacacagcttattcgtgagtggactggaattcagcagttccctcctgcaactcaaaccaagttactggagttgttgggaaaattgaataaagaggtattcatctatcatgtttacagataattgaacattttggatgaatggggtatgatgaatgtaatgtgttgaaatttgcttctctgttgtttgatgtagaatgtgacctccttgaccatcctcgtaatg

SEQ ID NO: 230 - DNA, 1875 bp, Portulaca oleracea
caccacaacttaccaataacacaccacaatccaccacaattccaccacacccgccacaatccaccacaccgcaccgtgccatactgcagccagccgtataaaagaacaaggcacagatcgttttgggtttctggtactatactttttaggattattgtgtgtatcctattttgatgtagaatagaaagtgctctctgatacaaactgttgtagaactctttttgttttgggactcagaattgatttaggtaccagttggggtcaaaacatgtcaatttctgtcgcaaaatgtttgcatttaaatgttggatttgttgaaaacttgaaatggtggtttgttttgtttttcctacataatgaagtttccctttaagacaaagtgagacgacattctatacaggttaatttaggctgttcctagtgtgaaacagatactttctctatagtgggcattttctcgtgttggtttgttttgttttgtttatttttatgcttgagatacctgttctctgactgtttttttggtgcctgttcatcttaggcttcctccatgcctgttgttttggttgagaacagtgggagatgcaacaaaaatgaaagtgatgaaaaggttgttttcactgtattttttttatgatacccttattctgcatcaatgaatgatgagttgatgattgcttacgcgaatgatagattctgcccaacggagttgcatggattccaaatctggtgcagaccattgtcaatattgttttaaatggaagtaagagcgttctggttgaccagaaactaatcgagggacctaatccaaatgagcgagggaaaatttggatacccgtgatattggctattcaagtaagctcctcatactaccttttctcgattatccttttggcttgaggcttgttgagttttgtttttgagttattaagtgaagtgttgtaagctattgaaaaacctttcagttgatttttgaccccatgcttctcgaatatgatgattggagggttcttaaatattatttttttattttttttattttttaaatttttgctcgtggcttccggcttaacattggttctgcagaatagtacttgggaagcatccagcccctcacgatgattgcacatgatttgtggtgaagggtttagtagtttgtgagggggttttcaaagcctgctaggtcaatcgtggaatgagtttcatattttgcttctgaatatgcttattttgcttatttgttatttcgttagatgatgttgtctaaaggtaatagttagtctcgtaacttggtttactaatggtggtagaatatttttcttttactgggcaaatttttcccagggaagggtatcttacagagttacagtgttcgctttacatttgaattcctggaaaaatgatatgaaatgtccaaactatccttagtttccaatcctgttgaaaaatgtcccttaacaacccccctccccccaaaaaaaaagaaagagaaattctgagttggactgtggaatattgggtcccatgtgaaagtcttttcccatccattaaacacaaccaaactaagggaaacctaatcaacttttaggaaagttgaccagaccaaaatgctccatgagattatcccttgttgtgagccccatcctcatgagtaatgatctggagttatattcgtaagtagtatgttgtcgtgaatatattgtttcacttctctgtcccattttggaacatgtacggagtcgactggtttctaagataatcttgtaaaagatctgggtttaaataccagctacatccaccctttgtggcatcttttcaagactggtttctcatgctgtttcagcttgacaaccactttatgtgtgacatttctgg

SEQ ID NO: 231 - DNA, 1389 bp, Senna obtusifolia
aacaaacgtctgacggataagccgataagggggtacagtgcgtagctgcaattctcaactatcctcactcaccaccgagaaattttgtttaggggaacatccagaaatgggatctcaagcaatccgtgagtgggcaggaatcaatacatttgcacctgctacacagacaaaattgcttgaacttctgggaaaacttaaacaggagaatgtgaacactttgaccatacttgtgatgggaaaaggtggtgttggaaaatcttcaatcgtgaactccatcattggtgaaagagttgttgctattagtccttttcagtcggaaggaccaagacccgtgatggtatcacgatcaagggcaggatttacattaaatgtcatcgacactccgggtctcatagaaggaggttacattaataatatggcacttgatataataaaaagtttcctcttgaacaagaccatagacgtgctgctttatgtggaccgtctggatgtatatagagtggacaacttggataagttggttgccaaagctattacagatagttttggcaaaggaatatggagcaaagctctaatagcacttacacatgctcagttttcaccaccagatggattgccttatgatgaattcttctcaaaacgatcagaggctctcctgaaggttattagatcaggtgcccggttaaagaaagatgactctcagaaggattctactattcctgttgttttggttgagaacagtgcaagatgcaacaagaatgaaagtgatgaaaaggttcttccaaatgggactgcctggatttcttggttagtccaaacaatcacagaagttgcattgaatagaagtgagtccattcatgttgacaagaaattgattgacggaccaaatccaaatcagagtggaaagttgtggattcctctcatctttgcgttgcaatacttctttgtgatgaaacccatagaaggattcatcaagaatgatattgcaaatgagagtaggccatcatgggaaacattcgagtgatgccaatgccggtcggttttcgcaggaaagatctgtttaagctatgcaccttttttctgtcattaaatttagttgttgtttagcttccagtgagatgactttgttgatttccttagacttcgattgctagaccaagtagtgtgcggctggacaatttgttactgattttgagaggattgcattttgtatgctgggtcggtttaagctgttttccatttattaatggaactaattaattgctttagttctttttcttgtgggtcatgctatcaatatttttggagtgttgattcaaatggaaattcatagtgaactgtgaatgtatgtatggttcttaatgaaaataatagaacacgttaaaagtc

SEQ ID NO: 232 - DNA, 1927 bp, Sorghum halepense; identical to SEQ ID NO: 145

SEQ ID NO: 233 - DNA, 5129 bp, Sorghum halepense
atcgactaacaaggatgctgatggtgatgatgtggtggctcttggaggtgaagaagccccagaagaatcgactaacaaggatgctgatggcgatgatgtggtggctctgggaggtgatgaagccccagaagaatcaactaagaaggatgctgatgtagcagacgaagccaccaagcctgagccaccgagtgaggcaagtccagtggtaagtgagcatcctgaatctgattttgttgctagtagtcttgatgctagtggggatgtaaacaattcaaatgttatactgacccaggttctgaatgatgaaagcatagaggagcttgctcctgcaactgctgacagtgtgcttgaggatagtcctgagaaggagcagaatgctgatgaccagaccactgccagtgaagtggtggaagatgttggtgtcgacaagcccacagaggttgagaatgttgctgctcctagtgctgatggtatcttgtctcgagagttggctccagaatcaagcaatgaaaataatggtgctgatgagattgaaggcgccactgaggttgttgatcgtgaagaggaggctgctgacaatgacataattgaggttgtgccatatgatgaggatggggttggtaatgaggctgacgacgatgatgacggggcgaactctgacacgagtcccgcacgggttgcaatcttagagagctccgaggccgcgaagcagatcatgaaggagcttgcagaaggctctagtggtagtgtctcaagagacttcaccaatagcatggatgggcagattatgcttgatgattctgaggatgacgaggatgatgatgataatgatgatgcggatgagaagggatttgattctgctgccttggcggcccttctgaaagcagcaaccggtggatcctcagatgggaatatcacagttgcttcaccagatggttctagaatattcaccatggaccgacctgctggtcttggttcatcagccccttctctgaggccaactgcacctcgccaacctgcccggtcaaacctattcagcccctcggagctagcagttactgctgaccctacagaagagatgacagaggaagagaagaagctacacgacaaggttgagttgattagagtaaagtttctgcgtctggtttacagactaggagctactcctgaagaaacggttgcggcacaagtgctgtaccgtctgagccttgctgagggtatccggcatggtaggcagacaaaccgagcattcagccttgataatgcgcggaggaaggccttacttcttgaagcagagggaaaggaggaactgaacttctcatgcaacatacttgttctaggaaagactggagttggcaaaagtgcaactatcaactctatatttggtgaagaaaagtccaaaactgatgccttcagctcagcaaccactaatgtgcgggaaatcattggtgatgtggatggtgtcaagattagaatcattgatacacctggccttcgacccaacgttatggaccaaggatcaaacagaaagattcttgctgctgtcaagaaatataccaagaaatgtccgccagatatagttctatatgtggatcgtctggatagtcttagccgtgatctcaatgatttgcctcttctgaagaccattactgctgttcttggctcatccatatggttcaatgccattgttgcactcacacatgctgcctctgcacctcctgaaggcctcaatggtgctcccatgacatatgaggtcttgatggctcagagatcccacatcatccagcagtccatcaggcaggctgctggagatatgcgcttgatgaacccagtagcccttgttgagaaccatccttcatgcaggaaaaaccgtgagggccagaaagtgcttccgaatggccaaagctggaggcatcagatgctacttttgtgctactcctcgaagatattatcagaagccaactcacttctgaagcttcaggatcctaatcctggaaagctttttggcttccgcttccgctctccacctcttcctttcttgttgtccactcttgcagtctagagcccacccgaaactttctgctgagcagggtggcaatgaaggtgattctgacattgaattggatgagtattctgatgtagaacaagacgatgacgaagaagaatatgatcagcttccaccgttcaagcctttgaccaaagctcagcttgcaaggctcacaaaggagcagaagaatgcttattttgatgagtatgactacagggtcaagcttctccagaagaaacaatggaaggatgagatccgcaggttaaaggagatgaagaagagggggaaaactgatctggatgactatgggtatgcaagtatcggtggtgagaacgatcaggatcctcctccagagaatgtatcagttcccttacctgacatggtgctgcctccttcatttgactgtgacaatcccacataccggtaccgctttctggagccaacttcgactgtcctagcaaggcctgttttagatgcgcatggatgggatcatgactgtggttatgatggagtgagcgttgaagagacactagctatccttagcaggttcccagcaaatgtagcagttcaggtcaccaaggacaagaaggaatttagcatccatctggactcttccattgcagcaaagcatggagagaatgcatcatcgcttgctggttttgatatccagactgttgggcggcagcttgcatatattctccgtggcgagacaaaaatcaagaatatcaagaagaacaagaccactggagggttctcagtaactttcctgggcgacattgtggcaactggactgaaggtcgaggaccagctctcccttgggaagaggttgtcactagttgccagcactggcgcgatgcgagcccaaggggacactgcatatggagctaacttggaggcacgtctgaaggacaaagactatccgattggccagtcgctctcaaccttgggtctctctctgatgaagtggcgccgggaccttgctctgggcgcaaacttgcagtcccagttctcaatcggaagggggtcgaagatggcagttcgacttggtctgaacaacaagctgagtgggcagatcactgtcaggacaagcacctcagagcaggtccagatcgcactcctgggtctcataccggttgcagcctccatctacaggagcttccggcccagtgaaccgtcctttgcttattagcttgtctggaggagtcccagtttaattatttcataaccatatcgtttctcttagcaattttccttttcatatgaaccatgtttccttatgttttagttcactctgtaattcctatcataattttggctgaagagggttgtgagatttatctggaactatagctgaataaataatgccgcgggatgtacggtccttgtggttaccaatctgttatagcgtttttaagtctgttctgattattcttgtgattatcaatctattagtgtttctaagtctattctggttattctgtgagtactactgctttgctactaatgctgatgttgacatgttatgatattactgggagtagctggccgagagcatgcaatgtatctagctgtccctatggtctttgagataatctattagcacacattggtgatgcgtcattgtatctagctgacccagaattggtgatgtttctatttaggagcacatattcctgcatttgcatcataatattgaagacctgaactcttggcacacatatcagtagttgaggtgcattgtttctgtatcagtttttttagacgctatccatggtgcgtcattggtttctgcagaaaacaacagtccagcaagtttctgcagaaaacaacaatcctgctggacgtggaaacaggagtggtagtagcaaatggattcaccactcacctgactagctagcccttctcttttcttttctttaagatggtttgcatggctagtttgcagaaaacaacaatctctagtttgcagttttgcaatgtctccgttcctgtgttttttgtgaactcgagaagttctcaatatggcaaaattgcacacctgatgaaacggtgcatcgatagatagatgggccgctgatccgaagtagtaacagggaaggcgtgtgtattgggaatttagccgaggccttgcacgtgcgtctcagcagcttcctgggctggctcatttttttaaggccagagaaagagtttaatcatcatagggtctgccgaaacaatttgaaggccagagaaagagtttaatcatcgtgaagttgaagaaagcatcaaacagtcaatggcggagcttagcgaggaccatagtgtgatagtgggctagggccaagtaatggaatgacaaaaaaaaactagtgaagcatgaaaacctcaattgtttgcagccatactagcataagcacatatattatcatgtcagaccataaacacttcaattgaggaaaattgaatgcccataacgcaagatttcaacttgcaaaggattttaactaattaatatgaaagaatccattttgtgttgcttcatgaagttgtcaactgcggcaagcacaagagcgatgtattactcgacctgcggggggtaagacagcccccgggcattgcattaagaagaagatcttctcacgcaggtcgagaaaacccccgaacctctgccccacccatacacagcggcaccgtagcccatgtgagaacgaccaacgaccgggaccggaccttagacctgtgctttggcatgggacagacgaggggagttttttaaccttagcctgaaaattcgctatcatagctgaaatctatttagaaatcatttttttggggttatagaaatgaaaacagctttgcacatcactttgattggtagacgatgaaaatgaacaaagcaaaactacaataatatgggtcatttgttactagaaatacattttttagaatacttccatggagaggttggtactctctagactaccaattgtttataaatctatagtactccaattgataggacgagggcatttattcaccttgggatcaaattcttgagtctgtttctagatgatgcaattagatctaacgaaatgagggcatc

SEQ ID NO: 234 - DNA, 7430 bp, Sorghum halepense; identical to SEQ ID NO: 147

SEQ ID NO: 235 - DNA, 6412 bp, Spirodela polyrrhiza; identical to SEQ ID NO: 148
  unsure (1)..(6412): unsure at all n locations
  unsure (1)..(6412): unsure at all n locations

SEQ ID NO: 236 - DNA, 477 bp, Taraxacum officinale
agagctattcaattcctgttggtttggttgagaacagtagcagatgcaacaaaaatgaaaaagatgaaaaggtttactttttacttttattcttgactattcatgcattttaattttgttaattttgacttttgtttccttttatttacggtcacagattcttccaaatgggactgcttggattccaagcatagtggaaacaatcacagaagtgagtttgaccgaaagcaaaagcatattggttgaccagaagttgattgatgggcctaaccctaatgatagagggaaactattcattcctctaatcctagcctttcaagtaagtatatatataatcttcacttaatatatataatcctagcattcctctaaccctaattgtgtatgatgacagtacttttttgtggtaaaaccgcttcaaagatcaatcaagaatgatgttcagaaagaggtaaagcctttgtgggcatgagcaac

SEQ ID NO: 237 - DNA, 202 bp, Taraxacum officinale
ttttacgaactttcaggttcaatggcccgtgaatggacagggattcagctctttcctcttgcaacccaaacaaagttgttggaactactcggagatttaaaaacgaaggtctgaatctataaattgtttctctttactaacaattactcccagtaactaattttcaagctatatatatatattcaactaattggcttctctt

SEQ ID NO: 238 - DNA, 978 bp, Taraxacum officinale
tttgctacaattattgggaaaactgaagaagaaagcccatttattttcctaatttcatctatatattagaagaaatattaaataaaattaagattatgtaattcctgttcgtgcaaaaaatgcagaaaaatgataggttaatgatcattgtaatggggaaaggtggagtttgaaagtcttcaactgtgacctttatctttggtgagagagcagttactatcagtggcctttcaggtacatagaaagtttctaaagatttcttttagacttaatttgttatatttgttgaattgcttataatacaataaggatttttgtagtcagaagtattaagacctaatatggtttcgcgacaaaggtcaatgttcaaattgaacatcattgatacaccgggcattatcgaaggatgatatgttaatgaccaatcccttgagatcattaaaaggtcatttttactttactggattttagtataatgatacgactgaaaatttatctcttaaaacaaatttgattttagtataattatacttatggaaacttgaaatatgtgacatttgttgactatttttgtaggaattatatcgattaatttggaataatatgtggattatatcgcaggggcaatgggatggcaataacaaagaactagactgaacttgcttcaacataaagaattgatcaggcattaatgcaaaactggactaaacctattttagtagatgattaaattattaaggttgctgtgtttctccattatttcactatgaaatttccatatgaggaagttatttccaaattcaaaattgagattaaaaaaaaatgaagatgcaatctggcaggtttacacacacaactcccccctcccaccaccatcgccctttattctaggattcttttgtacttttcggtttccaattctaaatattttgtattttgatatgttctttgtttacaggttgttccatagagaggtaa

SEQ ID NO: 239 - DNA, 494 bp, Taraxacum officinale
ttcaaatcacaactttcatctcatttctataatctttcagtcagatgtaccaagacccgtgatggtatcccgttcatggtctggattcacattgaacatcatagacacacctggcattgttgaaggaggttatgtcaatgaccaagtccttgacctcatcaaaaggtcaaagtcaaaccaacatcttcatcaaatcaagttctttactttttatgcaacaaatggggtttcactaaagatttgtgatttgtttttttgcaggtttcttttgaacaaaacaatagatgttttgttgtatgtggaccgtttggatgcatatagagtggataatttggataaacagattgtgaaggcaataacagagagttttggtaaagagatatggagtaaaggaatggtggtgttgacacatgctcaacttacaccaccagattgtcttagttatgatgactttttttggaaaaagacctgaagctcttttgaaagttgttgaa

SEQ ID NO: 240 - DNA, 498 bp, Trifolium repens
atgatgaaaaggttgacatttctttctttagtaattgatcatagtccttttacttagttttggctgaccttaagtgtggttgttttatgacaggttcttccaaatgggattgcatggattcctaatttggtcaaaacaatcatagaagtggccatgaatggctgcaagtctatttctgttgataagaagctgattgaagggccaaatcctaatgagagaggaaagcgctatatacctcttatacttgcattccaagtaagctttaaatatagaattttatggtcatccttcttatcttttggttaagaatatatatactgtaatatacccctactcatttttgatatttttaagttttagtgccctcccatatgctcttcattgcttgctttgtttgttgcgtgtgcaagggttgttaaaacacattggctcttaatctctctatctttgtttatttgtgaacagtatttctttgtgataaagcctatacaacgatca

SEQ ID NO: 241 - DNA, 2704 bp, Trifolium repens; identical to SEQ ID NO: 154

SEQ ID NO: 242 - DNA, 325 bp, Trifolium repens
ggagaagatacacaatatacagaccatatgtgtgaaattcttgaggcttatccagcgagtaaatttttctcttgaagattccttggtctcaaaagttttatgcaggttggttgcagatattggacggcgctcaaatcaagaatttgtcattagttcagcaaaaatattagcaaagaagcttgaagaagattctgaagatgatttagacttttctttgaacattctggttcttggcaaaagtggggtgggaaagagtgcaaccattaattctatttttggtgatacaatggttatgacagacgcatttgaaccttccacaacatct

SEQ ID NO: 243 - DNA, 700 bp, Trifolium repens
tattgcttcctctaaaataatagagttatgtccagcttgtctcttgttcttttgtttcaatttagtgttaatgttaataattgttaatttattcaatgttaatgttactaattattaatttattatttgttgcttttcacaaacactgggcgtgtaattcataattttcatgcttctattttgcttttctcttatccctaggctactgccattccgatagttttgatcgaaaacagtggaaggtgcaacaaaaatgagagtgatgagaaggttggagatttggctcatggcattttctcttgtatcttcctttagcctatttatcttgctcaatctgattgagaaaatgtgttcatgatgacaggttcttccaaatgggattgcttggattcctcatctagtccaaacaattacagaagtcgcattgaacaaaaatgagtctattttggttgacaagaagttgattgaaggaccgaatccaaatcagagaggaaagttatggattcctctcatatttgcagcacaagtaagcatttgaactttgagacatatcttgttttctctttataaatgactggagattcttcttgtttactttattcttcttgtttgcagttcttcttaatcatgaagcctatagaatcgatgatcaagaatgacattgctaatgaagaaaggccctcatgggagacgcgtgatg

SEQ ID NO: 244 - DNA, 285 bp, Trifolium repens
actagtgcccttggtccgtcaatatggcgaaatgtgattgtcactctgactcatgctgcctctgctcctccagatggtccttcaggctccccactaagctatgatgtatttgttgctcaaagatctcacattgttcaacaaactattggacaggctgttggtgacctacgtcttatgaatccaagtttgatgaatccagtttccctcgttgaaaaccatccttcttgtcggaaaaacagagatggccagaaggtgcttcccaatggtcaaagttggagacctcta

SEQ ID NO: 245 - DNA, 212 bp, Trifolium repens
tctagacaagaccatagatgttctactttacgtggatcgcttagatgcgaatcgagtatacaacttggacaattggttgccaaaggtataactgacagttttggcaaaggaatatggaacaaggctatagtagcactcacaatgcccaattctctccacaagatcacttgccttatgatgaattcttttcgaaaagatctgaggctctcttg

SEQ ID NO: 246 - DNA, 478 bp, Xanthium strumarium
cccaacatagtggaaaccattaacaaaagttgctacaaatgaaagtcaaagcattctggttgaccagaagttgattgatggtccaaatgcaaatgaaagagggaaagtgttcatccccgtcatcttagcattccaatacttgtttgttaaacgagttcagaagtggatcaagaatgatatagctaaagaaaccaagtcttcttgggactgagtagggtttcatcagtgaattattttaacatggtcttaatttagatgtctttttgtcgattcagtgattttctagtgttacatgttatgttctaagccatgatttaagtttgctacgaaaaataatgcttgaggtacccatgccatgatttacacatagcgttgttaagttgagggactgaaactgtgcattttgttagtctcatggatgtgttttgtcatatatgtttctgaagcaacacatgattttattaataatcaattcggg

SEQ ID NO: 247 - DNA, 757 bp, Xanthium strumarium
catcagagctcttatcaactcagtacgtcatcactctccagtctccgttttcatggcgtctcagttgatccgcgaatggagtgggattcagcaattccctcctgccactcaagacaagctgcttgaactgttgggaagactaaaggaaaagaaaagggacaaactgacaatccttgtgatgggaaaaggtggagttggaaaatcttcaactgtgaactctatcattggtgagagagcggttaccgtcagtgccttccagtcagaagcaccaagacccgtgatggtttcacgggagcgttcagggttcacattgaacataattgacacaccaggcattgttgagggaggatatgtcaatgaccaagccattgacatcatcaaaaggtttcttttgaacaagacgatagatgttttgctgtatgtggaccggctagatgcatacagggttgatacactagatgggcaggttgtgaaagccataagcaacatttttggtcaagaaatatggcatagagcaattttagtgctcacacatgctcaagtatcacctccggatagtctaacttacaatgagtttttgtcaaaaagatctgaggctcttctcaaggttgtacatcttgctgctaggttcaaaaaacaagatatcgagagcatttcaattcctgttggcttggttgagaacagtggcagatgtaataaaaatgggaaagatgaaaagattcttccaaatggtattgcttggattcccagcatagtt

SEQ ID NO: 248 - DNA, 2221 bp, Abutilon theophrasti
ggaggtggcgggggcaattctggtggaagcggcggtggaggtggaggaggaggtggttccggtggcggtgacggaagcagtggcaatttctgggagaagttcttttcgccttcgccagcaattgcggacgataataaccaaaatcaagaatgggattctcacggattaccagccaacatagtagtccaactcaacaagctaagtgggttcaaaaagtacaagctttctgaaattttattcttcgaccgacggcgatggaccacggtaggaactgaagattccttctttgaaatggtttcgttgagaccaggaggggtctacaccaagacccagttacagaaagagcttgaaactttagccacatgtggaatgttcgagaaagttgatatggaaggcaaaaccaacccagatggaactttgggattgaccatttcgtttacggaaagtacttggcaacaagctgacaggtttaggtgtataaatgtggggctaatgactcaatccaagcctatcgaaatggaccctgacatgacagataaggagagattggagtattatatgagccaagagaaggattataagagaaggattgagagagctaggccttgtctgttgccaatgcgagtgcacagagaagtattgcagatgttgagggaccaagggacagtgagtgctaggttgctgcagaagataagggatagggttcaaaaatggtaccatgacgaagggtatgcgtgtgctcaggttgttaactttgggaacttgaatactaaggaagtggtttgtgaggtcgtggaaggggatattacacagcttgtgattcaattccaggataagcttgggaatgttgttgaagggaatactcagcttcctgtcgtgaggagagagttgcctagacagcttcgacaaggcaatgtttttaatattgaagctgggaaacaagccctaaggaacataaactcattggctttgttttcaaatatcgaagtgaacccacgacctgatgagaagaatgagggaggcatcattgttgagataaagctcaaagagctggatcagaaatcagctgaagttagtacggagtggagtattgtacctggacgtgggggacgtcccacattggcttcaattcaacctggtggaactgtctcttttgagcatcgaaatctcaaagggcttaacagatccgttcttggttcattgaccaccagtaactatttgaatcctcaggatgatcttgctttcaagttagaatatgtgcattcatatttagatggtgtctataatccacgcaaccgaacttttcgcgcaaactgctttaacagccggaaactgagtccggttttcactggtgggccaggagttgatgaagtcccaccaatatgggttgaccgagctggtgttaaagctaacattacagagaatttcacccggcagagtaagtttacttatggacttgtgatggaagagataacaacacgtgatgaaagcagtcatatctctgcaaatggtcaaagagtgctgccaagtggaggtatcagcgcagatggacctccaaccacactaagcggtaccggtgttgatcgagtggcatttctacaggcaaatatcacacgtgataataccaagtttgtaaacggtgctatagttggtgagaggaatgtgttccaggtggatcaaggacttggtattggcagcaagtttccattctttaaccgccatcaactaactcttacaagatttctccaactaagacaagttgaagaaggtgccggtaaagccccaccgcctgttctagtccttcatggccattacggaggatgtgtgggtgaccttccaagttatgatgcttttactcttgggggcccatattctgtcagaggttataacatgggtgagttaggtgcagccagaaacattcttgaggttggagcggagctaaggataccagtgagaaatacacatgtttatgcatttgcagagcatgggaatgatctaggaagttcaaaagatgtgaaggggaacccaacagaagtctataggcgaatgggacagggttcatcatatggggttggtgtcaagctcggtctagtgagagccgagtatgctgttgaccataacaccggaactggtgcagtattcatcagatttggggaaagatactaaaaagtgagatagggttgaatcagtatggatggtacaaatcttagtttttggtaat

SEQ ID NO: 249 - DNA, 347 bp, Abutilon theophrasti
taccttcagttatagagttgctaagtatgcctatttgttcagtgtctgaaatattgtattcttggttcctgatttatgtaactagtttcgctgttactggtcattggtgattaattgtaaatttatgtctgcttttttggtttacagcttcgacaaggcaatgtttttaatattgaagctgggaaacaagccctgaggaacataaactcacttgctttgttttcaaatattgaagtgaacccacgacctgatgagaagaatgagggaggcatcatcgttgagttaaagctcaaagagctggaccaaaagtcagctgaggtcagtacagaatggagtattgtacctgg

SEQ ID NO: 250 - DNA, 285 bp, Abutilon theophrasti
ctgatgagaagaatgagggaggcatcattgttgagataaagctcaaagagctggatcagaaatcagctgaagttagtacggagtggagtattgtacctggacgtgggggacgtcccacattggtatgcaaatctagttatatattctaccttgcaatttcgcttgtagattataagagatagtagcttaaactttaaatttgttatttatattgtttgcatattgtgctatgtcttcttttcaggcttcaattcaacctggtggaactgtctcttttgagcatcg

SEQ ID NO: 251 - DNA, 1860 bp, Abutilon theophrasti
ccctaaaagacccttgaaaaaaaatgcattctttcgctgccctatcatcccacccccttcccttttccaaccgccggcaatggtcggcttcttcctcacgcgcttcccccacgccccaccaacattaaatgcctcctcccttcttttcgaaaccctgaatcccaaaagttcacttccctctttaaacccctcgcgcttgcctctgtctccgctgccactctccttattcgcatcacccccatttccacccttctcagtggaggtggagggggcaattctggtggaagcggcggcggaggcggaggaggtggttccggtggcggtgacggaggcagtagcaacttctaggagaagttcttttcgccttcgccagcaattgcggacgataataaccaaacccaagaatgggattctcatggattaccagccaacatagtagttcaactcaacaagctaagtgggttcaaaaagtacaagctttctgagatcttgttcttcgaccgacggcgaggcaccacggtaggaactgaagattcattctttgaaatggtttcgttgagaccaggagggatctacacgaaaacccagttacaaaaggagcttgaatctttagccacttgtggaatgtttgagaaagttgacatggaaggcaaaattaacccagatggaaccttgggactaaccatttcttttgcagaaagtacttggcaacaagctgaaaagtttaggtgtataaatgtggggctagtggctcaatccaagcctatcgaaatggaccctgacataacagataaggagaaattggagtattatatgagccaagagaaggactataagagaatgattgagagagctaggccttgtctgttgccaatgcaagtgcatagagaagtattctagatgttgagggaccaagggacagtgagtgctaggttgctgcagaagatcagggatagggttcaaaaatggtaccatgatgaagggtatgcgtgtgctcaggttgttaactttgggaacttgaatactaaggaagtggtttgtgaggtcgtggaaggggatattacacagcttgcgattcaattccaggataagcttgggaatgttgttgaagggaacacccatcttccagttctcaggagagagtgtcctagacaggtagagttgatgctcctttcttggtttttattttttattttctgtttaaaatgtttaagggtagtttctgagccactgagaaactagttgagagccaccttttgcactctaatagttactcttatagtctttgaccttcgatgctacttgggttaggtttgatctctacttcaattatacaactctagaagcatatcgttcattgtttattcagaaatagctcgaaaaggaatctgataaaaaaatggtaattggctgaacattaagtggcagatcaaatgttgaaggatgatgggggggggacaattatgtgaataacaagtaaaacacagaatttgcttcttttgaataagctctcacaaaccatagatttgatctttggttgattgaaatgtttggtttcatactcccgtggatggattgtttagtttgtaccttcagttatagagttgctaactgtgcctatttgttcagtgtctgaaatattttattcttggttcctaatttatgtaactagtttcgctgttactggtcattgctaattaattgtaaatttatgtctgtgctttttgggtttacagcttcgacaaggcaacgttttcaatattgaagctgggaaacaagccctgaggaacataaagtcacttgctttgttttcaaatattgaagtgaacccacgacctgatgagaagaatgagggaggca

SEQ ID NO: 252 - DNA, 3087 bp, Abutilon theophrasti
gcaaatatcacacgtgataataccaagtttgtaaacggtgctatagttggtgagaggaatgtgttccaggtaagcccatatattttgaatgtgctgatactgttcaatatcatgaataaggtgactgcattgtcattggaacatttgcttgaaatatcttgttttgtgtgttgttgaaatagttcaaatgcataagcttaaacttactactaataagtgatcctattcataaatctacacttgatttgaaaatttgttccctagctaattgccggcatttatttatccaatgcagttggatcaaggacttggtattggcagcaagtttccattctttaaccgccatcaactaactcttacacgatttctccaactaagaaaagttgaagaaggtgccggtaaagccccaccgcctgttctagtccttcatggccattacggaggatgtgtgggtgaccttccaagttatgatgcttttactcttgggggcccatattctgtcagaggttataacatgggtgagttaggtgcagccagaaacattcttgaggtaagaatgattggagatacctttaaaatcttttgtttagcttttagtgccatcataattttatgttgtatttccagaggagtctaaattaatctgaaatccattttctgatgtaaccctgcaggttggagcggagctaaggataccagtgagaaatacacatgtttatgcatttgcagagcatgggaatgatctaggaagttcaaaagatgtgaaggggaacccaacagaagtctataggcgaatgggacagggttcatcatatggggttggtgtcaagctcggtctagtgagagccgagtatgctgttgaccataacaccggaactggtgcagtattcatcagatttggggaaagatactaaaaagtgagatagggttgaatcagtatggatggtacaaatcttagtttttttttggtaatatatgagtttaactggtggtaataaatttgaattttgagttattcgaattatttgaatcaattcgaataaattttcaaatttcaatttttttcaattcgaaaaattgaataaatccaattttaaatcgatgtaataactcattggatttttgacaagtttagaaatgtgcatattagtctttaattattaaaaaattaaaataatcttcaaaaaatttaaattataaaattttttaaaatcatttaaaattactaaaaaatgaaaatctatattccaaattaataaatacaaaagtcattttttgtcactgtcatacaacatatagttttatttgtatttttttaatttaatttggataaaaaatttcggacaccagttataacaaaaagatattgcaccgaaaattttctgagacaccagctataacaaaaaaaaaatatatttacaaaggagtttcacattgtaactttaaaaaaaattatcaacgtataaaaactaccaagggcatatcattgctttgcccggctttaaaatgaaccagaccctcctttaccacaagtactaccagcaacaggtgaagcaagaaacaagattctctcctttagcccctgttatatgtcaaggatgcttacggataagtgcaaaggtgagctccttcactgtgataaactactccaaaacggggaccaaccccaactatatatatttaaaaaagcataagaataaagtagcagagatccatttgttaatttctttcctgaaaatatttcaatcgttaatcattcatgacgtcacaactcaacgtgttggaactagaaatggccattgccgttatggaaaggtcaattttcctcacatttttacttcatctaaagagcttatcaacacgtgacgcctgtcttatccatggtgtttaattgcaagttgtggaactaggtgaaccacaatttcctttcctgtccaaaacagagcagaaatttccccaaaatagaaactttaagaaataaatgtcttgcccgattcgacccattcccaacaaactcttacttttgactgtatcataactctcaatgaatttttttgagtaaaacgtttccatttttcactggttaatcaaattgtacagaccatttggtataacaaatagccaatcatgaggacaagtttctctcattgtgtttttagcaggccagttagccagcttgtttctttccctgttaacaaatctaaacataaaattacaatgcattgttttttaggcttaaatgtccttgatgattgaatcaacttcccacaaaatagctatttctccattaatcatttgaattgcagtttgacaatctgattcaaaaatgacgttctcccagctgtgttgctcggctatacacaatctcaacctcaatgcgagacactcagctacaaacgctttcgtagaaattatttgttcgttggatctgcctacaactatccattcgctattacgggcaacgactgcgattccagcaacctgagatgatttcaagaacgaggcatcgcaatttacctgattgtatttgcatccggtggttcccaaccttcgatttgcctagcgaccgaccctctgttatcattttgcaagttaattgctgatgttgacaaactcacattagcttgtttgtattcaaaatgttgtgcttcaaccgacaaccagacttttattggatcaaccttttcactttcaaaaaccattctgtttctagtctttccacccccacccagtgcaagccaataatcccaagtcgattccgccggcaattctctcgttcattttcaccatggctacccaccactctaaaaaagatatgaaaccaattgttgatggtgaatagttaaacatcgaagctctccaaattaccatagacatcggacaaaaaaatattgcatgctcgagagtttcctcatgttcatcacatcggctacaacacgctatccgagatcgatgtcttttttccattgcttcatttgttggaattacatcatgacaggccttccatataaaatttctaacttttggaagacatttaaggtcccatatagctgaccataatttcccattgttgctcgatgatagact

SEQ ID NO: 253 - DNA, 3228 bp, Abutilon theophrasti
atactaagatattcatgttctgttctttaggatgatcttgctttcaagttagaatatgtgcatccatatttagatggtgtctataatccacgcaaccgaacttttcgcgcaaactgctttaacagccggaaactgagtccggttttcactggtgggccaggagttgatgaagtcccaccaatatgggttgaccgagctggtgttaaagctaacattacagaggtaatcttccgtacttaaaaaaattcatgaagtaacttttggactttatgtgcggtcaaatatattgtgatcaatatgtttctgggcagaatttcacccggcagagtaagtttacttatggacttgtgatggaagagataacaacacgtgatgaaagcagtcatatctctgcaaatggtcaaagagtgctgccaagtggaggtatcagcgcagatggacctccaaccacactaagcggtaccggtgttgatcgagtggcatttctacaggcaaatatcacacgtgataataccaagtttgtaaacggtgctatagttggtgagaggaatgtgttccaggtaagcccatatattttgattgtgaatagtgttccatatcatgactaaggtgactgtcattagaacatttgcttgaaatatcttgttttgtgtgttgttgaaatagttcaaatgcataagcttaaacatactaataagtgatcctattcataaatctacacttgatttgaaaaattgttccgtagctaattgccggcatttatttatccgatgcaggtggatcaaggacttggtattggcagcaagtttccattctttaaccgccatcaactaactcttacacgatttctccaactaagacaagttgaggaaggtgccggtaaagccccaccgcccgttctagtccttcatggccattacggtggatgtgtgggtgaccttccaagttatgatgcttttactcttgggggcccatattctgtcagaggttataacatgggtgagttaggtgcagccagaaacattcttgaggtaagaatgattggagatgcctttaaaatcttttgtttagcttttagtgccatcataattttatgttgtatttccagaggagtctaaattaatctgaaatccattttctgatgtaaccctgcaggtcgcagcggagataaggataccagtgagaaatacacatgtttatgtatttgcagagcatgggaatgatctaggaagttcaaaagatgtgaaggggaacccaacagaagtctacaggcgaatgggacagggttcatcatatggggttggtgtcaagctcggtctagtgagagccgagtatgctgttgaccataacaccggaactggtgcagtattcttcggatttggggaaagatactaaaaagtgagatagggttgaatcagtatggatggtacaaatgtaaggttttttttttttgtaatatatgagtttaattggttgtgaacaaaacttagttcaaaaataatttttttgaattttgagttatttgaattgagttatcgaaaatttattcgaatcaattcgaataaaattttcaaatttcaaattttttcaattcataaaattgaataaaccaaatcttaaaccggtgtaataattcattggatttttgacaggtttagaaatgtgcatattagtctttatttattaaaaaatcaaaataatttttaaaattttttaaaaattttaaattatatattttttcaattttttataaaatcatttaaaattattaaaaaataaaaatctatatctttttaattttttttcaaattaataaatacaaaaattattttgtcagtgtcatatacaacatatagtttgggtattatttatatttttattttaattcggacaaaaattgttcggacaccagctataacaaaaagatattgcaccgaaaaattaccaagggaatatcattgctttgcccggctttaaaatgaaccagaccctcatattcacctttaccacaggtccacaagtacaaccagcaacaggtgaagcaagaaacaagattctctcctttatcccctgttacttgatgcttacgttttatgatctatcaaatatatggataagtgcaaaggtgagctccttcacataagaataaagtagcagagatccatttgttaatttctttcctggaaatatttcaatcgttaatcattcatgaggtcacaaatcaacatgttggaactagaaatggccattgccgttatggaaaaggtcaatttccctgacatttttacttcatctaaagcttatcaacacgtgacgcctgtcttatccatggtgtttaatggcaagttgtggaactaggctgtggaactaggtgaaccacaatttcctgtccaaaacagagcagaaatttccccaaaatagaaactttaagaaataaatgtcttgcccgattcgacccattccaaacaaactcttacttttgtctgtatcataactctctatggattgattagttaagaagatgatgaaatcaaatttgagctaacttgttccattcccaacaatcaataaagtttgttttgagatgcagataaatggcacgcttggttgctaacttgtttcagcacccaatgggaaaaggataaaaagttgaagaaaaagagacaggagaaaatgcaataagccatccaataacaagcaagattgttgacaagtgatgaattttttatttgctttttagtttcgtttgtgcccccccaaaagaagaaaagaaaaggtttgattttgatacattcaatattagccaagaccgagttgatcaaaattaataagtgattgattttgttctacaatgatttaattgaaattctgaaaacacaacaagaacaatcaatgagcatgtgaaacatcaaatcaaagccctttgaacagttggtctctagaaggtaagtggaaaaggtacggtttttatcaccagtataacgaggaacaatcgagagcaaaaccgcctcatctgagattatcaaaccagtcaaactgcactaacgaaagaagataaggaagacggaagccattgtaggtgaaaagattgaacaaaaactgcatgttaagtcgatatctcaaacatagtgggggagccatgtacaaacaaaactaccaagaaaaacatctattcttcttttgaaaatgaatttagccagtcagagtgtcaggacattaaactagata

SEQ ID NO: 254 - DNA, 420 bp, Amaranthus albus
accggttgtttggagggagttgcctaagcagcttagagtgggccatgtctttaatatagaagcaggcaagcaagctttgagaaatataaactctttgggattattttcaaacattgaagtgaatcctcgcccagacgaaaagaatgaagggggaattattgttgagattaagcttaaggaacttgatcaaaagtcagctgaagtaagtacagagtggagtattgttcccgggcctcaaggtcgtccaacactggcttctatacaaccaggtgggactgtctcttttgaacatcgaaatatcaaaggtctcaatagatcatttcttggttcagtaaccactagtaacttccttaatccacaggatgatctttctttcaagttcgaatatgtgcatccatatatcgatggtgtatataatcc

SEQ ID NO: 255 - DNA, 699 bp, Amaranthus albus
ttcaatcaattctttctcatccaatcactaaaaccctaatcatatcttccccaattggactcctcattttcttcaatggtggaaacggaggtttcaacaatggaggcaatggtggtggtggtggtggtggtagtggtggtaatggagattcatggtggtcacgtttgcttactccgaaagccttggcagaagatgataatgatggtggttctgacaaatgggatcctcatggattaccagctaatattgtagttcaacttaataaattaagcgggtttaagaaatataaggtttctgatattcttttctttgatcaaagaactagaactactgttggtactgaagattcattctttgaaatggtttctttgagacctggtggtgtttatactaaagcacagcttcagaaagagcttgaaactttagttacttgtggaatgtttgagaaagttgatttagaagggaaaactaatcctgatggtactatcaaagtttcaattaatttcttcgaaagtacttggcaagctgctgagaaattcaggtgcatcaatgtgggtttgatgccacaaacaaagcccgttgagatggatcctgatatgactgaaaaggagaagctggattattttattagtcaggagaaagattataggaggaggattgataaagcacgtccgtgtcttttgccacctgcgctttacc

SEQ ID NO: 256 - DNA, 571 bp, Amaranthus chlorostachys
cactatggtggttgtgtgggagaccttccaagttatgaggctttcacccttgggggaccctattctgttaggggttacaacatgggggaacttggtgcagctagaaacattcttgagcttgctgctgagctacggatacctgtcaaaaccacacatgtgtatgcttttgctgaacatggaaacgatcttggaagctctaaagacgtcaagggtaatccaactgaagtttacaggagaatgggcaagggttcgtcttatggagttggtgtgaagcttggtcttgttcgagccgagtatgctgtggatcataattctggtactggctcattatttttccggttcggggagaggttttaagcttgatggcattcatttttttgaatttgttttagctttttgatagattgatgtagaatggaatttctgagggtgagtggcggatttttatttttagtataacccattgtcttctaatggagctatgggatttcagatatttagtcaaatagagttgtcaatacttccctcttaatttgatgtttgatgtcgaagtcaaagcataagctttatt

SEQ ID NO: 257 - DNA, 2537 bp, Amaranthus graecizans
cttccttctcccttctttaaaccctcagaatccttcttttttcctcctctgactttccttatcacccatcaatggcggccttcaccattccaggcgccatcaccactcctccattatcctcaccttctcaattatcttctctcttctccaaatcacaccattcttttcacctttctaacaatacccatctctccaaatccgcttccattcactcttttctcccctctcatgaatccacaaaaaaccctaatcaatctttccggaattctcttacaccctcttacccaaagccccttcaatcaattctttctcatccaatcactaaaaccctaatcatatcttccccaattggactcctcattttcttcaatggtggaaacggaggtttcaacaatggaggcaatggtggtggtggtggtggtggtagtggtggtaatggagattcatggtggtcacgtttgcttactccgaaagccttggcagaagatgataacgataatggttctgacaaatgggatcctcatggattaccagctaatattgtagttcagcttaataaattaagcgggtttaagaaatataaggtttctgatattcttttctttgatcaaagaactagaactactgttggtactgaagattcattctttgaaatggtttctttgagacctggtggtgtttatactaaagcacagcttcagaaagagcttgaaactttagttacttgtggaatgtttgagaaagttgatttagaagggaaaactaatcctgatggtactatcaaagtttcaattaatttcttcgaaagtacttggcaagctgctgagaaattcaggtgcatcaatgtgggtttgatgccacaaacaaagcccgttgagatggatcctgatatgactgaaaaggagaagctggattattttattagtcaggagaaagattataggaggaggattgataaagcacgtccgtgtcttttgccacctgcgctttaccgagatgtgaggaagattttgatggacaaggggttggtatctgctaggttgctgcagcaaatcagggatacagttcagaaatggtaccatgacgaggggtatgcatgtgctcaagtggttaattttgggaatttgaatacaaatgaagttgtttgtgaggtagtggaaggagatattacccagttgttgatccagtttcaggataaacttgggaatgtggttgaagggaacacacaatttcctgttgtctggagggagttgcctaagcagcttagagtgggtcacgtctttaatatagaagcaggcaagcaagctttgagaaatataaactctttgggattattttcaaacattgaagtgaatcctcgcccagacgaaaagaatgaagggggaattattgttgagattaagcttaaggaacttgatcagaagtcagctgaagtaagtacagagtggagcatcgttcctgggcgtcaaggtcgtcctacactggcttctatccagccaggcggaactgtctcttttgaacacagaaacatcaagggtcttaatagatcatttcttggttcagtaaccaccagtaacttccttaatccgcaggatgatcttgctttcaagtttgaatatgtgcatccatatattgatggtgtatataatcctcgcaaccgaactttcaaagcaagctgcttcaatagcagaaagttgagtcctgtgtttacaggtggcccgggactggatgaagttcctcctatttgggttgatagatctggtctgaaagcaaatattaccgagaatttcacaaggcagagtaagtttacttatgggcttgtatgtgaagagatcacaacacgggatgaaagcagccatattgccactactggccaaaggattttgccaaatggtggaattagtgctgatgggcctccaacaactttaagtgatactggtgttgatcgcatggtgttcgcacaggcaaatattacacgagataatacaaagtttgtaaatggagctatagttggtgacagaaatgtgtttcaggtcgaccaaggccttgggataggcagtaaattcccatttttcaaccgtcatcaactgacactaaccaagttcctccaactgacgcaagtagaagaaggcgctggaaaaccaccaccacctgttcttgtcctacatggtcactatggtggttgtgtgggagaccttccaagttatgaggctttcacccttgggggaccctattctgttaggggttacaacatgggagaacttggtgcagctagaaacattcttgagcttgctgctgagttacggatacctgtcaaaactacacatgtgtatgcttttgctgaacatggaaacgatcttggaagctctaaagacgtcaagggtaatccaactgaagtttacaggagaatgggcaagggttcgtcttatggagttggtgtcaagcttggtcttgttcgggccgagtatgctgtggatcataattctggtactggctcattatttttccggttcggggagaggttttgagcttgatgg

SEQ ID NO: 258 - DNA, 2705 bp, Amaranthus hybridus
aatcccttcttttttcctcctctgaccttttcttatccacccatcaatggcggccttcaccattccaggcgccatcaccactcctccattatcctcaccttctcaattatcttctctcttctccaaatcccaccattcttttcacctttctaacaatacccatctctccaaatccgcttccattcactcttttctcccctctcatgaatccacaaaaaaccctaatcaatctttccggaattctcttacatcctcttgccttcaaccaattctttctcatccaatcaccaaaaccctaatcatatcttccccaattggactcctcattttcttcaatggtggaaacggaggtttcaacaatggaggaaatggtggtggtggtggtggtggtagcggtggtaatggagattcatggtggtcacgtttgcttacaccaacagccttagcagaagatgataacgataatggttctgacaaatgggatcctcatggattaccagctaatattgtagtccagcttaataaattaagcgggtttaagaaatataaggtttctgatattcttttctttgatcaaagaactaaaactactgttggtactgaagattcattctttgaaatggtttctttgagacctggtggagtttatactaaagcacagcttcaaaaagagcttgaaactttagttacttgtggaatgtttgagaaggttgatttagaagggaaaactaatcctgacggtactatcaaagtttctattaatttcttcgaaagtacctggcaagctgctgagaaattcaggtgcatcaatgtgggtttgatgccacagacaaagcccgttgagatggatcctgatatgactgaaaaggagaagctggattattttatcagtcaggagaaggattataggaggaggattgataaagcacgtccgtgtcttttgccacctgcactttaccgagatgtgaggaagattttgatggacaagggtttggtatctgccaggttgctgcaacaaatcagggatacagttcagaaatggtaccatgacgaggggtatgcatgtgctcaagtggttaattttgggaatttgaatacaaatgaagttgtatgtgaggtagtggaaggagatattacccagttgttgatccagtttcaggataaacttgggaatgtggtagaagggaatacacagtttcctgtcgtctggagggagctgcctaagcagcttagagtgggtcatgtctttaatatagaagcaggcaagcaagctttgagaaatataaactctctgggattgttttcaaatattgaagtgaatcctcgcccagacgaaaagaatgaaggaggaattattgttgaaattaagcttaaggaacttgatcaaaagtcagctgaagtaagtacagagtggagtatcgttcctggtcgtcagggccgtcctacactagcctccatccagccaggcggaactgtctcttttgaacacagaaacatcaagggtcttaatagatcatttcttggttcagtaaccaccagtaacttccttaatccgcaggatgatcttgctttcaagtttgaatatgtgcatccgtatattgatggtgtatataatcctcgtaatcgaactttcaaagcaagctgcttcaatagcagaaagttgagtccagtgtttacaggtggcccaggactggatgaagttcctcctatttgggttgatagatctggtttgaaagcaaatattactgagaatttcacaaggcaaagtaagtttacttatgggcttgtatgtgaagagattacaacacgggatgaaagcagccatattgccactactggccaaaggatattaccaaatggtggaattagtgctgatgggcctccaacaactttaagtgatactggtgttgatcgtatggtgtttgcacaggcaaatattacacgagataatacaaagtttgtaaatggagctatagttggtgacagaaatgtgtttcaggtagaccaaggccttgggataggcactaaattcccacttttcaaccgtcatcaactgacactaaccaagttcctccaactgacgcaagttgaagaaggcgctggaaaaccaccaccaccagttcttgtcctacatggtcactatggtggttgtgtgggagaccttccaagttatgaggctttcacccttgggggaccctattctgttaggggttacaacatgggggaacttggtgcagctagaaacattcttgagcttgctgctgagttacggatacctgtcaaaaccacacatgtgtatgcttttgctgaacatggaaacgatcttggaagctctaaagacgtcaagggtaatccaactgaagtttacaggagaatgggcaagggttcgtcttatggagttggtgtgaagcttggtcttgttcgagccgagtatgctgtcgatcataattctggtactggctcattatttttccggttcggggagaggttttaagcttgatggcattcatttttttgattttgttttagctttttgatagattgattgatgtagaatggaatttctgagggtgagtggcggatttttatttttagtataacccattgtcttctaattatgggatttcagatatttagtcaaacagatgtcgaagtcaaagcataatctttattggcaaattatttggtctttccatttcggatac

SEQ ID NO: 259 - DNA, 2626 bp, Amaranthus lividus
cctctgaccttttcttatccacctatcaatggcggccttcaccattccaggcgccatcaccactcctccattatcctcaccttctcaattatcttctctcttctccaaatcccaccattcttttcacctttctaacaatacccatctctccaaatccgcttccattcactcttctctcccctctcatgaatccacaaaaaaccctaatcaatctttccggaattctcttacatcctcttgccttcaaccaattctttctcatccaatcaccaaaaccctaatcatatcttccccaattggactcctcattttcttcaatggtggaaacggaggtttcaacaatggaggaaatggtggtggtggtggtggtggtagcggtggtaatggagattcatggtggtcacgtttgcttacaccaacagccttagcagaagatgataacgataatggttctgacaaatgggatcctcatggattaccagctaatattgtagtccagcttaataaattaagcgggtttaagaaatacaaggtttctgatattcttttctttgatcaaagaactaaaactactgttggtactgaagattcattctttgaaatggtttctttgagacctggtggagtttatactaaagcacagcttcaaaaagagcttgaaactttagttacttgtggaatgtttgagaaggttgatttagaagggaaaactaatcctgacggtactatcaaagtttctattaatttcttcgaaagtacttggcaagctgctgagaaattcaggtgcatcaatgtgggtttgatgccacagacaaagcccgttgagatggatcctgatatgactgaaaaggagaagctggattattttatcagtcaggagaaggattataggaggaggattgataaagcacgtccgtgtcttttgccacctgcactttaccgagatgtgaggaagattttgatggacaagggtttggtatctgccaggttgctgcaacaaatcagggatacagttcagaaatggtaccatgacgaggggtatgcatgtgctcaagtggttaattttgggaatttgaatacaaatgaagttgtatgtgaggtagtggaaggagatattacccagttgttgatccagtttcaggataaacttgggaatgtggtagaagggaatacacagtttcctgtcgtctggagggagctgcctaagcagcttagagtgggtcacgtctttaatatagaagcaggcaagcaagctttgagaaatataaactctctgggattgttttcaaatattgaagtgaatcctcgcccagacgaaaagaatgaaggaggaattattgttgaaattaagcttaaggaacttgatcaaaagtcagctgaagtaagtacagagtggagtatcgttcctggtcgtcagggccgtcctacactagcctccatccagccaggcggaactgtctcttttgaacacagaaacatcaagggtcttaatagatcatttctcggttcagtaaccaccagtaacttccttaatccgcaggatgatcttgctttcaagtttgaatatgtgcatccatatattgatggtgtatataatcctcgtaatcgaactttcaaagcaagctgcttcaatagcagaaagttgagtccagtgtttacaggtggcccaggactggatgaagttcctcctatttgggttgatagatctggtttgaaagcaaatattaccgagaatttcacaaggcaaagtaagtttacttatgggcttgtatgtgaagagattacaacacgggatgaaagcagccatattgccactactggccaaaggatattaccaaatggtggaattagtgctgatgggcctccaacaactttaagtgatactggtgttgatcgtatggtgtttgcacaggcaaatattacacgagataatacaaagtttgtaaatggagctatagttggtgacagaaatgtgtttcaggtagaccaaggccttgggataggcactaaattcccacttttcaaccgtcatcaactgacactaaccaagttcctccaactgacacaagttgaagaaggcgctggaaaaccaccaccaccagttcttgtcctacatggtcactatggtggttgtgtgggagaccttccaagttatgaggctttcacccttgggggaccctattctgttaggggttacaacatgggggaacttggtgcagctagaaacattcttgagcttgctgctgagctacggatacctgtcaaaaccacacatgtgtatgcttttgctgaacatggaaacgatcttggaagctctaaagacgtcaagggtaatccaactgaagtttacaggagaatgggcaagggttcgtcttatggagttggtgtgaagcttggtcttgttcgagccgagtatgctgtcgatcataattctggtactggctcattatttttccggttcggggagaggttttaagcttgatggcattcatttttttgaatttgttttagctttttgatagattgatgtagaatggaatttctgagggtgagtggcggatttttattttaagtataacctattgtcttctaatggagctatgggatttcagatatttagtcaaat

SEQ ID NO: 260 - DNA, 2691 bp, Amaranthus palmeri
ccgacctttccttatccacccatcaatggcggccttcaccattccaggcgccattaccactcctccattatcctcaccttctcaattgtcttctctcttctccaaatcccaccattcttttcacctttctaacaatacccatctctccaaatccgcttccattcactcttttctcccctctcatgaatccacaaaaaaccctaatcaatctatccggaattctcttacatcctcttacgtaaatccccttcagtcaattctttctcatccaattaccaaaaccctaatcatatcttccccaattggactcctcattttcttcaatggtggaaacggaggtttcaacaatggaggaaatggtggtggtggtggtggtggtagcggtggtaatggagattcatggtggtcacgtttgcttacaccaacagccttagcagaagatgataacgataatggttctgacaaatgggatcctcatggattaccagctaatattgtagttcagcttaataaattaagcgggtttaagaaatataaggtttctgatatccttttctttgaccaaagaactaaaactactgttggtactgaagattcattctttgaaatggtttctttgagacctggtggagtttatactaaagcacagcttcaaaaagagcttgaaactttagttacttgtggaatgtttgagaaggttgatttagaagggaaaactaatcctgatggtactatcaaagtttctattaatttcttcgaaagtacttggcaagctgctgagaaattcaggtgcatcaatgtgggtttgatgcctcagacaaagcccgttgagatggatcctgatatgactgaaaaggagaagctggattattttattagtcaggagaaggattataggaggaggattgataaagcacgtccgtgtcttttgccacctgcactttaccgagatgtgaggaagattttggtggacaagggtttggtatctgccaggttgctgcaacaaatcagggatacagttcagaaatggtaccatgatgaggggtatgcatgtgctcaagtggttaattttgggaatttgaatacaaatgaagttgtttgtgaggtagtggaaggagatattacccagttgttgatccagtttcaggataaacttgggaatgtggtagaagggaatacacagtttcctgtcatctggagggagcttcctaagcagcttagagtgggtcacgtctttaatatagaagcaggcaagcaagctttgagaaatataaactctctgggactattttcaaacattgaagtgaatcctcgcccagacgaaaagaatgaaggaggaattattgttgagattaagcttaaggaacttgatcaaaagtcagctgaagtaagtacagagtggagtatcgttcctggtcgtcagggtcgtcctacactggcttccttccagccaggcggaactgtctcttttgaacacagaaacatcaagggtcttaatagatcatttcttggctcagtaaccaccagtaacttccttaatccacaggatgatcttgcattcaagtttgaatatgtgcatccgtatattgatggtgtatataatcctagcaaccgaactttcaaagcaagctgcttcaatagcagaaagctgagtcctgtgtttaccggtggcccaggactggatgaagttcctcctatttgggttgatagatctggtctgaaagcaaatattaccgagaattacacaaggcagagtaagtttacttatgggcttgtatgtgaagagattacaacacgggatgaaagcagccatattgccactactggccagaggattttgccaaatggtggaattagtgctgatgggcctccaacaactttaagtggtactggtgttgatcgtatggtgttcgcacaggcaaatattacaagagataatacaaagtttgtaaatggtgctatagttggtgacagaaatgtgtttcaggtagaccaaggccttgggataggcactaaattcccaattttcaaccgtcatcaactgacactaaccaagttcctccaactgacggaagttgaagaaggtgctggaaaatcaccaccaccagttcttgtcctacatggtcactatgctggttgtgtgggagaccttccaagttatgaggctttcacccttgggggaccctattcagttaggggttacaacatgggggaacttggtgcagctagaaacattcttgagcttgctgctgagttacggatacctgtcaagaccacacatgtgtatgcgtttgctgaacatggaaacgatcttggaacctctaaagacgtgaagggtaatcccactgaagtttacaggagaatgggcaagggttcgtcttatggagttggtgtcaagcttggtcttgttcgagccgagtatgctgtcgatcataattctggtaccggctcattatttttccggttcggggagaggttttgagcttgatggcatttattttttgaatttgttttagctttttgatagattgaagtagaatggaatttctgagggtgagtggcggatttttagttttagtataacccattgtcttctaatggagctatgggatttcagatatgagaaccgattttcttagtcaatacttctctctcaatttgatgtttgatgtcgaagtcaaagcataagct

SEQ ID NO: 261 - DNA, 14603 bp, Amaranthus palmeri
tgccctttttttgcgttgttttcttatctttccctttgtcgtataaaattgcaaattagcaacaaaaaaatgattggcttatccaaatggatttgatgagttacttaaagtgggagcattaatagagattaatgcttcctcactttattggctcactcaatttttaatgccaaatgttaactagtaagtttgttgaatatctttgttggtttagtgttctcttctatgatctctctactgtattctgattatattcttgctaaaaaatcattttccatgcttctttttaacattatgttgacagagaaaaaggacttgagttgtgtatgtcatcgactttggtcgcgactcacatgtgatattgaataattggtattgtggatctatgcccaaatctttgatttcgtgtttttggactatggaaaattaacttcttttcttgctcgatgttccagttactttttgttccattatcctaatgccattaagctcccacgtaggcgtggtttaagaggtcggatgttcacaatcttacccttataaaacaagaggttgtttttgatcacccttgtaaacaccgttggcaacttcacataactaagaagtgtgaatgatttaatgagtcattttacggtagtctatttaatccaaaagaaaaaactataattctttacatactatcgagatggagcactttcttgtttcatgaggtatgtaaattttatgatcaatgtggtgactaaagacaaatcttctttagatgaaatagcttatgatgcttcacaatttcataattatgttctgaggttatgaacttatgataactgttgtgtaccttgctgtttgttctttgctggctcaatttcaagacgtctgagaactaactggacatgctatttcttttgacgtgataatatgttgaatgaacataagttttaagtgtgttgtaatatagtattgctatgttttactaaagcataatcaatttgatgtggtgtctattttgtagcttagagtgggtcacgtctttaatatagaagcaggcaagcaagctttgagaaatataaactctctgggactattttcaaacattgaagtgaatcctcgcccagacgaaaagaatgaaggaggaattattgttgagattaagcttaaggaacttgatcaaaagtcagctgaagtaagtacagagtggagtatcgttcctggtcgtcagggtcgtcctacactggtaagtttcatttttgtttcctacaaacactcactataatagtatacattatgatcttactggacttcttttgtaaaaactgtgatttgtcaggcttccttccagccaggcggaactgtctcttttgaacacagaaacatcaagggtcttaatagatcatttcttggctcagtaaccaccagtaacttccttaatccacaggtaattttacttttgatatatgatctcttaaggctatcttattcataaggattaaagattaattaaagagctaccttttcttgtgtttggatgaaggctgcttgatgaataggcataggataaactatctcgtgtccttcctctcttttgtcttatgctccttaatgcctagatttactaatctgtgtgcggtgattgtttttggtcattactgttaaactgtctcaagagatcagtatttttgttaggaaagatgttaaggccattttttttatgccacttcttggtgatatgattcttctgattttaactactagctgattttcaggatgatcttgcattcaagtttgaatatgtgcatccgtatattgatggtgtatataatcctagcaaccgaactttcaaagcaagctgcttcaatagcagaaagctgagtcctgtgtttaccggtggcccaggactggatgaagttcctcctatttgggttgatagatctggtctgaaagcaaatattaccgaggttgatatatcttttcttttcatgttgacttagttagccttatttaacttgtctcttctgctcatatttgtgacaaaatgatgttgcttttgtagaattacacaaggcagagtaagtttacttatgggcttgtatgtgaagagattacaacacgggatgaaagcagccatattgccactactggccagaggattttgccaaatggtggaataagtgctgatgggcctccaacaactttaagtggtactggtgttgatcgtatggtgttcgcacaggcaaatattacaagagataatacaaagtttgtaaatggtgctatagttggtgacagaaatgtgtttcaggtaaatcatttttccatttttccattcttgattgtttttcccagtgtactgtgtttttctcccatttcctgattcttgagctcagtggtgattcatgctatcaatgcacaatctgacaatatagttttgaaagtgattagatatagtgccatcactgatctccttataatgatgactaatgattggcttatcaagtgcaaacattgctgccctaaactagaagattcttactaaagcatataattggaagaaagctcctcccaagaaaaaaagaacaagggggaaacatgtctttgtttggatacacttaacatttgtttgctcttttttgcatttgatgaactgctataatgatctacgaatatagacaattcaacttaagtaggcttccgttttttcgttttccaattttatgtttctattgattcaaggggccctttatctttactgcttaagaaaatactttgaacccaacttcagcctagaaggatatcttatccacccacataatttcaaagtcttaattttacagtgtggattgcaccataaactaaaataaattaaattgaaaatttgttgctaataaagttgatactttatgtgacattttctaaactggtataccctattttaatgacattctacatacttatcctgcttcattcattcctttctgtatgttcaatttttcactgttattcttcactcatgctatttacctcatgttttgtctatctttttagcttctaagctcttcaatgctctaacgtttccttatggtcttttgtacatgactaaaccaacacgaacaaatatctctcatttcatcttcatcatattagccattattatctttttttagtttgaattaggttctaaaaggtctattataagctttaatttacgtatatcttctagaaaacaattcataaaatatgacgtggcgcttctgcgacattgcaatcgttttcgctatcacaatgacatgtacaatttttttcctatggtttaaacaatcacccctttttcatgaagcttctacaatagcctctagatttacctattctttcactctctcgtatttgttgattttccttgtgagatgaatgttatggtttgcttcccccccgccgacatacatcctaggtttcggcccatcattagattcttccccatatatcgttacacccgttccaagtaccctaagtaccttgaatgcttgagatgtgttttcttcatccaatccttttgtaagatgccaagattggtgaatcgggttgcgtctaccatgtaggagagctaccatggcttttgaggctaagggttgaacaaggctagggttagggtttgtagatccttgatccttaaacaagagatgttgaggaaaaatagagttttttggaggagttagaacaataaagctttcattcataagggagtttggaaggtctcttgcaatcggttgagctaaacagaaaaatttgagctctactgataaaaggttccttaaataagggtggtgggagcaaagatgtattcattcataagagagtttggaaggtcttttttaaggaagtcggcaacaggacacgtttgcttaaaaataggaaaattctgttagaacagaaaagcctaattattttggtgaaagggatacttgtttgattaggaaagtgaaaatgaatggatgaaaatcaggaagaggactgagatcaaataaatttaagtgtgtagttacttggtgaggattgagtgccaacaataggattccttattgtttgactttcattaatgaaggggcaatttggggtctttttgtgatggcaatataagggtaggataatgttgtagttttatgaggatgggtggaaaagattagcaaagatcgaagctttgaattgcttctcactttgcatcacttttgggtgagtttaaagtttcgaaaatctgtgctttatgactcatgatcagatctttttggattgaaaattaaagaattggttatttatgaggaaagtcgaggcccgagggtgggcggaaaaggattaggaaagattgacgcttttgaattacttctaccttgcgtcacttttaggattaagattttgatttttttttaaataccaatgttgaagtttttgatctgagatttttgggtttgactttgtgtggacatgtcgaagaaaagaattgcagaggttgaagctttgtaatgcttaaattttgcattttaatgggggtttgatgatatttaagcttgttgttagggaagatggaggcgttttgatatgatattttaggagatggatctatttactgttgtttacataaggatattctggtcgtatgattggaataggtgaacaagtttttgtattatgttttgagttatgattcacgaatgttgttggaaaatttcgggaaggaatttttattatgatgaatgaatttaaggaggaatgatttattaatattctgattgagctattagaaaaagaaaacacatattcacttaactggtctaggcttaataataggaatcaaattgatttgtttatgaagaaggagatggcgatggtgatggcgcgtggggtaaattaatgaagatggcgtgtggtttaatgaaggatagaacaacgctcctagctacctacgccgacagaaaatctgtgatttcattcacattttagagcgacttattttctacataagcaagggcgattctcactcactctcaatcctcaaaagagtttatgatgcaacaaagaatgaacaaaacatttctgaaatttaactaatcaatgcttgtgttttattggtaacggatgactccataaatagaacatgaactcataaaagattctagaaagtactaaaaactttaactgaataacggatatctaactgattaatacattagctaaataatatattaatgttgtaagaaaataaaattttgcctgaaaataggggatcaggtgtaggatgaatctcatacatgactgataaatgatttgctgttgttgatctttggaatctagtgcttttgggtttggatgaactttaatctatcatgtgaatttggaataataaaaaaaggactaaactgatgtgggattgtgctatggcctgactacttgaattaaatagtaaatttgggaatgaaatattaaaaggacaaaagcaaaatgatattataatattaatgaacaaagaaacattacagccctagaaatggtaaaagaaagataaattaagcacttcgagaagctttaggtctcctaaaaatgagtataaactcacccacaatttgtttactaatttcttgatgattatgggtctctaattccccttatttataataaactattaacttttttcccaagtcttccctattatgaaaattactattttgccctttcgtaaatccaatattgatcatagcagcttaatcaaatggctctacatgagcctttgctacaaaaaaatccatctgactaggcttcatctgttaggcgtttaattgtaggcctcattttacacgccaactaatggacgtttattccttgctctgtctctcctggatatgaagtcattgccttgcaggccttcagactctctacaatttgaagtacaagacttaaaagctaatatgtgtttgaattatatttgatgtggatttgggttgatttctgtcttctaactgcaggtagaccaaggccttgggataggcactaaattcccaattttcaaccgtcatcaactgacactaaccaagttcctccaactgacggaagttgaagaaggtgctggaaaatcaccaccaccagttcttgtcctacatggtcactatgctggttgtgtgggagaccttccaagttatgaggctttcacccttgggggaccctattcagttaggggttacaacatgggggaacttggtgcagctagaaacattcttgaggtaagagtttccagtttttttttaatatctttgtggttctagctgtgtgctgaattctgcacagacgtgatatggtgtaatcggtgaccttttggaggaaattgggacaaaataccgctgccttttatttatgaaaatttatttgatgggctgttgaggggaatagattaaatttctttctaaattaaaaaaaaattaggtgttcataactttactataacgggtagttttaaatgtttgtccactttagaattctttccatttttggaaatctattttcccaaatatattctcataatccttctcattttctacaaatatactctctatatcaatgacaatgagaatttcctttttcttctttattttatttttaatttaaatgtcttttctctttataatacccatacaattattacttcatactactattcaattaaaataatacccacttattacaaagattctagttttcttaatttgtgtgaaaatcacatagtgaacaatctttaaagaacggggggagtaacaatatatccaaaatgtcgagttccagttatggaaacgatctccagtcattgatccatttgagtgcgtttatattgtagcttgctgctgagttacggatacctgtcaagaccacacatgtgtatgcgtttgctgaacatggaaacgatcttggaacctctaaagacgtgaagggtaatcccactgaagtttacaggagaatgggcaagggttcgtcttatggagttggtgtcaagcttggtcttgttcgagccgagtatgctgtcgatcataattctggtaccggctcattatttttccggttcggggagaggttttgagcttgatggcatttattttttgaatttgttttagctttttgatagattgaagtagaatggaatttctgagggtgagtggcggatttttagttttagtataacccattgtcttctaatggagctatgggatttcagatatgagaaccgattttcttagtcaatacttctctctcaatttgatgtttcatgtcgaagtcaaagcataagctttattggcaaattatttggtctttcccaggttactaaacccgtcctttttacccctagttcgttattgattttgtcttttcgtcgctttttacctttttctttgattttacgtttgtttttgtgcgtatgcttgttattctatccaactatgtaagttctctcttgaagaccgttctcgagccgagggactctgtgatcgcactctccttaatgggtatgagtctgtcatcgttcttccctccccagatcctgatcatagttttctatgaacgggatacactgggtatgatgatgatgatgatgatgatgcaaattatttggtcttaccatttcagatacaataacaattttcatttttttggtcatgtgtagatgtgtttaaaacagatctgatgttttgatattactagaaatatctaatgaatttaactttgacaagacttttaaatagatttacaattacgtgaaatcaacgtggccacacctagcgtaacttggtttaaatgtaaatgttgctcattaactcatgtttattttttatttaatttgtaattacgtaaacattatggtcttttctaatgtctcatgtaggagtcatttaacattgtagatttgtaggtatagagtgtagctgcttcatctgtgtacttttaaattcactagaggttaaaactttttatttgataacacttttaattacaaagatttaatcatcatacaatttaataaatttgctatgaaatgataaatgtaagctcataaaaacttttgccaagtgtgattatttcattggttttaaattcattagaggttaaaactttttatttgataacacttttaattacaaagatttaatcgttatacaatttgataaatttgctgtgaaatgataaatgtaagctcataaaaacttttgccaagtgtgattatttcattggttaactaattcttatatggtaattaaataatcaactaattatctaaatcaatacacccttttaagcaggtttttactctctgtttttttaatattctatttgaaatattccaccttaaggagagaaaaattttattaatgtttttaatacatatttcaaagataaaatatatcaatgttgagatcttgttatatccgtcttaatatattcttttagattatttattttttataattttttattatgtgtattttgttatattaaggtttaaaatttgcattgaatactgtcaaaaagtaaacaaagaaacgaagggagtaaaataatcactgattgcctaaatcaacacatctttttaagtaggtttcaaaaagtaaggattacttattctaaagaatttatatacctaaataataaattctggagtataatagttaatttaacatgcatcattttcgtacctagagatttattttaaaaattatgatatcatagtaggagaatatagtgttatcaaaatatattatgcaagctaactcgttcccccatcggtcttgactcaagaacgtttggaggcacaactactcgttttcttccacaattcttgaattttgactctaccatgtatggtttgtttgcttcttttgattgaattgcgctatgccataacctccttatggtcctatgatgataaccatatttttgaccattgatttggaacgaatgttccatgaattaatcggttgttttcaatgaaagcaactcttgaaatattagatgcctcatttctttgctgagccttggcttatgatgattgttttgttgttcttcttgttgcttaatcatctgtggtggtttttgctctgattctgagcttgattgaggatcatattgtgttgatccaaattaccatgccccctcgatttcgtcttcacttcctgaggccatgattaaggcaatgatggagtaatttcaattgctactggttctgttatggtgaagttactaatttcgtttttaaggttctgatttttttgtgaagctgctgatttttttgtgaaattactgatttatggtgaagctactgattttttggtgaaggtgctgtgaagttactgattgaggatcatacttgctgtttttataaacatcctcagtagaatttgtatagtcatttcaattctattgcttgattagcttcaattagatgattaatccatgtttattgtaattgcccaatgggatgtttgggtttatcttttcagattttagccattccctccttaatttggattaccctccaaaactttccaaaaatggaaagtcccccatgtaactaaaacagaaattctgtttttctaattgtgttgatcaggttctctctcctattaatgacaatattttttttttgttttacattatctttaattaatttatattttctctctcataataccaatacaattattaaatcacaccactattctaataaaataatacacacaatcaacaaagattcccactatcttaatatgtgtttaatcttcaaataggacatacatataagaacggagggagtagtatgttattctttattaaaaagctcgtaatttcgtattttatactccatgtacaaaccatttgttctttcattcaaattaaaaaaatgaaaagtacaaatataacattataaaatgtctaattaattttttatcttttgttgtgattttttttttgttgtgaattaatttttcactaccacctatgcgcactatgaacaatatgatacaatgtacataatgtatacaattgctcagagtaaaaaaaattataagtatgatgtaaaagttatttcctaaaattttaatttcttaatttatacaaatatattagaaaatttaataaagtcgtacatctcacgaacactataaaatatagcaaaatgtcaatattagtcagaccaatgatgtattttgcaatgtatataaaattcacatttaagttgaatttaacaagagttaatccgactatattttaccttgaatcaaatactcctataagatacaaagtatatgaatgaaaagtgaataagaatcatagtggaagtaaatcaaatccctaatttgatagatcaggagcagtttcaacgttcaatctcatcattatctcctcaaagctgttgttcaattataatcctcggatgcttaaatatcaattcacaacactgtgatttgttttcagttaatttggcgccattaattataccatttgaatgtttcctattttcagatcgaccccattattgacctcctacagaaaaacccacttcacaatcagtttttttcggacattttcggatgcttacataaaatgcatcgaaaattatacccaacatagatctttgatgttgggcaaagcattacatgcacatttgctcatcattggccgagctcgttctagtctttttgcttctaagctcataataatgtatgttgaatgcagagaattggctagtgcacgtaaagtgtttgataaaatgcctgattcgaactatcggagatggatagctcttataggggcgtatgcgaaatgtggggcttataagcaagcattggatattttgagggaaatggttaaagaaggtgtaaaacccaacaattatattcttcctagtgttcttaaagcctgtggacatcgttcggaatggtgggttggtgaggagattcatgggtttattttgagaaattcatttgagggtgatgtgtatgttagttgtgcccttatagatatgtactcgaaatgtggttttgttgatcacgcgaggaacgtgttcaacaatatgattgagaaagatttgattgctgtgaatgctatggttgctggttatgttcatgtaggaatgatgaaagaggcattgagtttagtagaggatatgaaattgatgaatatgaggcctgatgttgtaacatggaatactttgattgcaggattttctcatgtaggggatagtttaatggtggatgagcttttccaagttatgcgcgttaatgggattgagccggatgtggtgtcatggacttctatcatttccgggtttgtgaagaatctcaggaacaaagaagcttttcttacgtttcagaaaatgcttgatgctggatgtttcccaaatgcaaatacaattagtactctcatatcttcttgtgctaatgtaggaaatgtaacatggggaaaagagatacatggatttgcggtgattgttggacttgagcaggacgtgtatgtgcggagcgcgcttatagacatgtatgccaaatgtgggtgtataaatgaagcatcaatattgtttcaaaagacgactaaaaggaacactcctacttggaattcgatgatctttggattagccaaccacggctattgcaatgaagcaattgaagttttcagaaggatggaaacagaggacgcagagaagctcaaccatttgacattcactgcagcattgacagcctgcagtcacggtgggatggtcgaactaggaagaaatctctttaaatcaatgcaagagaagtataatattaagccaaggcttgagcactatgcttgtatggtggatcttgttggtcgagctggaaatttaaccgaagctcatgacattgtcaaagcaatgccaataaaacctgatttgtatgtatggggagcattatttggagctagtaaacagcatggtgacatagggctcgcggaagtagcagcaaaacacttgtctgaactcgaacataagggtataggagcaaatttactgtccaatttacatgccgaggcaggaagttgggccaatgctgcgagattgaagaagaagaaaatgaggagtttttcgggatgcagctggattgaggctactggatttaacccgatgaacagccagtgggattcgtaacagcttgcaaatcctttgaaactgagttgatggtgcatgaattgctcaaaatatgttgttcatggctattcggtctcggccttctcatttcatctcagatggtcagcactaaaattgtctaacttgggatacacataaaatacatggagatgttcccatacatatcgacttgaggaactctataagtcaagctaactcgcctttcgtaactatcagggccggctttaagggtgggtaagagaggccgtgtctcagggcccatgtcaaaaaaacaaatttaatggttgtaaaagggttcatataggtgatgaattacaatagaaaacggccctaatgtgttatttcgcccaaggccccaaaatatccagggccgatcctggtaactatgtcttgaactcttgatggcttcaaagaggcgaccaagaaacttttattaaaagtgtggtagccaatctttaaaaaaattctacataatagtattgtaatgttgtacttaaagctacagtaatattactaggttaaaaatgtttaattggtcgttaagtagtgaatcttattcgacattgtcttcttttcttaaaaatacaataaattttatagttaaaatttgctactaaaggtgtttcataaaagtatgttgctaccacataaaatatttgtaagataatttacaactttaacggctaattacacgtttttagccaattaatgttactatatctttaagaacaacattatacatgcgattttgtggaattttttaaagatttgctaccactgacatttcattaaattatgttgctatcatatagactatgtccataaaatattagaataaaattagtagaaaatatgttgaaaaataaacattatccaaaatttatgatttacataaaaaaattcttaatagaaacaacaaatacaataactcaaaaagaacaaataaaaaacttttttttaaggaaaataaaaataatttgaacaaaagtagtatttatacattattaatgcacttttacatgaacaactaaaatatggccttacacaaagcaaaaggtcattgttaattgttatccactaacaaaatgaatgaggtgggcattgtgatgagcaaattactttaatgtgccaatttcatattaagaaaacaacactttatgtcacttttgtcattgtgtcattttactaaactaatctttcttctttggaatttgaaaccttatctcaccttgcacccactttgccctatcctattcctaacatatgcaaatgcaaatgtttgctacctcactttgccctaacatgtttattaccttatctcagcttctacacccttgtgattatgaatttgcagcattttctgttttagttcatctcacttaaattgcaacatttttatttttggactataatccatcactttcttttaatctcatccatttattttgactctcttttaatttaatccacgcaattcgttctctctcttcatttattaccacttttttaattctcactacttttttctttgctactatctcatagggcgggagggaatatgtcaatcaatcttcttttacaattttttctataaatgtgtaagaaaaatagtatttatttgaaatcttgttagattatctaaagcatatttatattaattaactttctataattgtgaattatgtataagaactgggttgctcttaataagtaaaacttttcataagtgacgtcttaggttcgaatctcattagttttccccttcccccagcttaacctataataaaaaatttaagtattattttaaaatattaattgctaaaatagtacgttgtatattttctaaaatgagatgaaagtgtaactattaaaaaaaaaaaaaaccacacatattaacttatattcctttataaatgacaaattttgaatcataaaagataacatgtaattcatgtggtcgaagtgaatttgaataaaatcaataacgttagagctttattcctaaaaattgaggtcgtatgatattatttgctagcaagggttaatcgaaagccacctcttgttagggttatgaccatcaacaatagtattgcgtatatctgatccctcttaaacaattcttacttagaaaccacttaatgttattggagttctcaaaagataatgatactagcaaaatcagagagtaaaaaataaaaaggaaaaaaatcactgatataatcaataatcaatggctaatttttaccaaatatttagataataatccactaatttaattagcttaagggttaagataaaaatcatatttaatggctataaaaaaagtgtattttgaaaggaatcattagttggatatgatattaaataatttaagtatgaaaaaggatatggtggtcccaaaaagatcaatcag

SEQ ID NO: 262 - DNA, 1536 bp, Amaranthus palmeri
ttatactttatgtgttattagttttgggtgattggaatttataagctcaatttattcttgttgaactttctgtgttggtggttttgggttgttgtaatttttcataattggtaaggtaggtcagtgtttacacattttgagaaaatgttgttacttattacaagttttgagtaaactttttgtgttgtttttcggtcattggaatcatatgctcaatttgttatttttggattgtttatagttgctttcagtttctgtcaaagtgcatcccatgataatttgcttggaaattagcatcccttgataagtattgtactctgttagtgattttgggtaattgggatttatcataattgataggtcattgatgaaacattttgagaaaatatggatacttaagttttgagtaaattgtttttgaaaaaggtgtagacctaatgatagtggaaatagtgaaatggatgtttagttttatgtagttgagtagatgcatcaatgtggttattgtttttttataaacgaacttttttgtatatgaactctaggtttatatgctgtatgctatgtatttttaaattttcactgtgttcttactgatatgcaagtcaatatatggtagttccttgctaaaagtatttctgcaattttttttgaggtcgtgcaaaataatatgtgttaaaattgaaattggtatggttttgtgtatttgtgttcaggtgcatcaatgtgggtttgatgcctcagacaaagcccgttgagatggatcctgatatgactgaaaaggagaagctggattattttattagtcaggagaaggattataggaggaggattgataaagcacgtccgtgtcttttgccacctgcactttaccgagatgtgaggaagattttggtggacaagggtttggtatctgccaggttgctgcaacaaatcagggatacagttcagaaatggtaccatgatgaggggtatgcatgtgctcaagtggttaattttgggaatttgaatacaaatgaagttgtttgtgaggtagtggaaggagatattacccagttgttgatccagtttcaggataaacttgggaatgtggtagaagggaatacacagtttcctgtcatctggagggagcttcctaagcaggtaaaattcattttagagttgtttagacattgttataattgtgttcatctttttttcttttaaaaaaattgcggatatcgttgagattgcggtaatggtcgcagtatcacagacgtggcacctcgtggtgttatgactccttttgtggattgcaatgtggattgttcacttaaaaaatattttaacatagtattttaagttttctataatatgttttccaatcaaagcttttaatagctcttttaaaacctaatacacttaaaaaagatattaatgagttatttgttagaacttgaacaacttatgtggttgctattccttgactacaaatgacaggctacataacgtgttttgcggtttagtaagcttaaaatctgttatgaagtgctcgtg

SEQ ID NO: 263 - DNA, 1426 bp, Amaranthus palmeri
gcataaaattttataaccaatagtatatttatatataaatttttaatatatgtataaataaaatacttatttaaaaaagtaaaaaaatagtatttggacatgtgtcaagttcttacttcttataggttgggtgaatggttaaccatgatatttcctaaaaatttcacaaacatgagattttttttgtaaactttcatcattgtgatacatttttacccaaaaaacttttcatccaaacaaaaaatcatcaccattgaaatagctcttaacaattacctcattttgatcgatattatgttgaaattattacatgaaaatcagtaaaaaaaatagattattgtgattttttttagggttggatccaatatcaatagttggtagagacttttggcacaatactcgtacgacctaacagagtcccgtgatatccgatacacctcttttccttccttctcccttctttaaaccctcacaaatcccttcttttttcctcctcccacctttccttatccacccatcaatggcggccttcaccattccaggcgccattaccactcctccattatcctcaccttctcaattatcttccctcttctccaaatcccaccattcttttcacctttctaacaatacccatctctccaaatccgcttccattcactcttttctcccctctcatgaatccacaaaaaaccctaatcaatctatccggaattctcttacatcctcttacgtaaatccccttcagtcaattctttctcatccaattaccaaaaccctaatcatatcttccccaattggactcctcattttcttcaatggtggaaacggaggtttcaacaatggaggaaatggtggtggtggtggtggtggtagcggtggtaatggagattcatggtggtcacgtttgcttacaccaacagccttagcagaagatgataacgataatggttctgacaaatgggatcctcatggattaccagctaatattgtagttcagcttaataaattaagcgggtttaagaaatataaggtttctgatatccttttctttgaccaaagaactaaaactactgttggtactgaagattcattctttgaaatggtttctttgagacctggtggagtttatactaaagcacagcttcaaaaagagcttgaaactttagttacttgtggaatgtttgagaaggttgatttagaagggaaaactaatcctgatggtactatcaaagtttctattaatttcttcgaaagtacttggcaagctgctgagaaattcaggttttgtttttggatcatttttgtgattttaattgattattgctccaagtgttgtactttttgtgttgttgtttttgggtcattggaatgtatatgctcaatttgttataattggaatgtatatggactataacctagattg

SEQ ID NO: 264 - DNA, 2664 bp, Amaranthus rudis
ccatcaatggcggccttcaccattccaggcgccatcaccactcctccattatcctcaccttctcaattatcttctctgttctccaagacacaccattcttttcacctttctaacaatacccatctctccaaatccgcttccattcactcttttctcccctctcatgaatccacaaaaaaccctaatcaatctttccggaattctctgacatcctcttacgtaaagccccttcaatcaattctttctcatccaatcaccaaaaccctaatcatatcttccccaattggactcctcattttcttcaatggtggaaacggaggtttcagcaatggtggtggtggtggtggtggtggtagcggtggtaatggagattcatggtggtcacctttgcttacaccaacagccttagcagaagatgataacgataatggttctgacaaatgggatcctcatggattaccagctaatattgtagttcagcttaataaattaagcgggtttaagaaatataaggtttctgatattcttttctttgatcaaagaactaaaactactgttggtactgaagattcattctttgaaatggtttctttgagacctggtggtgtttatactaaagcacagcttcaaaaagagcttgaaactttagttacttgtggaatgtttgagaaggttgatttagaagggaaaactaatcctgatggtactatcaaagtttcaattaatttcttcgaaagtacttggcaagctgctgagaaattcaggtgcattaatgtgggtttgatgccacaaacaaagcccgtcgagatggatcctgatatgactgaaaaggagaagctggattattttattagtcaggagaaggattataggaggaggattgacagagcacgtccgtgtcttttgccacctgcactttaccgagatgtgaggaagattttgatggacaaggggttggtatctgccaggttgctgcagcaaatcagggatacagttcagaaatggtatcatgacgaggggtatgcatgcgctcaagtggttaattttgggaatttgaatacaaatgaagttgtttgtgaggtggtggaaggagatattacccaattgttgatccagtttcaggataaacttgggaatgtggttgaagggaatacacagtttcctgtcgtttggagggagctgcctaagcagcttagagtgggtcacgtctttaatatagaagcaggcaagcaagctttgagaaatataaactctctgggattattttcaaacattgaagtgaatcctcgtccagacgaaaagaatgaaggaggaattattgttgagattaaacttaaggaacttgatcagaagtcagctgaagtaagtacagagtggagtatcgttcctggtcgtcagggccgtcctacactggcttctatccagcccggcggaactgtttcttttgaacacagaaacatcaagggtcttaatagatcgtttcttggttcagtaaccaccagtaacttccttaatccgcaggatgatcttgctttcaagtttgaatatgtgcatccatatattgatggtgtatataatcctcgcaaccgaactttcaaagcaagctgcttcaatagcagaaagttgagtcctgtttttacaggtggtccaggactggatgaagttcctcctatttgggttgatagatctggtctgaaagcaaatattaccgagaatttcacaaggcagagtaagtttacttatgggcttgtatgtgaagagattactacacgggatgaaagcagccatattgccactactggccaaaggattttgccaaatggtggaattagtgctgatgggcctccaacaactttaagtgatactggtgttgatcgtatggtgtttgcacaggcaaatatcacacgggataatacaaagtttgtaaatggagctatagttggtgacagaaatgtgtttcaggtagaccaaggccttgggataggcactaaattcccatttttcaaccgtcatcaactgacactaacgaagttcctccaactgacgcaagttgaagaaggcgctggaaaaccaccaccaccaattcttgtcctacatggtcactatggtggttgtgtgggagaccttccaagttatgaggctttcacccttgggggaccctattctgttaggggttacaacatgggagaacttggtgcagctagaaacattcttgagcttgctgctgagttacggatacctgtcaaaactacacatgtgtatgcttttgctgaacatggaaacgatcttggaagctctaaagacgtcaagggtaatccaactgaagtttacaggagaatgggcaagggttcgtcttatggagttggtgtcaagctaggtcttgttcgagccgagtatgctgtggatcataattctggtactggctcattgtttttccggttcggggagaggttttgagcttgatggcattcattttttgaatttgttttagctttttaatagattgatgtagaatggaatttgtgagggtgaatggcggatttttagttttagtataacccattgtctgctaatggaactatgggatttcagatatgagaacggattttttttagtcaaaaaaaagaaaaaaaaacaaaaacatgtcggccgcctcggtctcta

SEQ ID NO: 265 - DNA, 781 bp, Amaranthus rudis
cttttgtagaatttcacaaggcagagtaagtttacttatgggcttgtatgtgaagagattactacacgggatgaaagcagccatattgccactactggccaaaggattttgccaaatggtggaattagtgctgatgggcctccaacaactttaagtgatactggtgttgatcgtatggtgtttgcacaggcaaatatcacacgggataatacaaagtttgtaaatggagctatagttggtgacagaaatgtgtttcaggtaaatcatttttccattcttgattgttttttcccagtgtactgtgtttttgtcccatttcctgattcttgagctcagctgtgattcatgctatcaatgcactttctgacaatacagtttcgaaagtgattagatatagtgccatcactgatctccttataatgatgagtaatgattggcttatcaagtgcaaacattgctgccacctaaactagaaaattcttacttaagcatatactttgaagaaagctcctcccaagaaaaaaaaggaacaagggggaaacatgtccttgtttggatacacatatcatctgtttgctcttttttcatttggtgaactgctgtaatgatctacgaatataaacaattcaacctaagtaggcttcctttttttcgttttccaattttatgtttctgttgattcgaagggccctttttgtttgttggttaagaaaatgctttgaccaagaaggatatcttatccccccacataagccccccccccccccacactactacaaac

SEQ ID NO: 266 - DNA, 562 bp, Amaranthus rudis
cgatcgttttaggtgttttctcaggcggttgttatggggtgattttggtcggtggtcgacggtgctcgtgcaggttgtggggctgttctcgttaaggggttacaacatgggggaacttggtgcagctagaaacattcttgagcttgctgctgagttacggatacctgtcaaaactacacatgtgtatgcttttgctgaacatggaaacgatcttggaagctctaaagacgtcaagggtaatccaactgaagtttacaggagaatgggcaagggttcgtcttatggagttggtgtgaagcttggtcttgttcgagcgctgactttggcgtcttggcttggctgcccgtgggtgaggggggttagggtaggttgtttcgtcttgggactggtgggggttggtggtgttgggggttgatggtttaggtgttcattgggtttttgttttttcgaaggttttttggtctccttctggtgtttcgtatggttgtcgtgtttagtggtgtctgttttggattctatggtggtgctcctttggaattttcttgcttttgctgttggaatt

SEQ ID NO: 267 - DNA, 5300 bp, Amaranthus rudis
agcttgaaactttagttacttgtggtatgtttgagaaggttgatttagaagggaaaactaatcctgatggtactatcaaagtttctatcaatttcttcgaaagtacttggcaagctgctgagaaattcaggttttgttttgggatcatttttgtgttttcaattaattattgctccaagtgttatacattttgtgttgtttttgagacattggaatgtatatgctcaatttgttattattggaatgtatatggactataacctagattgattagtgtatacaagtggtgaattttttgtgttggtgtgtttgggtatttggattttgccattatcggtaggtctgatgaaatattttgagaaaatattgatgctcatcacaattgttaattgattattgcttcaagtattatacatttatactttatgtgttattggttttgggtgattggagtttatatgctcaatttgttattattgaaacttttgtgttggtggttttgggtagttgaaatttttcataattggtagggtaggtcagtgttcacacattttgagaaaatattgttacttattacaagttttgagtaaattgttttgattgtcacttcaagtattgtactttttgtgttgtttttgttcaatttgttatttttggaatgtttatagttactttcagtttctgtcaaagtagcatcccttgataagttgcttggaaatttaggttttttgtggccatgtttgagtttctagattggttagtgcataaaagtattgaactcttttgtgttagtgattttgggtagttgggatttatcataattggtaggtcattgatgaaacattttgagaaaatattgatacttcagttttgagtaaattgtttttgagaaagttgtagatctaataatggtggaaatagtgaaatggatgttaagttttatgtagttgagtagatgtatcaatgtggttgatgtttttttaatgtatgaatttttttgtatatgacctctaggtttatatcctgtactgctatatattttgaaattttcactgtgttcttactgatatgcaaaccaatatatagttgttccttgctagaagtatttctacaattttttttttgtggacttgcaaaataatatgtgcgacaattgaaattggtattggttttgtgtatttttgttcaggtgcattaatgtgggtttgatgccacaaacaaagcccgtcgagatggatcctgatatgactgaaaaggagaagctggattattttattagtcaggagaaggattataggaggaggattgacagagcacgtccgtgtcttttgccacctgcactttaccgagatgtgaggaagattttgatggacaaggggttggtatcagccaggttgctgcagcaaatcagggatacagttcagaaatggtatcatgacgagggctatgcatgcgctcaagtggttaattttgggaatttgaatacaaatgaagttgtttgtgaggtggtggaaggagatattacccaattgttgatccagtttcaggataaacttgggaatgtggttgaagggaatacacagtttcctgtcgtttggagggagctgcctaagcaggtaaaattcattttagagctgtttaaacatttataattgtgttcatcccttttaaaagaaaaaaattgcggatatcgttgagattgcggtaatggtcgcagtatcacagacgtggcaccttgtgtgtaacgactccttttgcggagattgccatgtggattgttcacttaaaaaatattttaacatagtaatttaagttttctataatatgtattccaattaaagcttttaatagcccttttaaaacctaatacagttaaaaaaagatagtaatgagttatttgttagaacttagaacaacaacttatatggttgttattccatgattacaaatcacaggctacataacatgttttgtggttcagtaagcttaaaatccgttatgaagcgctcgttgtgtaacgtaaggacctcatttatattcatcagtatacctccttgtccccacactcaaaactatgtgctgagaggagttcatgtttccttaattccttgtgatcataaatcaacaacaacattgctttacccaatgcttttaagtggctcccacttaggataaggtttggggggactcaatatacacaaccttacccttcttaattataacaataacaaagaagttttcgattgatccttggtagcaaacaccatatgcaacttcacataaatactaagtgcacatgatttaatgaacctttttactatattccattataatttaacaattgttttatcaattgcattattgttgtttcctaatttctagattaaaatttaaatatgatcattagaggcatacaaagaaaatataaatctagacttataattgataagatttgcatattcttagtttcaacttttttgaacaatataattggaaatatataagaatgttgaaaacatagcaaaagaaaatattttccattgtctacaagatctatgggggattatgtttcgctagtagatttatacttttgttttaggatcttgagatgtgatcattggaatatgttttacctagttggttactcaaacctacccttttggcaataagtaatgagttaggcgatttatttgttcatgtagtcgacccattggtgagaatccaatgctttgataacctaagggttcccctgcaaggttttccacggagggtgagggatggactataggacattgttgttttatttgatggaatagggtttaacaattaagagtttggaccaatgttactaggataaggaacgcggttgtaagtgcacttcaccatttttcaaattgaggtgggattgaaaagctttggatcgagatttttgggacgtggaatgttgtattctgaattttggtacaatttggggtctattagggtttttattgttacttggaaaaaaaaattatgaaatgaaaaaaaaatataattaaacaaatactatcaatagaacattatatatataaaaaattctatttaaaataataaatttatgtctcaaaaggatatttatataataaagacatgtagagtaaaataaaagaaaacgtatcctctagatccaattgtccatgataagttgtgaagtcggacaagttcacgaaactttagtctacactccacactatcgcccctcttttccaaaatctaacctcaacacacgtcaagactcgagatttataaacgctaaaactgtctcttctttttctattcttcatttcttcctcgagaaaaccaaaatcctatttccgaattttaaaattcctgccttcattttcttccctttttttgcattgttttcttatcgtcccctatgccgtgtatccaagaaaattgcaattaacaacaaagaaagattggcttatccaaatggttttgatgggcttacttaaagttggagaattaatagagattcatgcttcctcaccttattggctcactcaatttttaatgccaaatgttaactagtaagtttgttgaatatcttttttggtttagtgttctcttctatgatttctctacactgtattctgattatattcttgctcaaaaatctttttgcatgcttctttttaacattatgtcgacatgaaaaaaggatatgagttgtgtatgtcattgactttggtcgcgactcacttgtgatattgaatgattggttttgtggatcgatgcccaaacctttgattccgtgtttatggactatggcaaattaacttcttttcttgctatatgtttcagttactttttgttccattatcctaatgccattaagctcccacgtaggcgttgtttaagaggtcggatgttcacaatcttacttataaaacaagaggtcatttccgattacccttgtaaagaccgttggcaacttcacataactaagaagtgcgaatgatttaatgagtcattttactgtagtctatttaatcaaaaacaaaaaactataattctttacctactatcgagatggagcactttcttgtttcatgggctatgtaaattttatgatcaatgtagtgactaaagacaaatcttctgtagaagaaatagcttatgatgcttcactatttcataattatgttctgaggttatgataactgttgtgtgcctggttgtttgttctttgctggctcaagttcaagttgtctgagaactaactggacatgtttcttttgacatgatattatgttgaatgaacataacttttaagtgtgttgtaatatagtattgctatgtgtttactaaagcataagtcaatttgatgtggtgtctattttgtagcttagagtgggtcacgtctttaatatagaagcaggcaagcaagctttgagaaatataaactctctgggattattttcaaacattgaagtgaatcctcgtccagacgaaaagaatgaaggaggaattattgttgagattaaacttaaggaacttgatcagaagtcagctgaagtaagtacagagtggagtatcgttcctggtcgtcagggccgtcctacactggtaagtttcttttttgtttcctacaaacactcactataatagtatgtattatgagcttactggacttcttttgtaaaaactgtgatctgttaggcttctatccagcccggcggaactgtttcttttgaacacagaaacatcaagggtcttaatagatcgtttcttggttcagtaaccaccagtaacttccttaatccgcaggtaattttacttttgatatctgatctcttaaggctatcttattcataaggattaaagattaattaaagggctaccttttcctgtgtttggatgaaggttgcttgatgaataggcataggataaactatcctgtgtccttcctctcttttgtcttatgctctttaatgcctagatttactaatctgtgtgcggtgatttttttggtcattactgttaaactgtctcaagagatcagtatttttgttaggaaagatgtcaaggccacttttttttatgccacttcctggtgatattattattctgattttaactactacctgattttcaggatgatcttgctttcaagtttgaatatgtgcatccatatattgatggtgtatataatcctcgcaaccgaactttcaaagcaagctgcttcaatagcagaaagttgagtcctgtttttacaggtggtccaggactggatgaagttcctcctatttgggttg

SEQ ID NO: 268 - DNA, 2933 bp, Amaranthus rudis
gaagtcgcaatacgacatgcttggttgaaaataggaaaagtctgttcgaacagaaaagcctaatgattttagtgcaagggatacttgtttgattaggaaagtgaaaatgaatggatgaatttcaggaagagcactgagatcaaatgaattaaagtgtgtagttagttgggtggttttataataaatgaataaagtttataaatgaatcgataaatgaagtggacataatggagggaataaaggtttataaactcttgtactcgcaaaatttgcccagaaaactgtctttaacttattgaggtagagaattgagtaccaacaataggattccttattgtttgacttttcattaatgaaggggcaagttggggtctttttgtgatggcaatataagggtaggataattttgtggttttatgaagacgggtggaaaaagattagcaaagattgaagctttgaattgcttctcgctttgcatcacttttgggtgagtttagggtttcaaaaatctgtggtttatgactcatgatgatctttttggaatgaaaatttaagagttggttagttatgaggaaagtcgagggtgtgtggaaaaggattaggaaagattgacgcttttgaattacttctaccttgcgtcacttttagggttaggattttgattttttcttaagtaccaatgtcgaagtttttgatatgagatttttgggtttgacttttagtgtaatgtcgaagtgggtggaaaaagaattgctgaggttgaagctttataatgctttgattttgcattttaatggaggtttgatgatttttacttttaagcttgttgttagggaagatggaggcgtttcgatatgatagtttaggagatggatctatttaatattgtttacgtaaggatatggtttaattattaaagattaaatcattgttaaagattgaatttctggtcctatgattggaatagtcgaacaagtttttgtattttgttttgagttgtgattcacgaatggtgttagaaaattttcggaaggaatttttgttatgatgaatgaatttaaggaggaatgatttagtaattttctgattgagctatcaaaaaaagaaaagatataatcacttaactaatctaggctcaagaataggaatcaaatagatttctttatggatacggagatggagatggagatggagatggagatggcgatagcgtatgaaaggtaaattaatgaagatggcatatggtttaatgaaggatagaacgacactcctcgctacctacgccaatagaaaatctaagatttcctaagttcacattttagagcggcttattttctaaataagcaagggcgattctcactcactctcaatcctaaaagagtttatgatgcaacaaagagatgaacaaaacaattctgaattttaattaatcaatgcttgtgttttattggtaatggatgcctccataaatagaacatgaactgataaaaggttctagaaagtactaaaaacttaactgaataactgatatctaactgattaatccatcagctaaataatattaatattgaaagaaaataaaattttacctgaaaataggggatctggtgtgtaggatgaatctcatacatgactgataactaatttgctgttgttgatctttggaatctagcgcttttgggtttggatgaacttgaatctatcatgtgaatttggaataataaaataaggattaaactgatgtgggcttaatcaaatggctctacatgagcctttgctacaaaaaaaaaaagatccatctggctagggctgatctgttaggcatttgattgtaggcctcttttttacacgccaactaatggacgtttattccttgttctgtctttcctgcatatgaagtcattgccttgcaggccttcagactctttattacaatttaaagtacaagacttaaaagctagaacatttaattctaataaatccatttttctaactgaagcacaagcgctctatttatttaataaatgaaaataaatagtgaaaatgtgaaactgaaataatatattgtttatagacagagtttcatctagctgccttatattgcttattctgtttagccttcattattgcagtattttgagttctgacatctatccatttttgtcttctgactgcaggtagaccaaggccttgggataggcactaaattcccatttttcaaccgtcatcaactgacactaacgaagttcctccaactgacgcaagttgaagaaggcgctggaaaaccaccaccaccaattcttgtcctacatggtcactatggtggttgtgtgggagaccttccaagttatgaggctttcacccttgggggaccctattctgttaggggttacaacatgggagaacttggtgcagctagaaacattcttgaggtatgagttttcagttctttaatatctttgtggttctagctgtgcgccgaattcagcacagacgtgatatggtgaatccggtgaccttttggaggaaattgggacaaatagcgctgccttttatttgtgaaaatttatttggtgggctgttgaggggaatagattaaatttctttttaaatttttttaaaaaattatgtgttcatacttggttacattaatctattagcaatatatccaaaatgccaagttccagttatgagaaagtgacgtatcttgctccagtcgttgatccatttgagtgcgtttttattgtagcttgctgctgagttacggatacctgtcaaaactacacatgtgtatgcttttgctgaacatggaaacgatcttggaagctctaaagacgtcaagggtaatccaactgaagtttacaggagaatgggcaagggttcgtcttatggagttggtgtcaagctaggtcttgttcgagccgagtatgctg

SEQ ID NO: 269 - DNA, 230 bp, Amaranthus rudis
aaagagcttgaaactttagttacttgtggaatgtttgagaaggttgatttagaagggaaaactaatcctgatggtactatcaaagtttcaattaatttcttcgaaagtacttggcaagctgctgagaaattcaggttttcttttgggattatttttgtgttttcaattaattattactccaagtgttttactttttgtgttcttgtttttgggtcattggaatgtatatg

SEQ ID NO: 270 - DNA, 5994 bp, Amaranthus rudis
  unsure (1)..(5994): unsure at all n locations
  unsure (1)..(5994): unsure at all n locations
cattatcctcaccttctcaattatcctctcgcctctccaaaacccactcttctcttcaccttcctcacaatgcccacctctccatatccactcccaatcccataaactcttcttctaataccacccacagtcatcctcctaattctcttcaaaactctcttaaacaatctttctcaaatccccttaactcaatcctttctcacccaatttccaaaacccttatcatctcttctcctattggtctcctcatcttcttcattggcggaaatggaggttccaacaatgggggtaacggaggtggaggtggcggcggcggcggcggcaatggtggtggtaactcatggtggtcacgttttctatcaccccaagctctagcagaagataataatgatggtgattctgagaattgggatcctcatggattaccagctaatattgtagttcaactaaataaattaagttggtttaagaagtataaggtttctgacatactcttctttgatcacaaagaactcgtaccactgttggtattgaagattcattctttgaaatggtttctttgagacctggtggtgtttatactaaagcacaactccagaaagagcttaaaactttagttacttgtggaatgcttgagaaggttgatttagaagggaaaactaatcctgatgggtctattaaagtttctattaatttctttgaaagtacttggcaagctgctgagaaattcaggtttgttttcttgatggggttcttttttaagtttttgtgttagagcaaatactcttttaatggagattctaattacaaagattgaaaaaatgtaaagaaatatacaaagacaccaagaattggaaggtgggaaaatcctattatcaaattgatattagactataacacccacccaaagaatgaagataattatattgattagttcttgattacacacactaatcaattctaacaatggggttgataaactatagagattacatgagtaaattaaaaacccccaatttcactcaagaaccctattttgtggctctctctatctagatcaatctcccttacaagaggattacaatgtgtttctctctcttgattacaatgtaattcataccaaatgatgttttcattgagtatttatagtgttaataacaaggatgggcagcctttaaaagttcacacaaaacagagaacaaaaacagaaactgcacgtgatgggcgtagctagctcgaccaagttgagccacactgctcgatcgagggacctatagcgtgggtcgagccaaacagctcgagtgactcgagcaagatgcatcaacattccgaccttgtgcttatattcctcacatgctcatccattccaagctcaccatactcaacacaaaatcaaactaacacatgagattatgagtcacaaaacacaacattttggattgattgttgcttcaagtattgatcttgttgttatttttgggtatatgtttattttgatattattgaaatgtatgcatttatttgaaagtgtcatcatttggtatgttgctgtgaaattcaggtttgttttgttatggggttcatttttgagtttttgattgattgttgcatcaagtattgatctttttgttttcttatttttgggtatatgctcaatttgttatcattttgaaagtgttatcaattgtatgatgccgagaaattaagggttttcttatgtgtttttagattgaattttgcttaaggtattgaactttttatgtgtaatttgggttattggaattgatcataatctaggtcatacaatgacacaatttgagaaattttgatacttgtgaatcacaagttttgaggaagttgtagttcaaataaaatggattaagtgaaagggttaatgtgtttatgtaatgcggggttctaaatttttgtgttatttctggggtgaatgaatttatctgctctattttttcttttggaaatttattgtgattgatgaaggaattccatctttataacaataatgaaccgctagcagctttagcttttttgatatgcaaatcataagtgttcacttcagtttgattgttcctttctagctcactgaggagtcatttttagaaatttgtttatgagtaaatttgattatcaatgcaaaaaattgaaattggtcctgattttttctgtttaggtgcatcaacgtggggttgatgccacaaacaaaggcagttgagatggatactgatatgactgaaaaagagaagctggatttttttattaaccaggagaaggattataggaggaggattgataaagctcgtccgtgtcttttgccacctgcagtttaccgaggtgtgaggaagatattgatggataagggactggtttctgcgaggttgcttcaggaaattagggatacagttcagaaatggtaccatgacgagggatatgtgtatgctcaagtggtcaattttgggaatttgaatacaaaggaagttgtttgtgaggtggtggaaggggatattactcagttgttgattcagttccaggataaacttgggaatgtagttgaagggaatacacaatttccggttgtctggagggagttgcctaagcaggtaatgttttttagttctttgttgcatatcgtcaaagttgtgttcatcttttgtagcatgcctccttgtctacaatctagaatgtgaacgtcaaatagtggaataccagctttgtcatgcattgagaggagtttttgtttcctcaatttcagtggcctaaatatgctctgtttttgtatcgctatatatttgttgcataattgcttgttccaagtcaaatttcgaaaatagatgagcattagagacatagataaagccaatagtatatggagtcaatgtactgtatacgagcctcgactcaacttcttggcaaagtatacaataatgttgttgtgcaccactccgtacattccactctaacccacactccttattcccactccacaaacgcacactccttattctctactccactagcctagtagcatgttaagcttggtgcttactgattttagtatgcactaggtgttcaagtccacacaagagtttatacaacttttatcgttgtaattggaattaaacatgaatgttcgaacaaaaaaaaaaacatttttacttgcattttgtgttggatctttgggcattaggtttactaatagatctatacaagaaaaatacaaaggaatcctcaaaaaaaaaaaaaagaaaaatgcaaaagaggattaagatttagcatttatgtctatgactattttaattttttctttgcttaatgtactatgtaaaattttaatatcatattagatactaacacaacaccttttgtaaaaagaaataggttatgatgctaactatttcataattatattcagatgttatgaagttgtgatgctgttgttctattacttttttttcctttttttttgagatggaaaattttcaaatgaacataacaagtgtgttgtaatatagtattcctatgttctaccaaaggatcaattagttcgatgtggtttctattttttgcagcttagagtgggccatgtctttaacatagaagcaggcaaacaggctttgagaaatataaactctctgggattattttcaaacattgaagtgcatcctcgccctgatgaaaagaatgaagggggaattattgttgagattaagctcaaggaacttgatcaaaagtcagctgaagtaagtacagagtggagtattgttcctgggcctcaaggtcgtccaacactggtaaatttcataattttttcctactaatatcattttgttttatgtattaagtttttacttgacactatgctaaacctgtgatgcatcaggcttctatacagccaggtgggaccgtctcttttgaacaccgaaacatcaaaggtctcaatagatcatttcttggttcagtaaccactagtaacttccttaatccacaggtattttacttttatatatgatctcttaaggctttattgggttctcaccctaaaagggttatcaattatcatatatgtccttcaaagaagggctgccttataaatagtcatgaatcatgttaggctctcttgtgtgcttcctctctttctcctactgttttacttttcatcttctattctttcagttaggagtgattgtttttagtcattagacttttttttttgaaagatagtcattagacttgttattgctagttgttccttatttcgatggagcgaaagaattattgttctttggtttcaaattataatgcgctattgcaaaatggcttgtcaaaccatacgtacttatttatgtgaagttgcatatgatgtttgctaccagggatcaataaaaaacaatctctttgttagttatattactaacaagggtaaagttgcgtacatttgacctacgaaccccatcataggttggagccactttacgacattggggtagtggagtgttgttgtagacttgttgctactaaactttatctgaagacttctcaggaaagaagtgcaactttttgccgctctttcttcgatggtatttagaattaaactactttctgattttcaggatgatctttctttcaagttcgaatatgtgcatccatatattgatggtgtatataacccacgcaaccgaactttcaaaactagttgcttcaatagcagaaagttgagtcctgtgtttaccggtggccccggactagatgaagttcctcctatttgggttgatagatcaggtgtgaaagcaaatattactgaggttggtatgcttttttattttttttgaatttaatgcaactagtgttgtggacttaatttcttcggctcttaatggttacaaattgatgttccttttccagaatttcacacgacaaagcaaatttacttatgggcttgtatgtgaagagataacaacacgggatgaaagcggccatattaccacaagtggccaaagaattttgccaaatggtggaattagtgctgacggacctccaacaaccttaagtgaaactggtgttgatcgtatagttttcgcacaagcaaatatgacacgagataatacaaaatttgttaatggagctacagttggtgacagaaatgtgtttcaggtaactcttgtccatccttattgttttatgatattctcttagtatgctgtgttgtcccatattcttgattcatgattcttgtgcttagtagtggttcatgcttcatgttggcaaatacactttttcgtaatacataaataagctagataatgttgatcggcttatcggactgcaaacactactacctagactagaaactttttaggataacatatacttggaatttggaggaaagctcctcccaagaaaaagggaagacggaggaggggggatacattttcttttctggaacttattcatgtgtgctattatgatatgaatgttatgtttgaacctcttaccaaaatcattttttaaaacattatatataacatgacattcatattttaatagcatacaaacttaaaaaaattcattatcattgatgtaaacactattataacacataatgtcataagataaacaatagaatcaaacaatatacttatacaattaaatcaaaacttaaaatagatatgtactaattttttttctcttctaatacttaagtactaagaaaacaggtattagagctattatttgaatatgatcaatagtataaatctgtatccacaaggcgcacgaatcctaaggtgcacaagacgcacaaaaggcgtgcctctagctcgcctcatgtatctcgctgcgcctaaaggtctgcctttgttgctattgatctaagcggttgttatatacatagtgtaaaaatgcggtannnnnnnnnnnnnnnnnnnnnnnnnnctgatgcggtaacgagagtgatgggttatcatatcatctaaatatcgg

SEQ ID NO: 271 - DNA, 911 bp, Amaranthus rudis
ttaattgatataagaatattcatatttaatcaaaagttgaaattattacggaaaaatagatcattctcaataattttgaggtgagatttattttcgggttggatccaatatcgatagtgggtggggacttttggcacaacactcgttggacctccaataacagtcccgagacatccgatacacctctcttccttctcccttctttaaaccctcagaaatcccttcttttttcctcctctgacctttccttatccacccatcaatggcggccttcaccattccaggcgccatcaccactcctccattatcctcaccttctcaattatcttctctgttctccaagacacaccattcttttcacctttctaacaatacccatctctccaaatccgcttccattcactcttttctcccctctcatgaatccacaaaaaaccctaatcaatctttccggaattctctgacatcctcttacgtaaagccccttcaatcaattctttctcatccaatcaccaaaaccctaatcatatcttccccaattggactcctcattttcttcaatggtggaaacggaggtttcagcaatggtggtggtggtggtggtggtggtagcggtggtaatggagattcatggtggtcacctttgcttacaccaacagccttagcagaagatgataacgataatggttctgacaaatgggatcctcatggattaccagctaatattgtagttcagcttaataaattaagcgggtttaagaaatataaggtttctgatattcttttctttgatcaaagaactaaaactactgttggtactgaagattcattctttgaaatggtttctttgagacctggtggagtttatactaaagcacagcttcaaaaagagcttgaaactttagttactt

SEQ ID NO: 272 - DNA, 2874 bp, Amaranthus spinosus
tcaaaataaaatcataaaaaagaaattgtatgatcataaataagaaaaaatttaataacaatcccacatagcagcatcagcagcaaacaccagggagaagtgttttgctgcaatttccccattttttttaagccacccaaatgatttttatggtttatacatacattttcccctgcaaatcctactcttttttcctgcaattttttttttggttttctttctcagctgcaccagattttatttcacaactcttgagataaagagacagaatatccataaatttttgtggcaaagagaattatatcctagtaatttcctcctccgacctttccttatccacccatcaatggcggccttcaccattccaggcgccatcaccactcctccattatcctctccttctcaattatcttctctcttctccaaatcccaccattctcttcacctttctaacaatacccatgtctccaaatctgcttccattcactcttttctcccctctcatgaatccacaaaaaaccctaatcaatctatccggaattctcttacatcctcttacgtaaatccccttcagtcaattctttctcatccaatcaccaaaaccctaatcatatcttccccaattggactcctcattttcttcaatggtggaaacggaggtttcaacaatggaggaaatggtggtggtggtggtggtggtagcggtggtaatggagattcatggtggtcacgtttgcttacaccaacagccttagcagaagatgataccgataatggttctgacaaatgggatcctcatggattaccagctaatattgtggttcagcttaataaattaagcgggtttaagaaatataaggtttctgatatccttttctttgatcaaagaactaaaactactgttggtactgaagattcattctttgaaatggtttctttgagacctggtggagtttatactaaagcacagcttcaaaaagagcttgaaactttagttacttgtggaatgtttgagaaggttgatttagaagggaaaactaatcctgatggtactatcaaagtttcaattaatttcttcgaaagtacttggcaagctgctgagaaattcaggtgcatcaatgtgggtttgatgcctcagacaaagcccgttgagatggatcctgatatgactgaaaaggagaagctggattattttattagtcaggagaaggattataggaggaggattgataaagcacgtccgtgtcttttgccacctgcactttaccgagatgtgaggaagattttgatggacaagggtttggtatctgccaggttgctgcaacaaatcagggatacagttcagaaatggtaccatgatgaggggtatgcatgtgctcaagtggttaattttgggaatttgaatacaaatgaagttgtttgtgaggtagtggaaggagatattacccagttgttgatccagtttcaggataaacttgggaatgtggtagaagggaatacacagtttcctgtcgtctggagggagcttcctaagcagcttagagtgggtcacgtctttaatatagaagcaggcaagcaagctttgagaaatataaactctctgggactattttcaaacattgaagtgaatcctcgcccagacgaaaagaatgaaggaggaattattgttgagattaagcttaaggaacttgatcaaaagtcagctgaagtaagtacagagtggagtatcgttcctggtcgtcagggtcgtcctacactggcttccctccagccaggcggaactgtctcttttgaacacagaaacatcaagggtcttaatagatcatttcttggctcagtaaccaccagtaacttccttaatccacaggatgatcttgcattcaagtttgaatatgtgcatccgtatattgatggtgtatataatcctagcaaccgaactttcaaagcaagctgcttcaatagcagaaagctgagtcctgtgtttaccggtggcccaggactggatgaagttcctcctatttgggttgatagatctggtctgaaagcaaatattaccgagaattacacaaggcagagtaagtttacttatgggcttgtatgtgaagagattacaacacgggatgaaagcagccatattgccactactggccagaggattttgccaaatggtggaattagtgctgatgggcctccaacaactttaagtggtactggtgttgatcgtatggtgtttgcacaggcaaatattacaagagataatacaaagtttgtaaatggtgctatagttggtgacagaaatgtgtttcaggtagaccaaggccttgggataggcactaaattcccaattttcaaccgtcatcaactgacactaaccaagttcctccaactgacgcaagttgaagaaggcgctggaaaatcaccaccaccagttcttgtcctacatggtcactatgctggttgtgtgggagaccttccaagttatgaggctttcacccttgggggaccctattctgttaggggttacaacatgggggaacttggtgcagctagaaacattcttgagcttgccgctgagttacggatacctgtcaaaaccacacatgtgtatgcgtttgctgaacatggaaacgatcttggaacctctaaagacgtgaagggtaatccaactgaagtttacaggagaatgggcaagggttcgtcttatggagttggtgtcaagcttggtcttgttcgagccgagtatgctgtcgatcataattctggtaccggctcattatttttccggttcggggagaggttttgagcttgatggcatttatttttgaatttgttttagctttttgatagattgaagtagaatggaatttctgaggg

SEQ ID NO: 273 - DNA, 2718 bp, Amaranthus thunbergii
acaaatcccttctttttcctcctctaaccttttcttatccacccatcaatggcggccttcaccattccaggcgccatcaccactcctccattatcctcaccttctcaattatcttctctcttctccaaatcccaccattcttttcacctttctaacaatacccatctccccaaatccgcttccattcactcttttctcccctctcatgaatccacaaaaaaccctaatcaatctttccggaatcctcttacatcctcttacgtaaatccccttcaaccaattctttctcatccaatcaccaaaaccctaatcatatcttccccaattggactcctcattttcttcaatggtggaaacggaggtttcaacaatggaggaaatggtggtggtggtggtggtggtagcggtggtaatggagattcatggtggtcacgtttgcttacaccaacagccttagctgaagatgataacgataatggttctgacaaatgggatcctcatggattaccagctaatattgtagtccagcttaataaattaagcgggtttaagaaatataaggtttctgatattcttttctttgatcaaagaactaaaactactgttggtactgaagattcattctttgaaatggtttctttgagacctggtggagtttatactaaagcacagcttcaaaaagagcttgaaactttagttacttgtggaatgtttgagaaggttgatttagaagggaaaactaatcctgacggtactatcaaagtttctattaatttcttcgaaagtacctggcaagctgctgagaaattcaggtgcatcaatgtgggtttgatgccacagacaaagcccgttgagatggatcctgatatgactgaaaaggagaagctggattattttatcagtcaggagaaggattataggaggaggattgataaagcacgtccgtgtcttttgccacctgcactttaccgagatgtgaggaagattttgatggacaagggtttggtatctgccaggttgctgcaacaaatcagggatacagttcagaaatggtaccatgacgaggggtatgcatgtgctcaagtggttaattttgggaatttgaatacaaatgaagttgtttgtgaggtagtggaaggagatattacccagttgttgatccagtttcaggataaacttgggaatgtggtagaagggaatacacagtttcctgtcgtctggagggagctgcctaagcagcttagagtgggtcacgtctttaatatagaagcaggcaagcaagctttgagaaatataaactctctgggattgttttcaaatattgaagtgaatcctcgcccagacgaaaagaatgaaggaggaattattgttgaaattaagcttaaggaacttgatcaaaagtcagctgaagtaagtacagagtggagtatcgttcctggtcgtcagggccgtcctacactagcctccatccagccaggcggaactgtctcttttgaacacagaaacatcaagggtcttaatagatcatttcttggttcagtaaccaccagtaacttccttaatccgcaggatgatcttgctttcaagtttgaatatgtgcatccatatattgatggtgtatataatcctcgtaatcgaactttcaaagcaagctgcttcaatagcagaaagttgagtccagtgtttacaggtggcccaggactggatgaagttcctcctatttgggttgatagatctggtttgaaagcaaatattaccgagaatttcacaaggcaaagtaagtttacttatgggcttgtatgtgaagagattacaacacgggatgaaagcagccatattgccactactggccaaaggatattaccaaatggtggaattagtgctgatgggcctccaacaactttaagtgatactggtgttgatcgtatggtgtttgcacaggcaaatattacacgagataatacaaagtttgtaaatggagctatagttggtgacagaaatgtgtttcaggtagaccaaggccttgggataggcactaaattcccacttttcaaccgtcatcaactgacactaaccaagttcctccaactgacgcaagttgaagaaggcgctggaaaaccaccaccaccagttcttgtcctacatggtcactatggtggttgtgtgggagaccttccaagttatgaggctttcacccttgggggaccctattctgttaggggttacaacatgggggaacttggtgcagctagaaacattcttgagcttgctgctgagctacggatacctgtcaaaaccacacatgtgtatgcttttgctgaacatggaaacgatcttggaagctctaaagacgtcaagggtaatccaactgaagtttacaggagaatgggcaagggttcgtcttatggagttggtgtgaagcttggtcttgttcgagccgagtatgctgtcgatcataattctggtactggctcattatttttccggttcggggagaggttttaagcttgatggcattcatttttttgaatttgttttagctttttgatagattgatgtagaatggaatttctgagggtgagtggcggatttttatttttagtataacccattgtcttctaatggagctatgggatttcagatatttagtcaagtagagttgtcaatacttccctccttaatttgtatgtttgtatgtcgaagtctaaagacataagc

SEQ ID NO: 274 - DNA, 2606 bp, Amaranthus viridis
atcccttcttttttcctcctctaaccttttcttatccacccatcaatggcggccttcaccattccaggcgccatcaccactcctccattatcctcaccttctcaattatcttctctcttctccaaatcccaccattcttttcacctttctaacaatacccatctccccaaatccgcttccattcactcttttctcccctctcatgaatccacaaaaaaccctaatcaatctttccggaatcctcttacatcctcttacgtaaatccccttcaaccaattctttctcatccaatcaccaaaaccctaatcatatcttccccaattggactcctcattttcttcaatggtggaaacggaggtttcaacaatggaggaaatggtggtggtggtggtggtggtagcggtggtaatggagattcatggtggtcacgtttgcttacaccaacagccttagctgaagatgataacgataatggttctgacaaatgggatcctcatggattaccagctaatattgtagtccagcttaataaattaagcgggtttaagaaatataaggtttctgatattcttttctttgatcaaagaactaaaactactgttggtactgaagattcattctttgaaatggtttctttgagacctggtggagtttatactaaagcacagcttcaaaaagagcttgaaactttagttacttgtggaatgtttgagaaggttgatttagaagggaaaactaatcctgacggtactatcaaagtttctattaatttcttcgaaagtacctggcaagctgctgagaaattcaggtgcatcaatgtgggtttgatgccacagacaaagcccgttgagatggatcctgatatgactgaaaaggagaagctggattattttatcagtcaggagaaggattataggaggaggattgataaagcacgtccgtgtcttttgccacctgcactttaccgagatgtgaggaagattttgatggacaagggtttggtatctgccaggttgctgcaacaaatcagggatacagttcagaaatggtaccatgacgaggggtatgcatgtgctcaagtggttaattttgggaatttgaatacaaatgaagttgtttgtgaggtagtggaaggagatattacccagttgttgatccagtttcaggataaacttgggaatgtggtagaagggaatacacagtttcctgtcgtctggagggagctgcctaagcagcttagagtgggtcacgtctttaatatagaagcaggcaagcaagctttgagaaatataaactctctgggattgttttcaaatattgaagtgaatcctcgcccagacgaaaagaatgaaggaggaattattgttgaaattaagcttaaggaacttgatcaaaagtcagctgaagtaagtacagagtggagtatcgttcctggtcgtcagggccgtcctacactagcctccatccagccaggcggaactgtctcttttgaacacagaaacatcaagggtcttaatagatcatttcttggttcagtaaccaccagtaacttccttaatccgcaggatgatcttgctttcaagtttgaatatgtgcatccatatattgatggtgtatataatcctcgtaatcgaactttcaaagcaagctgcttcaatagcagaaagttgagtccagtgtttacaggtggcccaggactggatgaagttcctcctatttgggttgatagatctggtttgaaagcaaatattaccgagaatttcacaaggcaaagtaagtttacttatgggcttgtatgtgaagagattacaacacgggatgaaagcagccatattgccactactggccaaaggatattaccaaatggtggaattagtgctgatgggcctccaacaactttaagtgatactggtgttgatcgtatggtgtttgcacaggcaaatattacacgagataatacaaagtttgtaaatggagctatagttggtgacagaaatgtgtttcaggtagaccaaggccttgggataggcactaaattcccacttttcaaccgtcatcaactgacactaaccaagttcctccaactgacgcaagttgaagaaggcgctggaaaaccaccaccaccagttcttgtcctacatggtcactatggtggttgtgtgggagaccttccaagttatgaggctttcacccttgggggaccctattctgttaggggttacaacatgggggaacttggtgcagctagaaacattcttgagcttgctgctgagctacggatacctgtcaaaaccacacatgtgtatgcttttgctgaacatggaaacgatcttggaagctctaaagacgtcaagggtaatccaactgaagtttacaggagaatgggcaagggttcgtcttatggagttggtgtgaagcttggtcttgttcgagccgagtatgctgtcgatcataattctggtactggctcattatttttccggttcggggagaggttttaagcttgatggcattcatttttttgaatttgttttagctttttgatagattgatgtagaatggaatttctgagggtgagtggcggatttttatttttagtataacc

SEQ ID NO: 275 - DNA, 1169 bp, Ambrosia artemisiifolia
gggactaaacctaaacatcaacatccatatatatataaatctcacccaccaaatcactatatataaatctcacccggttcaatcgagtgagtcaactcacctcactcactcataaacccccttatctacaatggcgtccatctccgccggctccggccaattcctccctctccgccaccgtcaccgtcactccaccgtcacatctccaccttcctccacctccttcaccaccacccccatcacatcccatattatttcctctcataaccctaacaaaccctccaaaaccctaatttctaaaccctccttattctccgtcaaaaacctcgccctctccgccgccgccggtgtcttattccacgtcaccttcaaaaaccccaataatatcctcaattccgccggcggcggcggtggcggcggcggaacttcctccggcggtggcggtggtggaaactccggtggtggtggtggtggtgggtggtggaggagattgttgtgtcctgaagctaatgctgatgagaatcagtcatctgaatgggattcacatggtttaccagctgatattactgtgcagttaagtaagcttagtggatttaagaaatataaggtgtctgatttgttgttttatgataaggttaagtctgttgtggtcgggtcggatgattcgtttttcgaaatggtttcgattaaagcgggtggggtttatacgaaagcgcagttacagaaagaggtagagacgttagctacttgtgggatgtttgagaaggtggatatggaagcgaagacgaacgcggacgggacgattgggttgaaggtgtcgtttacggagtcgacgtggcaagtggcgaataggtttaagtgtattaatgtagggttgatgcagcagtcgaaagcggttgagtttgatgagaatatgactgagaaggagaagatggattatatgaagagtcaggagagggagtataagagaaggatggagcggtcgaggccgtgtatgttgccgaggccggttcatgaggagattttgcagatattgaggaaggggaatgtgagtgctaggatgttgcagaatattagggatagggtgcagaaatggtatcatgatgaagggtatgcttgtgctcaggttgtgaatttaatttgaatacgaatgaagttgtttgtgaggt

SEQ ID NO: 276 - DNA, 787 bp, Ambrosia artemisiifolia
gggtagtgtagggtatggtgggtagtgggtcaaaacaggtaacttttggtgtcggcctatttaggtcacactttttgtccagtttttataaatatatatacaaataacatgctgtacgttatcccaaaaatcatattattgaatctattcaatgattgttgaaaagttataaataaagtgatataggagaggtttaatgcacttttgatcagcacagcccattgacctgccaagcttttttttatgtcctgttttcattcataatgagttgaagtgtaacaaaattaaatcaattgtttttctacgccaaagtcatattctgttatccgtaagcatggtcattaaacgatggcaagtatcaccattttctgcaggttgctgctgaattacgtataccagtgaaaaatacacatgtatacgcttttgtagaacatgggaatgatctggggagttcaaaagatgtgaaaggaaacccaactgaggtttacaggcgcatgggtcagggttcttcgtatggtgttggtgctaaactagggttggttcgtgcagaatatgccattgatcacaattcagggactggtgccttgtttttcaggtttggtgagagattctaatcttttgctagtttcggtatttttgcagctcggataaagaggttcttgtgtgagattcaaacctaaatgttgaatagaatattaatatttttgctagaatcaagtcgggatgatctatcgacatacgagttatgttttgaattgtggatgttagtgttttatcaagttgtgac

SEQ ID NO: 277 - DNA, 914 bp, Ambrosia artemisiifolia
tttttccgttccactgattccattttttcttaaatagtcgttcactaaaagcattctggcaagggtgcatactccacccttgaaccaactgagctacacgcccaggggcaactaaaagttcgaatacactgtggatggcatttgccccatttggcaagcatgaccagtacaacccaattcattttaaccatcttttaagttttagccatttgacttgggttgtaactgtcacctgtcatgtttaaccatcagaaatctgtccagttttttctgagtctatgtagtccatgaaacttatttaatatacattcatacatgataagtgataatacccagaagctgcatttctactagaggtggcaaaatgggtggcactggcaggttgggtaacaattcaaaactgttttaattacaggtctgaaccggcttcagcttgtaaattttaaatttgtcaaataaaattgtaaaatctacaatgttaaaacatttatatgttttgttaaaaaattattttgagggtactctaaacatttgagtacacattggatgggttttgactggtttacttttgctaggctctaattcattagccatcataagtgtgttcacttaatcttgaattcacctgtcttggaactttactaaattgcagcttgatcaagggttggggattggcagcaaattccctattttcaaccgtcaccagctaacaatgacaaagttcatccaactgaagcaagtagaagaaggtgctggcaaaccaccgccaccggtgcttgttcttcatggtcattatggtggctgtgtgggtgaccttcctagttatgatgcatttactcttggtggaccctactctgttaggggttacaacatgggcgagattgctgctgctagaaatatcctcgaggtacata

SEQ ID NO: 278 - DNA, 1259 bp, Ambrosia artemisiifolia
acttttgacccatttcacttgctctgccttaagtttctttgtttttattttcttttacctgtttgattccttaggatagaacttaacccgaatcaacccattgattagtaaaaatggtaatggctgccttgataagatattggtaaaaacagtggtaacaagcagcttttttgcaggatgatcttgcttttaagctcgaatatgtgcatccttacttagacggtgtatctaatcctcgcaatcgcaccttgcgtacaagtgttttcaacagcagaaaaatcagctcagttttcacaggtggacccggagtggatgaagttcctcctatatgggttgatagagctggcgttaaaaccaacattactgaggtaaattactaattacccttatttctatgcactatctcttgttgattatgttaaatgtgtacattattcagaattttactcgtcaaagcaagtttacatatggaattgtaatggaagagataacaacacgtgatgaaagtagtcatattgcttcaaatggtcaaagggttttgccaagtggcggaattagtgcagatggcccgccaacaacactaagtgggacgggtgtagatcggatggtatttgcacaagcaaatattacaagagacaacaccaagtttgtcaatggtgcaattgttggtgagagaaatgtttttcaggtcagtcttctagactaattttcatacaggccggaccggctagttatgggtcgaaacaggttcatgtaaatgggtatgctttaaaatgagttaaatgggccaggtcgaggttgtatgcccacagacactttctttgtcttctcttttcttgagtttatacggataatgttaaaaatatgattaagaaacgtatattgttacaatgatatttaattatttaacctttttttaacagccaaacaaaaccattttatttcacaaacacccaaccttcttcatagcaagtcactaattacattacagattatacattgcacttccaaacatacatagctaatacaaatgttcaatcgaaatctgtcccttagaacctataccactcttggtacagtatctcctttagttcagatcttttacttacccaccaaaatgtagcttcttttacttcttccacctcttggtgcgccgagacggctgaccctttaaatattttttcgttccattgattccattttttcttaaatagtcgttaactaaaagcattctggcaagggtgcatactccgcccttg

SEQ ID NO: 279 - DNA, 273 bp, Ambrosia artemisiifolia
gcattaatgcattactgggctttttgtgcttccattgtttgcatatatcatgatagacattcgtattaatcatacaacatgatatttggcttgcagcttcagaaagggaaggttttcaacattgaagctgggaagcaagcattacgtaacatcaattctctatctttattttcaaatatcgaagttaatccgcgcccagatgagaaaaacgagggtggaattattgttgaaattaagcttaaagaactcgagcaaaaatcagctgaagtcagt

SEQ ID NO: 280 - DNA, 2510 bp, Ambrosia trifida
caccaccacccccatcacatcccatataatctcctctcataaccctaacaaaccctccaaaaccctaatttccaaaccctcgttattctccgtcaaaaacctcgccctctccgccgccgccggtgtcttattccacgtcaccttcaaaaaccccaacaatatcctcaatttcggcggcggcggcggcggtggtggtggagcttcatctggcggcggcggcggtggtggtgatggtggtggcggtggtgggtggtggaggagattgttgtgtcctgaagctaatgctgatgagaatcagtcatctgaatgggattctcatggattaccatctgatattaatgtgcagttgagtaagcttagtggatttaagaaatataaggtgtctgatttggtgttttatgataaggtgaagtcggttgttgtcgggtcggatgattcgtttttcgaaatggtttcgattaaagcgggtggggtttatacgaaagcgcagttacagaaggaggttgagacgttagctacttgtgggatgtttgagaaggttgatatggaagcgaaaacaaacgcggacgggacgattgggttgaaggtgtcgtttacggagtctacgtggcaagtggcgaatcggtttaagtgtattaatgtggggttgatgcagcagtcgaaagcggttgagtttgatgagaatatgactgataaggagaagatggattatatgaagagtcaggagagggagtataagagaaggatggagcggtcgagggcgtgtatgttgccgaggccggttcatgaggagattttggagatattgaggaaggggaatgtgagtgctaggatgttgcagaatattagggatagggtgcagaaatggtatcatgatgaagggtatgcgtgtgcgcaggttgtgaattttgggaatttgaatacgaatgaagtcgtttgtgaggtggtggaaggggatattactcgggtcgtgattcagtttttggataagcttggaaatgtgtgtgaagggaacactcagatgggagtagtgaggagagaattgcctaaacagcttcagaaagggaaggttttcaacattgaagctgggaagcaagcattacgtaacattaattctctatctttattttcaaatatcgaagttaatccgcgcccagatgagaaaaacgagggtggaattattgttgaaattaagcttaaagaactcgagcaaaaatcagctgaagtcagttctgaatggagtattgttcctggacgtgggggccgtcctactttggcttcaatccagcccggtggaactgtatcttttgagcatcggaacatcaaggggctcaatagatctcttcttggttctgtgaccaccagtaactttcttaatcctcaggatgatcttgcttttaagctcgaatatgtgcatccttacttagacggtgtatctaatcctcgcaatcgcaccttgcgtacaagtgttttcaacagcagaaaactcagcccagttttcactggtggacccggagtggatgaagttcctcctatatgggttgatagagctggcgttaaaaccaacattactgagaattttactcgtcaaagcaagtttacatatggaattgtaatggaagagataacaacacgtgatgaaagtagtcatattgcttcaaatggtcaaagggttttgccaagtggtggaattagtgcagatggcccgccaacaacactaagtgggacgggtatagatcggatggtatttgcacaagcaaatattacaagagacaacaccaagtttgtcaatggtgcaattgttggtgagagaaatgtttttcagcttgatcaagggttggggattggcagcaaattcccaattttcaaccgtcaccagctaacaatgacaaagttcatccaactgaagcaagtagaagaaggtgctggcaaaccgccgccaccggtgcttgttcttcatggtcattatgggggctgtgtgggtgatcttcctagttatgatgcatttactcttggtggaccctactctgttaggggttacaacatgggcgagattgctgctgctagaaatatcctcgaggttgctgctgaattacgtataccggtgaaaaatacacatgtatacgcttttgtagaacatgggaatgatctggggagttcaaaagatgtgaaaggaaacccaactgaggtttacaggcgcatgggtcagggttcttcgtatggtgttggtgctaaactagggttggttcgtgcagaatatgccattgatcacaattcagggactggtgccttgtttttcaggtttggtgagagattctaatcttttgctagtttcggtttttttgcagctcggataaaaaggttcttgtgtgagattcaaacctaaatgtcgaatagagtattaatattttttggtagaatcaagttgtgatgatctatcgacatacgaccaatgttttgaattgtggatgttagtgttttatcaagttgtgacttgtgatggtctatgg

SEQ ID NO: 281 - DNA, 379 bp, Ambrosia trifida
cttacaacacaatatggttaactatgttctgtaaacaaaaaaatagcagtctaatcgaatgcttacttgttttttggttaactatgttctgtttgttaattgtttgttttctctctggaatctggatattgctctggcctctgagccttgatacaagcattattgggctttttgtgcttccattgttttcatatatcatgatagacattcttattaatcatacaacatgatattttggcttgcagcttcagaaagggaaggttttcaacattgaagctgggaagcaagcattacgtaacattaattctctatctttattttcaaatatcgaagttaatccgcgcccagatgagaaaaacgagggtggaattattgttga

SEQ ID NO: 282 - DNA, 318 bp, Ambrosia trifida
ggcggcggcgggtggtggaggcgattgttgtgtcctgaagctaatgctgatgagaatcagtcatctgaatgggattctcatggattaccatctgatattaatgtgcagttgagtaagcttagtggatttaagaaatataaggtgtctgatttggtgttttatgataaggtgaagtcggttgttgtcgggtcggacgattcgtttttcgaaatggtttcgattaaagcgggtggggtttatacgaaagcgcagttacagaaggaggttgagacgttagctacttgtgggatgtttgagaaggttgatatggaagcgaaa

SEQ ID NO: 283 - DNA, 885 bp, Ambrosia trifida
attaccttcgtacacttaacacgttaattatacattgtacattaacccacctcaagttttatatactgcttagtctggttaaagttgcaagatttaattgaacacgtagctttaaatttgggttggattgggtagcgggttaaaacaggtaacttttggtgtcggactatttaggtcaatccgaaacactttttgtccagtttttgtaaatatatatatatatagcatgctgtaagttatcccaaaaatcatattattgaatctattcaatgattgttgaaaagttataaataaagtgatataggagaggtttaatgcacttttgatcagcacagcccattgacctgccaagcttttttgatgtcctgttttcattcataatgggttgaagtgtgacaaaattaaatcaattgtggatattctaaaacacttgtttttctacgccaaagtcatattctgttatccgtaagcatggtcattaaacgatggcaatatcaccattttctgcaggttgctgctgaattacgtataccagtgaaaaatacacatgtatacgcttttgtagaacatgggaatgatctggggagttcaaaagatgtgaaaggaaacccaactgaggtttacaggcgcatgggtcagggttcttcgtatggtgttggtgctaaactagggttggttcgtgcagaatatgccattgatcacaattcagggactggtgccttgtttttcaggtttggtgagagattctaatcttttgctagtttcggtttttttgcagctcggataaaaaggttcttgtgtgagattcaaacctaaatgtcgaatagagtattaatattttttggtagaatcaagttgtgatgatctatcgacatacgagtaatg

SEQ ID NO: 284 - DNA, 461 bp, Ambrosia trifida
gaatggagtattgttcctggacgtgggggccgtcctactttggtataataccatatatattttaagcatttgatttgtatatctgagttattgttgaatgcatttttactattcagttttattatttaacgtattatctgttatgcaatgtttaggcttcaatccagcccggtggaactgtatcttttgagcatcggaacatcaaggggctcaatagatctcttcttggttctgtgaccaccagtaactttcttaatcctcaggtgatcttttatatctatgacgctttgttaatttttagaagattatagaggtggaaataactggtcaaacatataacgatttatgtggaaagaaactgcttatttcagatcgaatttgtctaaaaagttagttttttttacataaaatcaatgtgtcaaatatgattaaaaaaggatgttattttaataataatctgg

SEQ ID NO: 285 - DNA, 284 bp, Ambrosia trifida
ttgtgatgatctatcgacatacgaccaatgttttgaattgtggatgttagtgttttatcaagatgtgacttgtgatgatctatggacaaacggctaatgttttgaattgtgtatgttagtgttttattaagcaagaaacaaacaataaaggatacaaaaattcttaagcttttttctttccaaacccatactactggtctcatcagtttcaagtataccaggcccgaaggtttctggtatcgggtatacttgtcgcgtatacttaaagtttcctagttaagaat

SEQ ID NO: 286 - DNA, 218 bp, Ambrosia trifida
ttgtgaattttgggaatttgaatacgaatgaagtcgtttgtgaggtagtggaaggggatattactcgggtcgtgattcagtttttggataagcttgggaatgtgtgtgaagggaacactcagatgggagtagtgaggagagaattgcctaaacaggtatatcttactagctgacttatcattttttgtttattgtatgtatcgtcgtatgtttgtaac

SEQ ID NO: 287 - DNA, 466 bp, Ambrosia trifida
tgaggtaaattactaattaccctaatttctatgcactatctcttgttcattatgttaaatgtgtacattattcagaattttactcgtcaaagcaagtttacatatggaattgtaatggaagagataacaacacgtgatgaaagtagtcatattgcttcaaatggtcaaagggttttgccaagcggtggaattagtgcagatggcccgccaacaacactaagtgggacgggtatagatcggatggtatttgcacaagcaaatattacaagagacaacaccaagtttgtcaatggtgcgattgttggtgagagaaatgtttttcaggtcagtcttctagactaattttcattcaaatgggtatgctttaaaatgagttaaaatgggccaggtcgaagtcgtatgcccatagacattccttgtcttctcttttcttgagtttatacggataatgttcaaaatatgatta

SEQ ID NO: 288 - DNA, 328 bp, Ambrosia trifida
gtcggttgttgtcgggtcggatgattcgtttttcgaaatggtttcgattaaagcgggcggggtttatacgaaagcgcagttacagaaggaggttgagacgttagctacttgtgggatgtttgagaaggttgatatggaagcgaaaacgaacgcggacgggacgattgggttgaaggtgtcgtttacggagtctacgtggcaagtggcgaatcggtttaagtgtattaatgtggggctgatgcagcagtcgaaagcggttgagtttgatgagaatatgactgataaggagaagatggattatatgaagagtcaggagagggagtataag

SEQ ID NO: 289 - DNA, 235 bp, Ambrosia trifida
gagtataagagaaggatggagcggtcgagagcgtgtatgttgccgaggccggttcatgaggagattttggagatattgaggaaggggaatgtgagtgctaggatgttgcagaatattagggatagggtgcagaaatggtatcatgatgaagggtatgcttgtgctcaggttgtgaattttgggaatttgaacacgaatgaagtcgtttgtgaggtggtggaaggggatattactc

SEQ ID NO: 290 - DNA, 410 bp, Ambrosia trifida
atttaaccctatggaaaaaataaacatctaattcattagccatcataagtgtgttcacttaatcttgaattcacctgtcttggaactttactaaattgcagcttgatcaagggttggggattggcagcaaattcccaattttcaaccgtcaccagctaacaatgacaaagttcatccaactgaagcaagtagaagaaggtgctggcaaaccaccaccaccggtgcttgttcttcatggtcattatggtggctgtgtgggtgatcttcctagttatgatgcatttactcttggtggaccctactctgttaggggttacaacatgggcgagattgctgctgctagaaatatcctcgaggtacatacaaattgcttctctctatcagttcttgtttatctgtttacttgcttg

SEQ ID NO: 291 - DNA, 1054 bp, Chenopodium album
gagtactgagtggagtattgttcctggacgtcaagggcatccaacactggcttctatccagccaggcggaactgtctcctttgaacaccgaaacatcaaaggtctcaatagatcattccttggctcagtgaccaccagtaacttcttcaacccgcaggatgatcttgctttcaagttcgaatatgtgcatccatatatcgatggtgtatatagtcctaaaaaccgcactttccgaacaagctgcttcaatagtagaaagctgagtcctgtgtttactggaggcccaggactggatgaagttcctcctatctgggttgataggtctggtgtgaaagctaatattactgagaatcttacccggcagagcaagcttacttatgggcttgtggttgaagagataacaacacgagatgaaagcagccatattgccattgcaggtcaaagggtgttgcccaatggtggaattagtgctgatggacccccaacaactttaagtgatactggtattgaccgagtggcattcttacaagcaaatattacacgagataacacaaagtttgtaaatggagctatagttggtgatagaaatgtgtttcaggtggaccaaggcttgggcataggcagtaaaaacccactcttcaaccgccatcaactaacattaactaggtttcttcagttgaagaacgtagaagaaggtgctgggaaaccaccaccgcctgtacttgtccttcatggtcactatggtggctgtgtgggagaccttcctagctatgatgcttttacccttggaggaccctattctgtgaggggttacaacatgggagaacttggtgcagctagaagcattcttgagcttgctgctgaattgcggatacctatcaaaaacacacatgcgtatatctttgcagaacacggaaatgatcttggaacttccaaagacgtcaagggcaatcctacagaagtttatagaagaatgggtcagggctcatcttatggagctggtgtcaagctaggtcttgtgcgagctgagtatgctgttgatcacaattctggt

SEQ ID NO: 292 - DNA, 520 bp, Commelina diffusa
agcacggatgggcccccaacaactttaagtggtactggaatggaccgtgtggcgtttgcacaagcaaacataacaagggacaacactaaatttgtaaatgggactgttgttggtgagagagatgtgttccagttagaccaaggccttggaatcggcagcaagtttccatttttcaaccgtcatcaacttacctcaacccgcttcattcagttgaagccagttgaagaaggtgctggcaaaccaccacctcctgttttggttctgcatggccattatggtggttgtgttggtgacctcccgagctatgatgcatttacacttggagggccctactcagtgagaggctacaacatgggggagttgggtgcaagtagaaacattcttgagcttgctgctgagataagaatccctatcagaaacacccacttttatgcatttgcggagcatggaaatgatcttggtagttcaaaggatgtgaaaggaaaccctacggagttcttccggcgtgcaggaaatggcc

SEQ ID NO: 293 - DNA, 969 bp, Commelina diffusa
cgggcaggagtgggaccaccatggcctcccagccaatatcgttgtccagctcagcaagcttagtgggttgaagaagtacaagatatcagaaattctgtttttcgataggcgaaaacggaatggtgtctccggggccgaggactctttctttgagatggtttccctccgggccggcggtgtgtacactaaggcgcagctgcagaaggagctggaaacccttgcctcttgcgggatgtttgagaaggtcgacctggacggcaagacgaagccggatgggactctggcgatcacggtgtcttttactgagagtacttggcagtccgcagataccttccggtgcattaatgtggggcttatgccgcagacaaagcagatggagatggatgaggatatgacggatagggagaagctggagtatttcaggggccaggagagagattataggaggaggattgagcggtcgaggccatgcttgctgcctgggccgggtgcagaaggaggttatgatgatgcttagggatcaggggaagggtaagtgcgaggttgctgcagaggattcgggatcgggtgcagaagtggtaccatgatgagggatatgcctgtgctcaagttgtcaattttgggaatttgaataccagggaggtggtatgtgaggttgtggagggggatattacacagcttgttgtccagtttcaagataagcttgggaatgtctgtgaagggaatactgaacttgctgttgtgcgtcgagagctgcccccgcagcttcgacctggtcacatctttaacatagaagcaggaaagcaagcattgaggaacataaattcccttgctttattctcaaacattgaggtgaatccaagacctgatgaaaagaatgaaggtggaatcatagttgagataaagctcaaggaactggaacagaaatcagctgaagttagcaccgagtggagtattgtacctgggcgg

SEQ ID NO: 294 - DNA, 451 bp, Convolvulus arvensis
caaggacaagtattcaacattgaagtggggaaacaagctttgaggaacattaattctcttgctctcttctctaatattgaagtcaacccacggcctgatgagaagaatgagggtggaattgttgtggaaataaagttgaaggaattagaacagaagtctgccgaagtcagtactgagtggagtattgtgcctggacgtggaggtcatcctacattggcttcatttcaacctggtggaaccgtttcctttgagcatcggaatattaaagggttaaataggtcaatacttggtacggtgactaccagcaacttcttcaatcctcaggatgatcttgcatttaagctagactatgtgcacccatatttagatggtgtaaccaaccctcgtaatcgtacattccgcactagctgcttcaacagcagaaaattgagtccagtcttcacaggtgggc

SEQ ID NO: 295 - DNA, 1886 bp, Conyza canadensis
accaccaccaccacaaaaacatttcgctgcgaacaaatttcatctcaaatccctaaaaaaccctcacaccgtcaaaactcaaaatcgccgttattttccctcaaaaatctcgctatctccgccgccgccggtgttttgttccacgccgcgtataaaaaccctggctttctaggcggaggtaacggcggtggtggcggcggcgccggaggcggcggaggtggtggaggtggaggtggtggtggagggtggtggaaacggtggctgtctccggcggctaatgccgatgagaatcaatcgccggaatgggattcacatggattgccggctgatataatggtgcagttaaataaattaagtggatttaagaaatataaagtgtctgaacttgtgtttttagataaagtaaaatctttaattgttggttctgatgattcatttttcgaaatggtttcgattaaggcgggtggggtttacacaaaggctcagttacaaaaagagctagagactttagctacttgtggaatgtttgaaaaagtcgatttagaggcgaaaactaatgcagatggaactattggactaactgtttcatttactgagtcaacttgggaagaagctgatcatttcaggtgtataaatgttggtctaatgcaacaatcgaaagcggttgacgtcgaagagaatatgactgagaaggaaaaggttgattatatgaggaaccaagaaagggactataggagacggatggaaaaggcgaggccttgtatgttgccgaaagcggttcatggggagatactgcagatattaggacaagggaatgtgagtgctaggatgttgcagaatattagagatagggttcagaagtggtaccatgatgaagggtatgcttgtgctcaggttgtgaatttcgggaatttgaatacgaatgaagtcgtttgtgaggttgtggaaggggatattactagagttgttattcagtttcaagataaacttgggaatgtgtgtgaagggaatactcaagttggtgtagtgaagagggaattgcctaagcagcttcaaaagggtaatgttttcaacattgaagctgggaagcaagcattgcgtaacatcaattctctgtctttattttcaaatattgaagtcaatccacgcccagatgagaaaaatgagggaggtatcatcgtagagatcaaacttaaagagttggaacaaaaatcagctgaagtcagtactgaatggagcattgttcctggacggggaggccgtcctactttggcttcgcttcaacctggtggaactgtttcctttgagcaccgaaacatcaaggggctcaacagatcccttcttggttctgtgactacaagtagctttattaaccctcaggatgatcttgcatttaagcttgagtatgtgcatccttacttggatggtgtatcaaattcacgaaaccgcactttgcgtacaagtgtctttaacagcagaaagctcagtccagtcttcacaggtggaccaggggtggatgaagttcccccaatatgggttgacagagcgggcatcaaaactaatattaccgagaatttcacccgtcaaagcaagtttacgtatggggttgtaatggaagagataacaacacgtgatgaaagtagtcatatttctgcaaatggtcaaagggttttgccaagcggtggtattagtgcagatggccccccaacaacgcttagtggcactggtgtagaccgtatggtatttggacaagcaaatattacacgagacaataccaaatttgtaaatggagcaattgttggggagaggaatgtgtttcagcttgatcaaggtttgggcattggcagcaaatttccttttttcaatcgtcaccagctaacaatgac

SEQ ID NO: 296 - DNA, 896 bp, Conyza canadensis
ggccattacgggggagaggaatgtgtttcagcttgatcaaggtttgggcattggcagcaaatttccttttttcaatcgtcaccagctaacaatgacaaaattcatccaactcaaagaagttgaagaaggtgctggcaaacctccaccacctgtgcttgttcttcatggtcattatggtggatgtgttggagaccttcctagctacgatgccttcactctcgggggaccttactctgtgagaggttacaacatgggagaaattggtgctgccagaaacatactcgagcttgctgcggaaatacgtattccggtgcgaaatactcatgtatacgcgtttgccgagcatggaaacgacttggggagttcaaaggatgtaaagggaaacccaactgaagtctaccgacgaatgggacaaggctcttcctatggtgttggtgcaaaacttggtttggtacgagctgagtatgcaattgatcacaactcggggactggtgccttattcttcaggtttggagagaggttttgaagcttctttacattctcattcatatattatccgggattcagtttagttttgaagagattgtggggttctggttggaaactaaagcatcttgtgtagaaaattcgtatttttgcttgcaccagtttgagattcaactcttttggcgaacacccagttctgattcgtgtgttagtgttttgttaagcatgaaaaatagttatttttaatgggtgatatcctgtattcacaactttgaatttagtcactacttgacagtctagtgatctgcaaccttttggtatgtcttaactcttaagggattaatgtcataacctccttgtgtaaaaaaaaaagaaaaaaaaacaaaacatgtcggccgcctcggtctcta

SEQ ID NO: 297 - DNA, 19015 bp, Conyza canadensis
agcttcactctacgaagaaatgttccctacaaaagcctagataaatggataattaggtgcttaaagttagggacagttaagtcattttacatctatctcaataatcggttaccttaatacgacttctaatttgtgtttacatatcattttaccccaaacaggcaaacaatataacggcatattcagatagttttttctaaattgattattgtggtttcaagtcactgattcagtctaaacgcatttccgaccactaatttgtgtttctccataaacatactatgctaagtttgtcatcacctgcaaagtgtatgcatattcttggaatctcaagtgttactttattattaagaaggagaaaaaaccatttatatctgcattttgtgtaacttctggtactgtatataggtttgtattcccagcattgggaggtttgttatttgggtatgacattggtgcaacctcgggcgctactctctcattgcaggtatatagtgccgatctgcatataatattttagttgttgaacattaacgatcaatagaatagagtatactctaatgtcaaaatttccattgttgtatctggtagtctgatacttacctcgttggctctgcagtcacctgagcttagtggcacaacatggtttaatctatccgctattcagctcggtcttgtggtaagttagcgatggttgtttacttttagcatttttagtgcatcctttttcacccctcacctccaccaccttttttgtttcatgttataaaaggtagaggttgcaaaaggagtgggttgggttgggttacaggtcagatagggttgggttgttccgtgactcccgtcaacacactttgtccataatattgaattttaagcaagtcatgtgttacatatgattggaaaactatagtattaaataattatactttttaaaaaaatattatgaattatgctgttgtaagaatttaattgtggtttagacaactcttgacctgtttacttcatctagcagagtttccccatttaagctactttctagttcttattcctttgaccttatattacaatcataaaccagaatggtcctagtttaatctaaatggttacctttactagcgggggaaatgcaatccagtcaatctggatcctaaagggtcaagatgggtaaaatcatgaaactttactaagatggaaagagagaattggtattatcaagtgttcacaacctcctaaactggtctgtgaaatgtggtatttgtcaactcattatattgaggaaaataattggcgtcaactctgcctgactagtttgatgtgtcctaaatctacccatattgacccataattgtttgtgccattactcaacccactcatcataccacctatactggttacccaatgagttctatttgaatgcaggtctctggctccctgtacggagctctttttggttctatcctagtctacccaattgcagatttcctgggtaagtttactttattaaaaagaggtggcaatgtcaactcgttctcttgttttaatgaatgggtcaatatgggttatgttttatctctaagatgtcaaacaggtgaaatcagttaacaattaggtagataggaatataggataatagaaatcaggccaaccgaatcacaagtcactcgaaatgcagtaatgcacgtttaatgtacacctcttaaattgttttagtacaaagttaacaaatatgggttcaatatatttgctataaccatttttgacacactaattgcttatgtatattttggacaaaatgtgtttcgggtcatctcaacccaaccctaaccaatctatatcacaaaaagtaatctgatttttgccgtcactaaatctgcaagagcaactctcttgccacctctaccagtactaaactatagacaagatcaagaaattttatgttaaaacagtggcttttgatttatgaaggcaggaagcgtgaacttctattagcagctctactttatttccttggtggttctatcacagcctacgctccaggtcttggggtgctcttactaggtcgagttctctatggcttaggtatcggtctggtaagcttctattaatgcttgttaaaataaactctagccagatgaaaaataatccagcagtaccttgttttggtttttcaggctatgcatggtgcgcctctctatattgcggagacttgcccgtctcaaatccgtgggactttaatatcttttaaagaactatttatagttcttggaattttggtatttatttctagtcagtcatttgtgtcatcgagtcaagttaaagatgttcagtaatgggcatttcttctttatacagttgggttactttgtaggcagctttcaaatcgatgctattggaggttggcgttatatgtttggttttagtgcacccatcgcgcttttaatgggtctaggtgtttggggcctccctccatctccaagatggttacttctaagagctgtccaaggcaaagcatccttgcaagactacaaagagaaggctattgctgctttaagtaaacttaggggccgacctgctggtgataaagtgtctgaaaagcaaattgaggacactcttgtctctttaaaatctgctaatggttctgatcaagaatctgaagggagtatttttgaggtgtttcaaggcgcgagcttaaaagcatttgtaattggtggaggtttggtcctatttcaacaagtactatttcaaacttctcttgttcgttcataaattgtggcagtatttggatgggcattatgaatgtgactacgttttgttgtataatcagataatcaactgttaaggggtgtaagagatacaatttagatttacttctactttttaaaactataaggtgatcaaatgcttgagtgttcatcacattcttatttttttcctgaaaaaaccaaaggccaccttgtgaagtgggagtgcaagtctgtcaaattaggttcaaaaaggggtaaacggtaaaatttatttacccttagatgatcaatcttgattatctgatttctaaataatcagttaactaaattttgtctatctaaacatcaataactgcacttaatgtgacacttaggcttttgactatttgatctttttgggacgtactgttacagaaaaattgcccttaatgttggaacaagtaaacacttattgcttcatattaaatggagatgaattttgtctatcgtcatctaagctttactcagtatcccttttatataacagataactggacaaccaagtgttctatattatgccggtcaaatccttcaggtatgtgtttctaaaagaatcactctataaatatatgtatgtttgtttgtgtgtatatgtatatgtatgaacgtacacttatcatttgctttcatatttgtgaaatatggactcaagactgcgggattctctgcggctgctgatgcaacacgagtttcagtcattattggtgtctttaaggtgcgtgtaacgactggggaataactcatagttatacaaatagttctggcataatcatacgtcatcaaggacttttgttgcattaaatagaaaaagttattttttgctagaatgggtgcttttataccaaaagtatcattgatcctctcttcttctgcatttgtttcaaatttgctgaatcatttttggcaattatagtgttcttttcgcattgggaagtcaagcataagggttcaaaaagttagtcatctgtgtattttcttttttacaactatatataacatatacttgtgcagctgttgatgacgagtatagccattctgaaggttgatgatctcgggagaaaacctttgctgatcggaggaattagtggaattgtatgtgtctagttccttccatttttagaaattatttaccttttgtggtggaatgactttaccaaattagaaaattttcactgtcctctgttacagaccctctccctacttctccttacagcttattacaaatttcttggggagttccccttgattgctgtgggcgctctacttctttatgttggatgttaccaggttagttcttttggatagtgttcatttatacaaattagtcaaaacaaatatattaagctatattttcttgacaaattgtgaaagtacgaataataaggtaaattccttgggataattagtgcacattgggtccaagaatggttctgcttaatcttcaaattctagatatactaacgatttgtgcatgtatgatgtatatgagtgtattatcttttgttggatctagtgtttgactttgatagtctaaaaggtagttgttttggcttaggtagagcctgtttagatttatgcctctgacccaagttgtgttagaaaatagtttcaatgataaccaaaaaactctggatgataaagtttcgagctttatctttcttcttttcttataaatggtatcataggttggcaacatgtcaaaatcggtagatttatcagttttaaacagtttagatagggttgggttgaaccagcaacacttcatcctgtgtatttttataatattagaagtaagtactacttactgaatgttgttactgtaaagtgatataatttgcatgagtaaagcaatttgtgaggttgtaaacattttttataacttagccccatttgaactgattgacacattcgatccatcttcgttttaactaggttaaattaatttaccagtttgacttgtatccggtaagtttaacttttaacctttaaccatttcactcaaatggattcaactttcctaatatagtctccatgtttgtatgtaacttgaattaaatgtttatgcgatacaaatggaaccatcttgatgaatatttaaataccttatatttgatttagttttagtccagctattatcctaaaaatctttcaaaattgatggggatttggcattttcagatatcttttggaccaataagttggcttatggtatctgaaatattcccttctcgtacaagagggaaaggaattagtcttgcagttctcacaaactttggttcaaatgcgctagtaaccttcgctttctctccattaaaggtcggttttcatttctcaaagcatgcaacgttttgtaagtcaatattgcgtataattatctttttatgcaggagctactcggtgcagaaaaccttttcctccttttcgcagcaatcgctttgttatcacttggattcgtgctactctatgttcctgaaacgaaaggactgagcttggaagaaattgaaaccaaacttttgaaatgagatacgattgacttgcaaatacaaaggactaagcttttcttggttgttgtcttgttgaatggactaaacaccaactgtatcgtcagtttttcatgtacatgtatatgtttttccacattgtacattaatcatgtgtaataatactacattggaataggccggtgtataatagcaatcaatatcttgcttcggttttataactgcatttagagagcaatttcaaactatgggaacctgatttatctgtagtgttagcatattatagcaagtgtgttaagtgttgctcataagtcataacttttttgataatgcctcaatgaaatgttattactgtaactcgcttactttcagactaccttgatacttagtaggtactgctgttgccgttttggatgcccttgataccggtgtataggtaattgaattaagaaaaacttaaataccatgaaaagcttactattttgggaaaagcttgttactgcagaacctagtcaacgtctgtttgccatgatatgttgttcacacaagtgcctgaaattatggcatcaaaatagatttatatttgctcttaaattttctgtttgtatttgtacagaaacaaagagccatgcttttgtgaattcttgacaatggctcaaccagatgatacacgaagaacgacaaccacagacgctttaaatattccaagaccccaaaactcgtcaggatcgaaaagttcaagcacccaaacttccccgcacagttggcaaggtaatttgtagcttttataataggttcccatttgatactgggctaatttataaaaatggctaccaggtatgcaaaggcattagaaggtctccctttgttgtaaatttgaaggttagaaacttgattaaaatttgaattttaaccttaatcaggttatcttgcaattgaccgcaagaaaatagttaaggcctaagggattttatagctgggtggtttttctttgagactttctgtatgcatgacctttttatacattaacacttgttcattttatagaaaaagttgataaaagcgttgaatttatctgtgtgtattcgtaggtggatcctcaaatcggtcatcaaattcttcacccaagccaagaaagagccatgatcatgacgaccatggaaaccaccataacaagaaatcagtgttcacgaaggtgaaagagaaggccagaaagttgaaaaaatccttaagtgggagaaggcgtcgggaggagaatgatttgcatacttcgactcctccaagcagttctggcccagtggaggatgatgaaaatgaccactccgaatactttggttccccatgtaatatattccttattaaaagaagcataattttcatagttttttgttgattctgtctccaaatagataaacaatttaaacttcggcaaaaggccattgctgttagcagtatttctagtaatggttgcaaatgaactcaacacagattaactgaaccatgtttgtgatgcctgaaccgtgacaagtctacttgtctcattctatctttacctgctaatgcgtcttgaatgcataatcaatggatcttaactatttatatgggtattttcagtgtatgaacctacagtggatcaacatttgacaaaacagcagcatgaagaaacaattgaagggtcctccgagaagcctgatatgtcaaaagatgggccaccctcattatgttctactgatgcaacacccacagacctcactatctctactcgtcaaaacacagaaacttcaaatctagatgctaaaaaacccgagagtactttagaagagaaagagaacacgaggagcagctcgcaatcagtgaaggaatacttgatgcataagtttgaaccaggagacgatgaacgagccctttctcagaaaatcacgcagacaataagtcctaagtatgaaagaatgaaagacactatgcagtcgttattaagaagcgaagaaccttctgagtcgacaagtaaaacttcaaactctggacttgatatttcgccttctagatcctcaatggaatcaaactccttgagcaatcatcctaatctgagcaattcagatttttctaatgcttcaaatataagccagtgctcagcatcgtcttctgctacaggtcagaacctaaatcttggctcttcatcacttgtttcttcgaatctgaaaccagactcaggtttgaattcaaactaaagtggtaatgcaactcaagatctagctttgacgaatagtcatgaagataggggcctctggcttataactaagtagctttagaaaaagcacattacatcacccataagtgtattcaaaatgcatgaaatcttttagattatttctttcaaaaaatgaatagaaattatgtggattttacccaaaacttctttatagtgatttattgttcgactttaattctataaattatatagttcaaattatagtctactatctgaataatataattttgcaagttatatgatttaagctaatttttccaatataccaatttaagataaaacataagacaatcaacacattaatagatacataagtctaagctgacacctttaatcttgcaaatgatgataaaatatgtttattcttatgtgttactaaacgaaattctgaatgcaggtgtaaaagatgagaattgtcaaaaggttctccacagctaactgatactctttgaagaaagttgagtgttaccagtcttacatagttttgaagtgaagtcattaatcttcagttaaggttttttttttttctcaagtagatactactttaccgggtatttttggttttctttgaactagaattgatttttgatatatttttgcatctgtaaatgaaacatattgctagaactccgatgatatccagtagaatcgtatgtgaattttgagcacttgtgttcataaggatactttacctcaggtacatgagccgcgctacttagtatagttaagaagtgacaaaatggcgactaagtaaagatagttgtttcgagctacatggagttttaagtgaatgttagactttgttgtatatctagtacccgacttgtttctaatctttgatagtatgctgctatatttcttcattttaaaacagcactggcttgatggttcgtcaagtaaattgtgtcttatgtatctaaattcttataagaatgattatcatttggtaccaatcggtattaaaccgataatactggtaccgatggcggtaccaatatctatattatcgatatggtatcagttttgggtaggaatgtttccggttttgataccaactggttccgtacggtacggtaccgaacaccatccctaaaacaaagagtgttcttggttattatcagttgtcatgaatataactaagataaagtatgagaaaataacttagagtaaccaaaaaacatttcaaaatatacaattttgattaactttttccttaagatttttatacacgcaatcaaagatttcttgcgacattgtgatctatttgtatgcatgtttttagaacgtatgtaggcagaggcaaacaattgttcggaaaaacataaacaaacatacaataaggttttaggttcggccctttattgctagaaagatatacaagaaacgtgtcctacctatcaagtatcgaaccacattaaataagcattttacgtttgatatatgtaacattcttgattgtggtttgttatcttttgttcatttggactttggtctattttttaagctgatgaatgttgcaatgcaatattaactttgtatttgctagatagaaatttcaaaagaagcagcaggtgtttttttttgtatgttttgtatatttatttgtatttgatggtttgtgtttgtttgctacaaattaagttttcagaagcaaaaaaaaaaaaaagccaatcaccagaatttagattaccggctggtatttacaaaaggaaaagtcatatatgttattgaaagcatatataatactctcacaatcaatcttcttcaattttgaaaacgtaatgaatataaaattagtccctctttaatgtgagggcaataagagtggttaaatgatgttgaaagcatataagttaaccgttttacaaaaataatgataataccgacctacagagtattagtatttaaaactttgatattcaaaacgtttgcaagatatacaacattataaaatcactttgagatttagaaaaaaatatgatgattttgttggttatttctaaaaatactttatatattgaattccgttaattttattttctaatcttactcttattttaacacatgtttcattttctatataaaagaatttctaggcaattattttagcataatttaccatttccctaattttaatactccataatatgtttctttaaaaaaaaaaaaaacatataaatgtcgatatgacttttttgtattattcgaggtcaaatgatttaactaaaaaatttcaatagtaaatctcgtccggtttacacacacagacagacactggactcacctaactctcactcataaacccttatatttttttttttctctatccctctcttatctccaaaatggcgtcaatcgccttcggcaccggccaatatttcactctccgtcaacctcgacaccgtcaagccttcacaaatcccccgtcttccgcttctctcaccaccaccaccaccacaaaaacatttcgctgcgaacaaatttcatctcaaatccctaaaaaaccctcacaccgtcaaaactcaaaatcgccgttattttccctcaaaaatctcgctatctccgccgccgccggtgttttgttccacgccgcgtataaaaaccctggctttctaggcggaggtaacggcggtggtggcggcggcgccggaggcggcggaggtggtggaggtggaggtggtggtggagggtggtggaaacggtggctgtctccggcggctaatgccgatgagaatcaatcgccggaatgggattcacatggattgccggctgatataatggtgcagttaaataaattaagtggatttaagaaatataaagtgtctgaacttgtgtttttagataaagtaaaatctttaattgttggttctgatgattcatttttcgaaatggtttcgattaaggcgggtggggtttacacaaaggctcagttacaaaaagagctagagactttagctacttgtggaatgtttgaaaaagtcgatttagaggcgaaaactaatgcagatggaactattggactaactgtttcatttactgagtcaacttgggaagaagctgatcatttcaggtgtataaatgttggtctaatgcaacaatcgaaagcggttgacgtcgaagagaatatgactgagaaggaaaaggttgattatatgaggaaccaagaaagggactataggagacggatggaaaaggcgaggccttgtatgttgccgaaagcggttcatggggagatactgcagatattaggacaagggaatgtgagtgctaggatgttgcagaatattagagatagggttcagaagtggtaccatgatgaagggtatgcttgtgctcaggttgtgaatttcgggaatttgaatacgaatgaagtcgtttgtgaggttgtggaaggggatattactagagttgttattcagtttcaagataaacttgggaatgtgtgtgaagggaatactcaagttggtgtagtgaagagggaattgcctaagcaggtagttctgactttcaattttagttagtatgtgtttgtttgtgtgtaaaatagttcatgtgctttttctttcagctgttttaggtttttcatttttggttttgccatagtaagtattcgattagttacatagatattatagtaaaagaccaatagctaaggaatagtgttttgatcagattactttaacacaatagcaaaatggtattttgtaacaaagtcactaagtcagtattcaatatacagaaatggatttgggatagaaatgtaggctgttgtttttattctaagttgatgaaggttttaaaaccaaagtgtgactactttttgagcagtttttgtgaaatgaaaatcagaacactgacaacattgccaaatagttagtgaagcttatgatcgcatcaataattagcccatcacactgccaatcacatgagtctgtgggagttctacttgatatccgattggcagtagagggagtatttaataagctttgtatgtggacactcatttttacaattgtctctgtgggacatgagtttgcacccaacatgtgagataagaaagggtgatcttattagtagtatcaattaaattatatagagttttcattatagaggtaatggacagtatgagtttgtttctttcattgatagtttgcagtctttctagctattgttttgatacaggagtttacacgcttgatgcgcttttatgtttacgtatagtatcatagatctattctttaatcatgcaatgtgatattttggcctgcagcttcaaaagggtaatgttttcaacattgaagctgggaagcaagcattgcgtaacatcaattctctgtctttattttcaaatattgaagtcaatccacgcccagatgagaaaaatgagggaggtatcatcgtagagatcaaacttaaagagttggaacaaaaatcagctgaagtcagtactgaatggagcattgttcctggacggggaggccgtcctactttggtatattattttaccatattgtttattgatgtagtgtgttttccaactatcgttaaatgcctttttgttatgcaatgattaggcttcgcttcaacctggtggaactgtttcctttgagcaccgaaacatcaaggggctcaacagatcccttcttggttctgtgactacaagtagctttattaaccctcaggtgtgtggtcttatggttatttctttccggttctatggggtaatattgggttggatgtgcgaataggatagaagattaaaaatgctcattctctatgggttttactgcaaaaaatgttgaataaattgatttagtaggccttatgcatctaagttaccctttgggtaacttttaacatgttgtacttgtttttggtgatttttttttttacccatggaaataaagcatagatcctgaatcaacctagtttttaagtaaaagaatgtagaattggtggtaacatgaactttttgcaggatgatcttgcatttaagcttgagtatgtgcatccttacttggatggtgtatcaaattcacgaaaccgcactttgcgtacaagtgtctttaacagcagaaagctcagtccagtcttcacaggtggaccaggggtggatgaagttcccccaatatgggttgacagagcgggcatcaaaactaatattaccgaggtacgttactgaattgttaaagtattctgatgtatgtttcatcgtcacttgtgagctatgttgaaagcatgtacgatgtcttacgataaattttgccccgcttcagaatttcacccgtcaaagcaagtttacgtatggggttgtaatggaagagataacaacacgtgatgaaagtagtcatatttctgcaaatggtcaaagggttttgccaagcggtggtattagtgcagatggccccccaacaacgcttagtggcactggtgtagaccgtatggtatttggacaagcaaatattacacgagacaataccaaatttgtaaatggagcaattgttggggagaggaatgtgtttcaggtcagtcttctatatacacttgaagtggcaaagttgggtggtttgagtaacaaactaagttgggctgggctacgccgacccacaaatacttttgtgtcttctgtcttttttagataagtttcatacatatataaataatgttttaattgtatctaaggcactatattattgcaaggataagctacttttaaaataaagcgttttaggagtttttatgcatattggatcatgttcagcctgtttgaaaaccgtgactcattcaggctgtttccagtttaaccattaataaagtttccccatacaactagttataggtaaaattaataaagtttccccatacaactagttatgggtaaattttaacaaaattaacatggttacccattaaaggatttaaattgtctcatgtaaatcaatataagtttctttactttcttacaatctatttgtggcatgaaggtcgtccataataagctataaattgcaagctaatcatcattccatcaaaagttccccacccagtgttgatttttttttgtatttttcatatatgaaaacttgaagtagtaagcacctaaataccatggattgacgcttatattcgaatttgcagcttgatcaaggtttgggcattggcagcaaatttccttttttcaatcgtcaccagctaacaatgacaaaattcatccaactcaaagaagttgaagaaggtgctggcaaacctccaccacctgtgcttgttcttcatggtcattatggtggatgtgttggagaccttcctagctacgatgccttcactctcgggggaccttactctgtgagaggttacaacatgggagaaattggtgctgccagaaacatactcgaggtacatccactttactttttcttgatcattaatcccttgtattctattggtaactcccaattacagatgctacatatgcattcagttgaaattttgtgctagttgcggaaaatttgagaatattttagaaaaaccaaaattgtaaaaacgtgttcaatggcattggttaaggaaaaaatttgtggaaagcgatcccacttttcggatctattaccaagttctttaaaagtcgcctttataatttctgcaacttaacatgcccttcttagtttcaaacctaatggacttggttagaagaaagttctgtattacttcagtctcattaatactgctagactagaccaaacacagagctttaagttgggctgacctgaaacactttctctggaagtctcttaatttctgttgtaataactcgagtgtcactagttagcgcctttttaccttcatgaagtccaattctgtttctattttttcccattatcttcaagcatatcattaattgatgactgatgcttgtagcttgctgcggaaatacgtattccggtgcgaaatactcatgtatacgcgtttgccgagcatggaaacgacttggggagttcaaaggatgtaaagggaaacccaactgaagtctaccgacgaatgggacaaggctcttcctatggtgttggtgcaaaacttggtttggtacgagctgagtatgcaattgatcacaactcggggactggtgccttattcttcaggtttggagagaggttttgaagcttctttacattctcattcatatattatccgggattcagtttagttttgaagagattgtggggttctggttggaaactaaagcatcttgtgtagaaaattcgtatttttgcttgcaccagtttgagattcaactcttttggcgaacacccagttctgattcgtgtgttagtgttttgttaagcatgaaaaatagttatttttaatgggtgatatcctgtattcacaactttgaatttagtcactacttgacagtctagtgatctgcaaccttttggtatgtcttaactcttaagggattaatgtcataacctccttgtgtagcctctgaactgcttgatgctgatgtaacagtacaaaagctgttcaaaagggaaaaaatttatataagaatcatctggttcaaaatagagggtgcgaaataaatgggtcaaccgggtttcaaataaggtcatgttttggtccaactcacatggttgaacagaaacttatttagaacactaaggtattcaataaaaaaaataaaaaatacgaaagaaaaaaaacacgtataaatttctcaagaatgcggccagccaagaacacatatgatgttactagaaccacatagcttgataaactcaatgtactatttctttaaaagtgtgaaaaacttcaaagtcgtaactccgtttccccaacaacacattcgttccacctacactttttgcgattagattaagagggcatctcaaaggtcttttttccaacatcggctccaacctgcaatattacaacaccaatgtgggagcagaatatatgattggatattcaaacatcctttatttcaacaaactcaattcaatggcttgatagagttcaaatgtattgagttcaactcgagttgaaacctcaacacgatagaaggcattgacggaaccaatgtaatatgaactatactactaatgtgcttaggcatctatttgtatttaatctgaacaagtgtgaataacttgattttatagtggattatattatttttttttagtgtatgttatcacctttcctttttttatcattctttttgactaattgtagagtttaacatagtttagctttgtctgtgactggtttcaaacttctttttgacactcaaaatatgttgttgaaagaaacatgatttcttgccattagattatctaggaaatggttaatttgaaagctaactaaatatataatataatagatttttttaaaacataattgcactcaccaaggggcatagttaagttggtaaactttgtatcacgtatagtagaattttattacaaggagcatacagtaatttcaaggaaatatcatggggcggtgtccattaatcaatcatatccacaatccattaaaagaaaagagcaaaatatatatctaaaagaatccatcaattgcctaaaaatatctactttaaacactttttcaatacagcctttcacttttccttcccaaacaagacctccaacaataatatattggttgattaatatcacctctctcaaaatatctcccaatagttaatcaaagtttttcaatcaattttcttttgaaaaaaaccagtaaataattctataatattttatggcagaggaagtaagacttaccggtggccctggcgttgacgttgatgaacgagtatctgagtgggagctagggttaccgaacttcgccgatttgacgccgttatcacagtcgttgatctcggcggagatgttatcggcgttcagtattacgccggaaccctaccggaatatgtctgacgtcaatcgtgcttctcaagatacactttctgatatccgaggtgataatttaaattcaattagtactaataataatgataataataataataataaaggaaatgaaagtgtggtggatctaactgattctcggaaatcacggagagttagttacgacgttgacggtgacggtgacgcggtggaggaaatcgataatgagtcaggtatggtgacagataaggcggagccggcatcaaaacgacagcgtttagtgtggacagcgcaattgcataagcgatttatagaagtggttggacatttagggataaaaaatgcggttccgaaaacaattatgaatttaatgaatgttgaaggattaagtagagaaaatgttgctagtcatttacaaaaatatagattgtatttgaaaaggatgcaaggctcgtcgtcttcggtttcgaatcatcaggagcagcagcagcatatgcagtttccggcttcacagatggttaattatcgcggtcttgaggggaatgcgtatccgtataatattatgcctatgcaacatagggattggtctggttcgggttatcagcatacaaaacgataacagatagaattggatcaagtgaaaaacccgtggtttgtggaaaatgggattgggtacgcttgttgaatgagctctaacgattaaatgaataaattcaagttatgtagtagtaatttggggtttttcagggtgaatttttcgttgttgaattttgttaataatattggattaatcctttgttattattacactcagtttgtatgcatgtatagtttgtgttactactctatcagttcatcactttttatgtttctccgccattgtaactccaagattcctctgttactgccattacccacttatttgttatatcttccattgattaatctcacttataccacctcactctgatttcgtgatcaagtcaaacccaagtgatgccgactccacttgatgtgggtctcaactccgtgccgaggcaaaagcatactctttgctctcatgatgtaatttgcaagttaaaaaatggtgaattgatggacttccatgttgaggtgacttgatgacagtttcttcaactctacaaattgatcaactccaaatttatccaaatggttactgatttctaaagttgttaatgtgattagacaaaggccacttggttttgtatgataatgtcagaatgttctgttgttgagttttgttatcactatactataattgttctacaattctcacttcatgctagtgactcaagattgaagatagagttttggtacatgttaacctttgtattcatttagcttgacctgagctattactaagcactaactgtttgtaactgcccagctaactttctaaccatttagctaacttaaggtagtgtcacacatatagcctgtgtggctgtgtaccctgttcgtgattgactgacttggcgtatttaaggggatgttaatctgtacgtattgcattctacgatttgcccagctctaacactgcaacctggaaagttcctttcattttcgttcatatgctataggcctatagctttcttgaacaaatgattattgtaattgtgttcttcgtgaccaactagccacccaggtaacaacaatgtaacgggcatcaagctcacaagacttccaatctatcgatatttgtctaaattcattctttatgcatctctgcaagaggagccataattatttatggactttgtgatgcattgttttgatttgttttcgactaaggcaagtgtctaaccagttatagaaattaagatttgggttagcctagtttagaacttaaaattttgggatggcctcgtgttatgatgtcctaatcttctatgtcatatagtgttatgcatttatgtgcaccagaaaacggcaaataccttcaaatctttagatattactcgtaaatttgaacaagttaaatcaacttgcaaaatcgtctttattcttttgaagttctgataggacaacctcaaataatcgaaactacgaatttcatgccgcccaatgggaggcgtaagtttttgaaaacgtttgcgtttatgggtggggtttaaaaaaaccacgaatttgtgctagacaaaaaatattgaaacccaactttaaaaaaatacaaaacgaatatactaaacaaaaaaataaaaaagagaactaaaaaaacaaaaagaaatacgaaacctaaatgtataaaaaaacaaatgttacatgtgaaaaaggtataaaaaaccaaatgtttaaaagaatacaaaggatatataatgcaacaaaaaaaaatttttaaaagaaccaaaaaacatagtaaataacaaaatatataccattttaaaaagttatgaaaaactgttaaatgtgataaaggtataacaaaacaaaatgttacaaaagattaaaaaaagagattaatcacgggaagaccaacgtactttctcatttgtacacggttgcccattatacttttttattgat

SEQ ID NO: 298 - DNA, 7215 bp, Cyperus esculentus
  unsure (1)..(7215): unsure at all n locations
  unsure (1)..(7215): unsure at all n locations
ggatttgggggaggtggatttgggaagttctggtcgaatgtgttctcgatactcccggccaatgcgaaggacggagaggccggaagggattgggatccccatgggctcccggtcgatgtcattgtcgcgctcaataaactcagcagcctcaagaggtagttttgttctcatttctcgcaaaatgtaccatagttagtcgcaaattcgcaaaatacattaactattggatattgatttatgagaaacatcttgnnnnnnttgaaaaaccgtctatatatccatgaatgtacacgaaatgtaacagatacatctcgaaatgtaacctatgaacgctaggtattactcttgatttatagaagtatgtatgaagtgggctgatgtaatgtcatttgaaccattatcaaactgtttattgataatgtattgtttgttcctgattgttgactatttattagtattatttttgttatgtagttaatgaaacagtgcactgaagttagccggttgttgtaacaggtacaagctgtcagaaatcgagtattacgatcgtcggcgtgggtaccagaatagcacaggagattccttctttgagatggtatctctccgggctggcgggatctacaccaaggctcagctccagcaagaggtggagaccttagctacatgtggcatgtttgagaaggtcgatctggaatgcaaaacaaaacctgatggcacactcggtgttaccgtcaagttctcggagagcatatggatgtcagctgaccagtttaggtgtatcaatgttgggctcatggcgcaacagcagccagatgagatggaccctgatatgactgacagagaaaagataacatattacaggttagatttgcatgcagcttcttgttaccttaaagaaattttaattttcttgtcttgttgaagagaagcatctacagtttgtttgttttgcactaccctgataagaattgttgcagttatggtaagccgtatgttaaggaatgcttcattctccccttaaattacaagttttgggcaagtgcagagtggcttagtgatttgacaagtacagtgtagggttgatgctgaatataggaaattgaacataagaattatcaagtgctacacgtgtattaacctattctggagtctagttaggtactgtttatgttattgattaaaaggaaagaaaccagtcttacatccctaagacttaggagtgtggaaccatgggatatatgctaaaacctaatagatacataataagattgtaaggggtcgcagtaatatttaagaagatcataaaaccaatgaaaatagggagcaggagaggaagtacaaggtcaggatgaacagagcaaggccttgtctgttaccagatccagtgcagaaggaaattaaagacatgctgcatgaagccgggcctgtgagtgcaaggatgttacagaagatcagggacagagttcagaagtggtaccatgatgaggggtatgcatgcgcccaggtggtcaattttggcaacctcaatactaagaatgtggtgtgtgaagtggttgaaggtgatattaccaagttggatatccagttccttgataagctcggaaatgtgtgtgaaggcaacacgcaactgcccatcatttatcgcgagatacctcctcaggtttgttttgtactctattttttcctctctttttaggttgttaaactttaaccatactttgttcttctgtagtttgtattatctttttttttttggtaggtgcagttatttgtctatattgaagcattgaatttgcctgcaaggaaaaaacaataacgtgtacattttacttagttgccttctgtgagcaaaatgttaaggaccacggctttgttattgttctgagttgcactatgatcaatagcttttatggatgtgttcttaggtagctaagctgtttgcggcttccattagcttttgaatgtttgtattctaatacttcattgtttctccgatggcagctccaaaagggacatgtcttcaacattgaggcaggaaagcaagcgcttaggaatataaactctcttggacttttttctaacatagaggtgaacccaaaacctgatgagaagagtgagggaggaatcatagtggaaataaagcttaaggaactggaacaaaaatcagctgaggtcagcacagagtggagcattgtaccaggtcgtcagggtcgtccaacacttgtaagttttctaactcttttttttcatcatatggaattcttgatgtatgatagtatttgatgatattttccctcaggcatcgatacaacctggtgggactgtatcatttgaacataggaacattaaagggttgaacagatcagttgttggctcagttacatctagtaatctactcaatcctcaggtactaaatttttatactgaacttctatctatggtggcagtgatgattttgcttagtttaatttgtgggggctaatatctactgtatttgataggatgatttgtcattcaagctggaatatgtgcacccatacattgatggagtactaaacccaaaaaaccgcacattccgttccagctgcttcaacagccgcaaactcagtcctgtttttactggtggacctgggtctgatgaggtccctcctatttggattgatcgtgttggcttcaaagccaacattactgaggtacctattctaacctcattcttaccaatctgtacttgaatgtgttcaaaatttaataatactgatattcttttatcgttcgatgcatatagagcttcaccaaacagagcaaattgacatgggggctggtgctggaggagataacaacacgagatgagacgagcaccatttgcacccatggtgcgcgtgcactccctagtggtggcctcagcatggatggaccacccactactcttagtgggaccggtgtagacaggatgggctttcttcaggccaatataacacgtgacaacacgcgtttcattaacggtgctgttgtgggggacaggaatgtgttccaggtatctttactaattaattctttcttttttaatttaaaattgaattgagctgcagtgcttgacaagtgtttatttttgttctcgtgtgttttgcagttggaccaagggctaggcataggaagcaacttcccattcttcaacaggcaccagctgactctgacaaaattcatccagttgaaggaggttcaagaagggcctggtaaatctccaccacctgtacttgttcttcatggccattacggtggttgtgttggtgaccttcccagctatgatgctttcactcttggtggaccctactctgtcagaggctacaacatgggcgagttgggtgcttgccgcaacattcttgaggtaaaataattggctcgaggatggtcttgaacttaaatagttctactttgaacatattgatgaagcatgttttgatttgattggactttaggttgctgctgagttgagaatccctgtaaggaacacacatatgtatctatttgctgagcatggcaatgacttgggcagttcaaaggatgtgaagggaaacccgactcaattcttccgtcgggcaggtcagggttcatcctatggagctggtgtcaagttggggttggtcagggctgagtatgcagttgatcacaatgctggtactggtgctgtattcttccgcttcggggagaggttttagaggatggtttcgagcacttctaattacctaaattctatcagagttggtttcttgtttagtgtagaaaggctcatataggttacttgttaagagatggtgtagtctagatgcagcattaattttgtctctctgtttcctcttctactgtttccattcttccttgataccaggttttgttgtttgttctgagttgtgaagattgttatggtcccgcaggcaataattttggttaaagacctaaatgtgggactcaatgcaattcttgattgcgaattcgctattttcttcaaatttgtttaggttttgtatttgtcatcgaagtacagtttgtggaaggaataaattgccatctcaaatatgacagatgttgtctgcaattattttaggtcaaatcgtaagatctttttcctatttttcatacattattgtaaaagaatgtgtgtttctgaggggactaccaattaagatcggagtcgtctctcataatggccagtccagatgtgagtcatgtgaccaattaagattgatggtcattccatgtagattttgcatcttaattatgtaaatgaatcgtgatttgagatctcaaaaacaaaaacaaatacaaaaaatgatgaacgttgaagcggactgcgcacttttgataagatgtttgaggtatcttcgaattattattgttgtctttttggagatgcatagtgggttaaaaattataaactcaggataatctttactgtaaaagaatttgcatatttgatgtattatacaatttacctttcgaaacaggctctagcacactgaatcgtgaattctgatcaacctttcgatacaaagcccgtaccacttctatactatacaatttaccttagtaacacagttagaaaaaaaatatttttaaaaattcaacacaagtagtctaagtttgatgtcgagtattaaatctgatgtcgagtcagattgaaagaaactactaggactggaacaaaacaattaaataaaggtctaccattaccacaccctggaaaagctaaatgaatcaaaagaattattactaagctctttataaagaagaacaataccaattttacagcatagactaagacctgctttttacaaaacaaaaggcaaaaacaaaaaaagaaaagaaaaagaaaaagagcagtttcagcattgcggagctttgaacattcttcagggtatcaataaacatatgaacagcaccagaaaaacaatcaattattgttgttcaaaatcatgttttcatttatcaaccttgtatgttttctcgagcatcttgtccagtacaagacatagcataaacatatctgtgctaaaacaaaatcgatacctacagaaagctgtaattgtttcattaaatatgaaagaatctagaatatatcctagctcctgcattcccttgaatagttgcaaaatttccttgagtttcctatttttaaccagcttatttacaaaaacagaaatttgtttttctgaaactccagttgcaagagactccaaaaagcagctggtagcctcagaaaatttctccaccctacaaagaccctcaactgttatcccatatgtgatctcattaggggcaattgcttccatggccatgttagacagcaaaacccgagcttcattaggcctaccttctaggaaagaccaatgaatgagagtattgtatgctactgtatttctcacaaatcctctacagctaaacagaactttagcaatattaattttaccacccttacaaaggccattaaccacaatgttgaaggtccttgggttcgggtcaatacctgtttttaacatatctgttaaaagtttaagtatcagccaccaactaccagttccagatagcctactcatgagagtgttgtaaccaattacccctacactgcaatccatgatctggtttttctgtaacaagttttgtactagcaaaaagtttgaatcgcaacaaagacaattgataaggatacctatggtaacattagtaggtttcaaccctttatttaacatgatctgcagctttccaatagcttgcttagacatattcttctgacaaaggccattcatgtatgtattgtaggttattgtattgggaatccagcccttcgtttgactttcttccaagaccttctcgacctcatcgaatctcccagctccacacagcgcctttatcagtatattgtaagtcacagtgtttggtgtacaacccaaactctccatcatcgtcattagttccttggcctcttcgattttcccttttaggcaatatccttcaacaataggggtatacgtacaaacagttggtttacattgatcttctatcatcaaatcaaggagaccccatgcctcctccaaccgattggctttacacaaaccggttatgactgtggaataagttgtcgaatcaggtctgaacccaaattccttcatcttagccatgacctcataagccaaatcaaatttcttcgaaacccaacaatgcagcttcaccagtacattaaatgaagagacattgggcgcaactcccaaagagagcatttcatcgaacaggtcttgggcatctcttgcacgacccaatgtcacaagggcattgatcgcggtgttgtagcaaagcacatttatatcgcaaccagaacatctcatctcggaaaacagccgcaatacctcacccatgtcaccaatgctagagtaatgcttcatcagctggttacagacgaacgcactgggtctccttggcacagaaacaacctccggttcatggaccttctccagttcaactgactcaaccaaggaatgccgaggcgacgaatcagcctgtaattcttcacccaataccttctctgtggaaccatcgctcaaaccttttttctcatctagtcgggtctcactctcacctgatacaatccgcaccgattcaacagaatcacttgagattccagcaagcgcatcttcaaccaagaaggagttaatttccaacaccggcggagtaaagccggtaccaagtggtgatcccggcggccggatcagagcggactgaatttgaacctgctgcagaaagaaagcgtccttgtgagaaaccccgggacctctgcgcgcatcggggacgacaggcgggagaaagaggtgaagaggaggtgctgccggaggtcgccggacggaggagggggtggcgccgctcatcaagagccccgctatccgcagcgaggctctggccgccgtcgccaattgcgggaccgaaaggagcgatcagatccgtggtccgccgctcttccctccagccgttgaccgaccatttacagggggagactttggtagggttttgctctgggagagcggagcagcagcagtcatggaaggaaggaaagtacggaagaagagtctacgagactactacccgctactgcgcagcaatctaaccgttggatgtgctttgagattcgtgcaaccaatcctcaacaaagccccctctaatccgcatcgt

SEQ ID NO: 299 - DNA, 479 bp, Digitaria sanguinalis
tggtctcactgtctcctttgtggagagcgtgtggagtgccgcgaaacagttcaagtgcatcaatgtggggcttatgtcgcagtcagggcaggttgacttcgaccaggacatgacagagagggagaagatggattacctccgcaagcaggaacgtgattaccagcagcgtgtccgaggtgcaaagccctgcattttaccagaaaatgtacgtggggaggtcctgggaatgatgaagaagcaggagaaggttagcgccaggatgctgcagaagatcagggaccatgtccagaagtggtaccacaatgagggtttcgtatgtgcccaggttgttaactttggaaaccttaacaccaatgaggttgtgtgtgaggtggtggaaggcgacatcaccaaggtggagtaccagtttcaggacaagcttggaaatattgttgaaggaaatacccagcttcctatcatagaccgagagctgccgcaac

SEQ ID NO: 300 - DNA, 423 bp, Digitaria sanguinalis
agggaggttcaaggggaggttttgcagatattgagacaggggaatgtgagtgctaggatgttgcagaatattagggatagggttcagaaatggtatcatgatgaaggctatgcctgcgctcaggttgtcaattttgggaatttgaatacgaatgaagttgtttgtgaggtggtcgaaggggatattactcgggttgtgattcagtttttagataaacttgggaatgtgtgtgaagggaacactcagatgggagtagtcagaagagaattgcctaaacagcttcagaaagggaaggttttcaacattgaagctgggaagcaagcattacgtaacattaattctctatctttattttcaaacatcgaagttaatccgcgcccggatgagaaaaatgagggtggaattattgttgaaattaagctt

SEQ ID NO: 301 - DNA, 786 bp, Digitaria sanguinalis
gcttatgtcgcagtcagggcaggtcgacttcgaccaggacatgacggagagggagaagatggattacctccgcaagcaggagcgtgattaccagcagcgtgtccgaggtgcaaagccctgcattttaccggaaaatgtacgcggggaggtactgggaatgatgaagaagcaggagaaggttagcgccaggatgctgcagaagatcagggaccatgtccagaagtggtaccacaatgagggtttcgtatgtgcccaggtggttaactttggaaaccttaacaccaatgaggttgtgtgtgaggtggtggaaggcgacatcaccaaggtggagtaccagtttcaggataagcttggaaatattgttgaagggaatacccagcttcctatcatagaccgagagttgccgcaacaggtatgtctgttacaacatcaatctaccaccaaacatgttacaatggttagcttctagtaacgcttggtaacgcttgcaacattctattttaactaatgtatgactcatttatgagccgtcctcgaggaaaatttatgtggataagatatcatgtagcatgcaaacatacttgtatacgatgttactcattacgtttgctgctgcgaatcttcaagaaaacgacaaaatgtttcttgtgcccactatgatgttgtttgatgtgcatcatatttaattatgattctccaatattcattatcccggcatgtattttctctccaagcatgtccatgtcacctgtaataactccgctccactgatcttttacagcttcg

SEQ ID NO: 302 - DNA, 297 bp, Digitaria sanguinalis
ggaggattccttcttcgaaatggtaaccctgcatccaggtggtgtgtacaccaagtcgcagctgctgaaggagctcgagacactcgtctcatgtggcatgtttgagcgggttgatctggaggtgaagccaaagccagataacaccattggtctcactgtctcctttgtggagagcgtgtggagtgccgccaaacagttcaagtgcatcaatgtggggcttatgtcgcagtcagggcaggttgactttgaccaggacatgacggagagggagaagatggattacctccgcaagcagga

SEQ ID NO: 303 - DNA, 917 bp, Echinochloa crus-galli
  unsure (1)..(917): unsure at all n locations
  unsure (1)..(917): unsure at all n locations
ctaatagtatctgtacccatggttgtcgagcaatgcctagtggtggtttgagcatggatggacctcccacaaccctcagtggcactggagttgatcgaatggcattcctacaggctaatataactcgagacaatactgagtttgtaaatggtgcaattattggagacagatatattttccagttggaccaaggtcttggcatcggaagcaaaaatccattcttcaaccgtcatcagcttactctgacaaagttcatcaatttgaataagcaagagaaaggtgcgggcaagccactgccagctgttttggttgttcatggtcattatgctggttgtgtgggagatttgccaagctatgatgcatttgcactcggagggccttactctgtcaggggctttactaacggtgaactgggtgcttctaggaatattctggagcttgccactgagttgcgcatccctgtaaggaacacacatgtgtatgcatttgctgaacatggcactgaccttgggagttctaaggatgtgaaagggaaccctacagagttcttcagacgcgttggttatggatcttcatatggtgttggtgtcaagcttgggttggtaaggggagagtacattgtagatcacaatgctggtactgggaccattttcttcagatttggtgagagattttgagtggacttcattccgccgcttgggaaggcacagattttcgaggcgtaccgtctaacgcagctgaatcctgtggttcttgtggactgataggatcaaagttcgaacggcattggagctctgctaaaataatgaagctttgatattttctgaggaagagtggtagctagagtgaggtgggttttttangtaggatgtaatgtcagatctttcggagcttggcttataaaaaagttgaatgtt

SEQ ID NO: 304 - DNA, 1061 bp, Echinochloa crus-galli
gcccaagccggataacaccattggtctcactgtctcctttgtggagagcgtgtggagtgccgcgaagcagttcaagtgcatcaatgtggggcttatgtcgcagtcagggcaggttgacttcgaccaggacatgacagagagggagaagatggattacctccgcaagcaggagcgtgattaccagcagcgtgtccgaggtgcaaaaccctgcatcttaccggagaatgtacgaggggaggtactgggaatgatgaagaagcaggagaaggtgagcgccaggatgctgcagaagatcagggaccatgtccagaagtggtaccacaatgagggtttcgtatgcgcccaggtggttaactttggaaaccttaacaccaatgaggttgtgtgtgaggtggttgaaggtgacatcaccaaggtggagtaccagttccaggataagcttggaaatattgttgaagggaatacccagcttcctatcatagaccgagagcttccacaacagcttcgacctggccacatctttaacattggagcagggaaacaagctctgaagaatataaattcacttgctctgttttcaaatatagaagtgaacccacgtcctgatgagacaaaggaagggggtatagtagttgaaattaagcttaaggagctggaacccaagtcagctgaagtaagcacggaatggagcattgtacccgggcgtgaaggcagaccaactctggcatccattcaacctggaggaactgtgtcatttgagcaccggaacatctatggcctgaacagatcaattgttggttctgttacatccagcaacctgctgaaccctcaggatgatctttcattcaagcttgagtatgtccacccttatttggatggtgtggatgatcgtagtaaaaaccgcacattcaaaactagctgcttcaacaccaggaaattgagtcctgtctttgttgctggtccaaacatggatgaagctccacctgttggattgatagagttggatttaaagccaacataaccgagagcttcacgaggcaaagcaaattcacatatgcctt

SEQ ID NO: 305 - DNA, 2624 bp, Euphorbia heterophylla
cgccttcaaatgcgatctttcttcctcttcctcttcctcttccacctcctcccacaaccctctttccaatccctcgaaattgcgcacctccatccttcaatccctctccaagcctgccgccattgctggcgctgcttccgccgttcttcttcttcgctttactcctttcattgacggacctggcaactctggcggcggcggttggttcggaaatggagggggaggaggtggtggtggtgacggatttggggacggcggagggttttggaagagactgttttctccggcgcccgcaattgcggatgagttgcagtctgaagagtgggatcctcacggtttgccggccaacattatggttcagctgaacaaactgagtggattcaagaagtataagctctctgaaatcctctttttcgataagatacggtgggccaccgtcggcactgacgactctttctttgagatggtgtctctccggccgggcggcgtctacaccaaagcccagctgcagaaggagctcgaaaccctagccagctgcggaatgttcgagaaagtggacatggaggggaaaaccaagccggacggaaccctagctctcacgatttccttcgctgaaagcacctggcagtcagctgagaggtttaggtgcataaatgtgggattgatgcagcagacgaaaccaattgaattggatccggatatgactgataaggagaaattggagtattacagaagtcaggagaaggattacaggaggaggatagaaaagtccaggccttgcctgttgcccaatgtagttcagagagaggtgcttcaaatgttgagggactctgggacggttagcgcgagaatgctgcagaggattagggatagagtgcagaaatggtaccatgatgaaggctatgcttgtgctcaggttgtcaattttgggaatttgaatactaaggaagttgtttgtgaggttgtggaaggggatatcactcaattgctcattcagtaccaggacaagcttggaaatgttgttgagggtaacactcagcttccagttgtcaagcgagagctgcccaagcagcttcgtcaaggtcaaatatttaacatagaagctggaaagcaagctctgaggaacataaactcattggccttgttttctaacattgaagtcaacccaaggcctgacgagaagaatgagggaggaataattgttgagatcaagcttaaagagctggagcccaaatcagctgaagtcagtacagagtggagtattgttccaggacgtggtggccgtcctacactggcttcattccagccaggtggaactgtttccttcgaacaccgaaatatcaaagggctgaatcgatccattcttggttcaataaccaccagcaatttcttcttgcctcaggatgaccttgcatttaagctcgagtatgttcatccttatttggatggtgtatataatccacgcaaccgaactctgcgtacaagctgctttaacagtcgcaaactgagtccagtctttactggtggcccaggagtggatgaagttcctcctatatgggttgatcgtgctggcctcaaggctaacattactgagaatttcacccgtcagagtaaattcacgtatggaattgtgatggaggagataacaacaagagatgaaagcagccatatctctgcaaatggtcaaagagtgttgccaagtggaggaattagtgcagatggacccccaacgaccctcagtggtactggcattgataggatggcttttctgcaagcaaacatcactcgtgataacaccaaatttgttaatggagctgtagttggccaaaggaatgtgtttcaggtggatcaaggtcttggaattggcagcaagtatcccttctttaaccgccaccagcttaccctgacacgattcatacagttggcgcaagtggaggaagccgctggcaaagcaccgccacctgtactagtcctgcacggtcattacggtggttgcgtaggagaccttccaagttatgatgcttttacccttgggggcccttactctgtgaggggctacaacatgggtgaactgggagcagcaagaaacatccttgagcttggagctgaaataagaataccagtgagaaatacgcacgtgtatgcatttgctgagcatggaaatgatctaggaagctcaaaggatgtgaagggcaatccaaccgaggtgtacaggagaatgggcaagggttcgtcatatggggttggtgttaagttgggattagtgcgagctgagtatgctgtcgatcacaatactggtactggatccgtgtttttccgatttggggagagatattgaaggatttgctacatcagactgaaattttaattacatccttaggacttgatactttgtttgaatctcactagaattttgtctagtttttcctactatctagcctacaaaagagaaaacattgtttgggagtatgtacttgaggcaatgcggttttctagtatattgtttgtgcaaatttggtaataagttgtatgactgatgaaattttacattttgtatttgttggttcaaattcccggtcttgcttgtatttaaatttaaaaagttgaatacaatcagctgtgtg

SEQ ID NO: 306 - DNA, 7053 bp, Euphorbia heterophylla
  unsure (1)..(7053): unsure at all n locations
  unsure (1)..(7053): unsure at all n locations
agaaacttcataatatggttcatgccttaataagtctgaaaaacaatcttaatctgatttattttttataagattaaaaaaaacttgaaatgaaggttttcagaaaataaactagccctcaatactctccgtaggaaatattccttctaatgttttatgtgaccaatgtcttaggttataagagatctcatgttaaatactactggtgaaatgaaaatattttatttatttattgtaagcataattgtgcaaaaaaatttggcttaacgcattcaaaactcctttactggacacattttgtcacatgttactatcaactttcagcatcatcactttaccctcctaaagttggcaaaactgatacaatttgtccccttaatccacgtgtcaatttctgattgaaaatagaaaaatatagaaaatagaaattttaaaaagtcaaaccaaccagaaactggcactgagggggcaaactatannnnnnnnnncaactttagagggtaaagtaatgacactgaaaatttgggatgacgtgtgacagaccgtgccaagttaaaggggctttggatgcgtttgaccaatttttttatagaatataagagacttaaataccttattagatcctcttttatgactcaaattcccttttagtgtctaacatattgaaattacttatttggtacctgaaatatttacatttcttcatttcgtgctttttttgtttttaaaaaatttgtctcgctaagctaacagtaataagaaaaaagcatatgaccttttggatcaagactcaactattaggctaagcctttcgccactgctccatttggtgcatcacgtattcaatatatgtgttgaacttagttcagaagaactaaagaagtctcagaagcttaagctcagaatccaaaagtcaaattttgaatataactaaaaatgagtaagaagatgcacgctcaaaagatggttaatgctcaaaagatgcttaaaggtcagaaaactgaaacatcagaaataagacaaagaaagactatgagataggaagccaaggaactcgaaggacttataaggctcacaagagaaggatctccaattgtcaaaagctataatcgcaagtaaacgactcatgtgaagacaaatactaaaaataggtctctacttcttaagacataaaaagataggtgactagaagtcttcaaaagtgagttgacaacaaagagaatggaaaccttttagcaacctaacaaactaacacaagcaagttgtattggattaaaaggtgcaaaagtttgaagaaaagcaaaaagttggtagagtttaaggaaatcaagaatgagtttgacgaaagatccaacagctctcaaggaaaaaagattttgtcacttgaagattgtgactccgaggataagtcacaacaaaaagattttgaagacagtctatataaaggcctctactagcagagagaagatgatccaagcttttcataatcaattgcaatctccctacacttttgtaaatactctcaagcaaacaatcataaaaaaaaacttgcttaaattataggaagcttagaacaaatatttctaacatgttgtaagttattcttgataactcaaagtaaagaccacaaaatcatttcaaacccactcttgagactaagcatggagattgttgggactgttgtaaccctgaaaatagtttggcgtaagttgtgtttcataagagctcaagaggagggtatagtctttaattaaggaattagagacatgaagtggatacactctatgttgtatagaattccatcgtaaaggcttatccacctcaaaaggagttgacataatggattaatgcttaaaaacagacgttttgatgactagaggtagtcagagttcgaaccaatataaaatcacattgtaaaaatagctaactcggacacatccatttttgcacgtattgtatcagaggtttttcttgctttatttgctaaaaggagtcaatcacccattctgactccaaatcacccctttaagaccaacaatataccgtgtttagacatgatttattgaattttagtacattgatcatccgtctaactacctaaataatatgaaatacttatatcatcattcaatgtataaatatatcttgaccatgtagaattgttgattcttaataaccctttaaatcgactaaaattaaacaggtttagcactatattgataaaaactaatatgtaagacacaatttcaataaaataaacactaaaagaacaatatgaattaatatgacccaaaaaatattttgccctaaataaaaactattgatttctattcattcaaaaaaaactattggttttctatatattaaattaggaaaaaaatttatacttttattagaaatatttttccttggaaatcatggtgtattttccaacattgaactctgtctcttgttcagaaagtttatttgatattttatttttgaaatataaaattaaaaaatgaaaaatgaaattagaaatatcaaatatcaaatatcaaatataaactctaaaagaaatgacacattcatttaaaattatattagacaattaatatactttccaataatagttatgaattgagaaatgaattttggaaggcatatgaagttcatttcagaccaaaaaaacatggctcaaaatatatataaaaaagcatagattaaaataaaattataattgaatagtacaacaaaatacatagtggcactgagtcgcactcaccgggtcgaggcagattgagagcataaacccccaaatttcccttttcttcttcttcctccttatcccctcgctccatagccatgtcctccttcgccgccccctccaatctcattaccaatcctccgctttcctcctcctctctcccctctcgtcgcccctcacgcgccgccgccgcccctcgctcctccgccttcaaatgcgatctttcttcctcttcctctacctcttccacctcctcccacaaccctctttccaatccctcgaaattgcgcacctccatccttcaatccctctccaagcctgccgccattgctggcgctgcttccgccgttcttcttcttcgctttactcctttcattgacggacctggcaactctggcggcggcggtaggttcggaaatggagggggaggaggtggtggtggtgacggatttggggacggcggagggttttggaagagactgttttctccggcgcccgcaattgcggatgagttgcagtctgaagagtgggatcctcacggtttgccggccaacattatggttcagctgaacaaactgagtggattcaagaagtataagctctctgaaatcctctttttcgataagatacggtgggccaccgtcggcactgacgactctttctttgagatggtgtctctccggccgggcggcgtctacaccaaagcccagctgcagaaggagctcgaaaccctagccagctgcggaatgttcgagaaagtggacatggaggggaaaaccaagccggacggaaccctagctctcacgatttccttcgctgaaagcacctggcagtcagctgagaggtttaggtgcataaatgtgggattgatgcagcagacgaaaccaattgaattggatccggatatgactgataaggagaaattggagtattacagaagtcaggagaaggattacaggaggaggatagaaaagtccaggccttgcctgttgcccaatgtagttcagagagaggtgcttcaaatgttgagggactctgggacagttagcgcgagaatgctgcagaggattagggatagagtgcagaaatggtaccatgatgaaggctatgcttgtgctcaggttgtcaattttgggaatttgaatactaaggaagttgtttgtgaggttgtggaaggggatatcactcaattgctcattcagtaccaggacaagcttggaaatgttgttgagggtaacactcagcttccagttgtcaagcgagagctgcccaagcaggtaaaatagatgatgaattcgatcttttgtgcttgtaattttgtatgatttggatatgtagtctttgcacaatctaggtttcagctttagttagcaaccatgaattatttataagcagtcagatctcattgaattgaaagacaatatgaggaatatggtacgttaaatactagcaaaaatatacgacttagtgagacccctggcctgaatgctgaaaaggatacatctttagtacacgaacactctaatgatcagtctacaagagaatatatttgtcttgaaattggataaacagccaatgactaagcaattgacagtttatctgaatatgcagttcatgatgccaaaaaaaagtaaatataaaatttatttttaatattcatttgttacttgtatgcccgccatggcaatatatttgtggtagtttgtgcattgattcttgtatttaaattggtgacatacagcttcgtcaaggtcaaatatttaacatagaagctggaaagcaagctctgaggaacataaactcattggccttgttttctaacattgaagtcaacccaaggcctgacgagaagaatgagggaggaataattgttgagatcaagcttaaagagctggagcccaaatcagctgaagtcagtacagagtggagtattgttccaggacgtggtggccgtcctacactggtatgtttctatattacaaaagtaaaatttgagggttcaaaccatggttcaattttaaaaaaacttacaccaacccattggccatctctatttcaggcttcattccagccaggtggaactgtttccttcgaacaccgaaatatcaaagggctgaatcgatccattcttggttcaataaccaccagcaatttcttcttgcctcaggtaatttgagttaatatatgtattatgctttttctcgagaagactatcctttagctaatatatttcaattgaagatattaatggttaattttgtacccaggatgaccttgcatttaagctcgagtatgttcatccttatttggatggtgtatataatccacgcaaccgaactctgcgtacaagctgctttaacagtcgcaaactgagtccagtctttactggtggcccaggagtggatgaagttcctcctatatgggttgatcgtgctggcctcaaggctaacattactgaggtgattgtctgagagatagatctcgttgctgacttattaattgttctcctaataaatgttcatcgatatgcatgaaacagaatttcacccgtcagagtaaattcacgtatggaattgtgatggaggagataacaacaagagatgaaagcagccatatctctgcaaatggtcaaagagtgttgccaagtggaggaattagtgcagatggacccccaacgaccctcagtggtactggcattgataggatggcttttctgcaagcaaacatcactcgtgataacaccaaatttgttaatggagctgtagttggccaaaggaatgtgtttcaggtgccccctcatccttgttatgttttgactagtcaattatttaatctactgacccctgtccttcataatgtttttgtggtgctcgggacactattggcaagttttcattgctaactccactgagtttttttggcattgctctagtcttctttagagtttagtctttttgttctccaccattattaggtttaagcaaggaaaagccgtcctcgttgccttgaggagctaatacttaatagctcttgatgttctgaatcaaggaactctgttgttttttaattttatggtctgtaatgactagtttcaagcattaagcaagattttgtaaaatagagcatggaaagtacatggttgctctttttgttctcttgtgcatctcaactgcagtgtctctttgaatattttttatgtccttgtatctgcaagtgcttggttggtttccccttaacatgtataatgtggtaatgtgatgttgatctacaaattaccacatcagccaggtttggtttattttttttatcatacaatatatatatagcaatctgattttgacttgtgtataatgtgattgtgatgtttgaattgtaggtggatcaaggtcttggaattggcagcaagtatcccttctttaaccgccaccagcttaccctgacacgattcatacagttggcgcaagtggaggaagcggctggcaaagcaccgccacctgtactagtcctgcacggtcattacggtggttgcgtaggagaccttccaagttatgatgcttttacccttgggggcccttactctgtgaggggctacaacatgggtgaactgggagcagcaagaaacatccttgaggtaggaatatcgaatattcattcttctatttcatgtgaattagaaaatctttcacaaaacacctggtattatccttgaggtatggtttttttatttttgtgaaattggttgcagcttggagctgaaataagaataccagtgagaaatacgcacgtgtatgcatttgctgagcatggaaatgatctaggaagctcaaaggatgtgaagggcaatccaaccgaggtgtacaggagaatgggcaagggttcgtcatatggggttggtgttaagttgggattagtgcgagctgagtatgctgtcgatcacaatactggtactggatccgtgtttttccgatttggggagagatattgaaggatttgctacatcagactgaaattttaattacatccttaggacttgatactttgtttgaatctcactagaattttgtctagtttttcctactatctagcctacaaaagagaaaacattgtttgggagtatgtacttgaggcaatgcggttttctagtatattgtttgtgcaaatttggtaataagttgtatgactgatgaaattttacattttgtatttgttggttcaaattcccggtcttgcttgtatttaaatttaaaaagttgaatacaatcagctgtgtgatatgaatgggacatcatctaagctattagcaatgg

SEQ ID NO: 307 - DNA, 920 bp, Festuca arundinacea
aaacacgttccagtgatatttttggccacattatatgtttaataccatagtaggtaaattatttgcaaatgttctaatcgctctgcaagcctttaagcttgtgtcagttattgtttaataccatcatgtgctttttgaaagttttccatggcattatactacttaaaaaatttccttattgactgcagttggatcaaggtcttggcattggaagaaaaaacccactcttcaatcatcaccagcttgacaaagttcattaatttaaacaatcaagagaaaggtgttggcaagccgctaccagctgtgttggttcttcatggtcattttgcaggctgtgtaggagatctgtcaagctatgatgcatttacccttggtggaccttagtcagttaggggctatggtacgggtgaactgggtgcttttagtaatgttcttgaggtgggtattactacataacttaattttttttctaatgcaccatattcatcacaaattgtgtcaggttttacgagttactgtctttcttccgatttattcattaaattggacaagtggaaaatacgacacataattattttataacaaatggtggttgttgctttgttggtaactgattattgacgtgccttctaatccactcaggttgctagcgaggtccgcatacctgtgaagatatgtttatggatttgtcgagcatcgcaccgacctgggaagtcccaaggacgtgggaaccctacggacttcttctgacgtgttggccacggatcttcttattgtcttagtgtcaagtttggcttggtgaaaggagagtaaattttagatcacaacacttgggctgggaccgttttcttcagattcggcgagagattcggagtgcaattcattcggccactgagaaaggcacatatcgtcaagatggg

SEQ ID NO: 308 - DNA, 494 bp, Festuca arundinacea
accgccatcagctaacagtgacaaaattcattaatctaaacaaacaaaagaatggtgccggcaagcccccgccggccgttctcgttgcccatggccgctacgcaggctgtgtgggagatctgccaagctatgacgcgttcgcgcttggagggcctcactctgtcaggggctatggcatgggcgaactcggcgcttcgaggaatcttcttgaggttagtatatagtacggtaccaggtttcgcagatatcacttttgaccgaaacacacatggtgaagataacattaacaagtacgcataagaaaatatatcagtttcaacccaagctcgcataagcaatggtaaagaatgaaatgcacaaatgaagttaaaaaagtgtcaagttcacctgaactgacgcatcatttctgtgccgttatcatgtaggtcgccacggaggtgcgcatcccagtccccatgatgaagaacacacaggtgtatgcttttgccgagcat

SEQ ID NO: 309 - DNA, 261 bp, Festuca arundinacea
acctagaggggaaggccaagcccgacggcaccctgggcctcaccgtctccttcaccgagagcgtgtggagcgcggcgaagcagttcaagtgcattaatgttgggcttatggcacagtcaggccaggccgacttcgatcaggacatgacagagagggagaagatggactaccttcgtaagcaggagcgtgattaccagcagcgtgtccgtggcgccatgccgtgcatattgccagagaccgtccgaggggaggttcttgcga

SEQ ID NO: 310 - DNA, 779 bp, Festuca arundinacea
agagggagaagatggactaccttcggaagcaggaacgagattaccagcagcgtgtccgtggcgctatgccctgcatattgccagaaaccgtcagaggggaggttcttgccatgatgaagaaacaggagaaggtcagtgccaggatgctgcagaagatcagggaccatgtccagaagtggtaccacaacgaggggttcgtatgcgcccaggtggtcaacttcggaaaccttaacaccagtgaggttgtctgcgaggtggtcgagggggacattaccaaagtggagtaccagttccaggataagctcggaaattttgtcgaagggaacacacaaattcctatcatagaccgggagctgccccagcaggtatgctgcatacccactagttactaaaaccagcatgggggaataattttattagcattactatgatgttctattgtcaattaaaatgttaaaaagatagtgattaccgtgacattttattttgaataaggaactaaaataaattagcttatagtagtgttctctgacattttaatttgaccaaatgaattttgttatgcatcatttttggaaggttagcgtttagtagttgttgcaatatcctgtgaaatcggaatgcagctgggttctgctttcctgttgaaaaccatcttttatcacttatgtattatgcatgatttttattagcgtgttggttagctaggagagtagcagcccgtagcatacccttttgtgacttgtgttttggtgattgttcagcatgcaataatctca

SEQ ID NO: 311 - DNA, 332 bp, Festuca arundinacea
gtcgtcgggcgattgggatccgcacggtctcccggccaacatcacggtgccgctctccaagctgagcgggctgaaaaggtacaagctttcggagctcaagttcttcgaccgtgcagcgcctgccggcggcggtgccacggaggctgggccggaggactccttcttcgagatggtaaccctgcagccaggcggcgtgtacaccaagtcgcagctgctgaaagagctcgagacgctagtctcctgcggcatgttcgagcgggtcgacttagagggaaaggccaagcccgatggcaccctaggcctcacagtctccttcaccgagagcgtgtgga

SEQ ID NO: 312 - DNA, 678 bp, Festuca arundinacea
gatgctcattgagctgatacgaatattatgcagtaaaatgttttttattgtttctgagacttcagcatttaaattatacttctgatgctctgttacagcttcgtcctggtcatatcttcaacattggagcaggaaaacaagctttgaagaatataaattcgcttgctttattctccaatatagaagtgaatccacgccctgatgagacaaaagagggtggtattgtagtggaaattaagcttaaggaactagaaccaaagtcagctgaagtaagcacagagtggagtattgtacctgggcgtcaaggaagacccactctggtaatgtacctactaaattagcaatcttctattttcgcaatttaaaattgctagccacgtgcctaaactacacaatattgtaatcctgtttcacaaccttgtatctgatgtcaaatttcttttaggcatccattcaacctggaggaactgtgtcatttgagcaccgtaacatctatggtctcaacagatctattgttggttctgttacatccagcaacttgctcaaccctcaggttagttggtaatgtgttacttgtttctgtagtttttctttgtttgcttttgtttattgttaattaacgttagttatttggttcaagaattcacagggtcagttaagcatgtcattcttgattca

SEQ ID NO: 313 - DNA, 840 bp, Festuca arundinacea
ttgtacctgggcgtcaaggaagacctactctggtatcgtgtctaataaatttgcaatcttctatttttcatgaaatctctatttaaaaactggtaggcatgagtaaactacactattgtattcctgttctgcaacctcgtatctgatggcaaatttcttttaggcatccattcaacctggaggaactgtgtcatttgagcaccgcaacatctatggtcttaacagatctattgttggttctgttacatccagcaacttgctcaaccctcaggttagttggtaatgtgttattcgtttctgtagtttttcgttgttttccttttggttaatcatttagttcaagcattcacagggtaagttaagcatgtcattcttgattcaattattatctgttcctttcattacactaccatcttggaattgtatttctgtacattgtctacacttccatttgcaaaatccttaaacatactttagcttcaagccttcaactggccactagataaagagcaaccgtgtcatgtgtagaaactagacatgtgcacatggtttctatgtttccagcatcatgaacaagctttggttcgtttcattttggcaacataataacctaacatttgtttatcattctcccatcctgagatgttttttcttttctagaatactcctgagatgttttatcatttccgattttaatcttattaggggaatgtctgattatcgttgttccatatgcatgtgcttatccattgttttttattggtctttaggatgatctttcattcaagcttgaatatgtccatccttacttggacggcgtggacgaccgtaacaaaaacc

SEQ ID NO: 314 - DNA, 1053 bp, Festuca arundinacea
tctagaaatgttcttgaggtgagtactgctacagaacttttctctctctctgatgcatcgtatattcatcacaagttatgtcatgctttacgagtaactgctttttttctttctaatttattcatttaattgaacacgttgaaaatttgatgcataattttgtgtaacatgtcgtggtctttgctttgttgctaactgttttttacatgtgttttaatccacgcaggttgctagtgaggtgcgcatacctgtgaagaacacatatgtttatggatttgccgaacatggcactgacctcgggagctccaaggatgtgaaagggaaccctactgagttcttccgacgtgttggccgcggatcttcttatggtcttggtgtcaaacttggcttggtaagaggagagtacatcgtagatcacaacactggggttgggacggtcttcttcagattcggcgagagattctgagtgtgtttcactcggcgactgggaaaggcacatatcgtcaagatgggatgattagtgcgctgttggggcattgggtctcaaagcggctatgcacgtggtgagctttttggattcaactggagaatgagacttgtgttccactagaataaagaagttttgttgtatttctgggcaagagataaggtagtgtcaggatgagttctttatttgtaggaagtgaggtttatctttcagatcttcaagctggtggttaagtagacgaaagttgagctcctagtgttaccatggaaggttttgacaaggcttctgtcacagtaaatttgtttcaccgttaacactttgtcaggttgtttagctaaattgtcaatgcagcttttgctccattgacgtcctatacgatgtagctaaattattatgatgttaaatggtaataactcgttgatctcttctagttcaaatatgggaacgatcaagctgagtttttagcttgtatgctgtgacgctgttcaaatacttatgttttgtaactgttcctatgctgctaagaagaaaccaatgcaaagaatcaataaaataaagtatagagg

SEQ ID NO: 315 - DNA, 1110 bp, Festuca arundinacea
atctttctaacatctgtctcaaaaaatgctgggcaagttcatgattaagctatgaagctgtccatcattgtaattcagtcctgttgctgaacctcatgtattcatgtctgatggagagcttcgtttcaggaatccattcaacctggaggaagtgtggcgtttgagcaccgcaacatctgtgggctgaacagatctcttgctggttcagttacatccagcaacttgctgaaccctcaggtgagttggtaatgggtgactgtttgatgaatgattattttagctttgtagtgtgctttttttttttacttgtgtagtcctggttactctagaagcagtcacacgcatgcaaggcattagtttctggtctactacaatctgaaagaactgtcaaacagcacatgcatgcaagccattcttacatataccttgaagctagcatagtactagcatggatcccatatatatccatgtctcagatgcacttatatgtatccatgtttttgtttgttttttaggatgatcttgcgttcaagtttgagtatacacatccttacttagacggtgtggaggaccgcagcaggaaccgcatcttcaaaaccagctgcttcaacaccaggaaactcagccctgtcttcgtcgctggccccaacatggacgatgctccaccaatctgggtcgacagagttggaatcaaagctaacataacagaggtttgcacaaatcaatgcccctcttccgaactgtaaagtattccaacttatatcattcactaactaattctcgaaaaaataaatctctccgcaacaattatttcagtttactttgatggtatcaattatgtatcacataatctatatattactacttctttactggtcaatggtcaagtatacatcctaaaaagattgtggcctacacacattttcagcaatgagagtatctcgtttcacatatttctctttccatcaaaactcaattaagccttttttcatgaatcatatccaacacgactaatgaattttcaatcatggattcgcagaacctcacaaagcagagcacgttcacgtatggcctcgtggcagagcagatcacgacgcgcgatgagagcaa

SEQ ID NO: 316 - DNA, 515 bp, Festuca arundinacea
cttcttgatttcagagcttcacacgccagagcaaattcacatatggccttgtggtggaagaggtcacaacacgtgatgagactaatagtatctgtacacatggttctcgggcaatgcctagtggtggtttgagcatggatggaccacccacaaccctcagtggtactggggtagatcgaatggcatttctacaagcaaatataactcgagacaacacagagtttgtaaatggtgcagttattggtgacagatgtattttccaggtatgctgatcaggacccttatgtttctgaaaacaaaatagtagtccttcagttactgccaagcggctctagacaaggttcaaatgctacccttaattgctcgaaaagaaccatgatagacctctttatggttgatctttgcttcaagtttccactttgggacttccacacagtgcacataaggttaaaacatgttccagcgaatagctatattatatgttcaataccagtaggtaaattatttgcatatgt

SEQ ID NO: 317 - DNA, 2626 bp, Ipomoea hederacea
gtcgatcggcgcgtcgggtctcgctttctccgttagccattcccatcgccgacgtgttaagccatcggcaacggcctccgtgcccgctgcccgtccccttccccttccaccggtctcagtcaaatccaaccgaactgctttatcctcatcctctcaaaaccctgaaccctcgttttccacgcataagccaaatccttccattttgtcctccaaactgtttaataggctcttaaaagcatccttcgtactcggctctggcctattcttacttcccagcgggttgcctaagcatcttttcaatcttggcggaggaggcggcggcggctccagcggaggaggcggcggcggcggaggtggaggaggaagtggtggcggtgaaggtggtaatttatggtctaagcttttctgtccctcggccaatgcgggagaggaagagtcgcaagagtgggacaaccacggcttgccgtccgacattgtggtccagctaaccaagctcagtggattcaagaggtataaagtatccgacatcatcttctacgatcggaaacgcggctatagtttcggtagtgaggattcgttcttcgagatggtgtcgctccggccaggtggggtctataccaaggctcagctcgagaaggagctcgaaaccctagcttccagcggaatgttcgagaaagttgatttggaggggaaaacgaaatcggacgggacagttgttatcactttccccttctatgagagcacctggaggtctgccgaatctttccggtgcatcaatgtggggttgatgccgccggaaaagccaattgagacggatccagacttgacaatgaaggagatggaggagtattatagtttacaggcgagccaataccagacaagaattaagaagtccagggcgtgcctgctgccagggaatgtgcaaaatgaaatcttgaatatgatgagagggcgtgtaagcgcaagaatgcttcagagaattagggacaaggtgcaacaatggtaccacgaaaatggatatgcctgtgcacaagttgtgaactttggtaacttgaacacagacgaggtggtttgcgaagtggtggagggtgatatcactcagctagctattcagttcctggacaagcttggaaatgtatgcgaagggaacactcggcttgctgtagtgaggagagaaatacctaaacagcttcgtcaaggacaagttttcaacatcgaagtggggaaacaggctttgaggaacattaattctcttgctctcttctctaatattgaagtcaacccgcgcccggatgaaaagaatgagggtggaattgttgtggaaattaagctgaaggaattagaacagaagtctgctgaagtcagtacagagtggagtattgtgcctggacgtggaggtcgtcctacattggcttcatttcaacctggtggaactgtttcctttgagcatcggaatattaaagggttaaatagatccttgcttggtacagtgactaccagcaacttcttcaaccctcaggatgatcttgcatttaagctagagtacgtgcacccatatttagatggtgtaactaaccctcgtaatcgtacgttccgcactagctgcttcaacagcagaaaattgagtccagtcttcacaggtgggccaggagtggatgaagttcctcctatttgggtggaccgaactggagttaaagccaacattacagagaacttcacacgtcaaagcaagttcacttatggacttgtgctggaggaaattacgactcgtgatgaaagcagccatatttctgctcgtggccagagggtattgccaagtggaggaattagtgcagatggacctccaacaactctcagtgacactggcattgacaggatggcgttcctgcaggcaaacatcactcgtgataacaccaagttcataaatggagcaatagtgggcgagaggaatgtattccagcttgaccaaggacttgggatcggaagcaagtttcctttcttcaaccgccaccagttgacattgacccgatttattcagttgaaggaagtggaggaaggtgttggtaagtctccaccacccgtattagtccttcatggacactacgggggttgtgtgggagatcttgctagctatgatgccttcacactcgggggaccatattcagtaaggggatacaacatgggagagataggtgcagccagaaatatactcgagcttgctgctgagctccgggtacctgtgagaaacacacacgtttatgcatttgctgaacacggaaatgatctcggtagttcaaaggacgtgaaagggaaccctacagaggtttacaggcgaatgggtcatggttcctcttatggcgttggagtgaagctcggtctagtacgagcagagtacgccgttgatcataactctggcactggcgcggtattctttaggtttggtgaaaggttttgaggaccatatacagcagttgagttgttcatggtatgaggataccatttcatttaacaattatctttcataataattagtgtagttttttgtaaccgggattgcttccataagatttaatgtcatttttattaaattttagtgtataatacttattataattaataatttatt

SEQ ID NO: 318 - DNA, 5553 bp, Kochia scoparia
acttttggtccatgttagccgactcctcatatgggattaaggctttgaatcctttgattgattgattgattgatattatggtagaaaaatatctatcagacgttatatttaaggtagtaaatgctataaattcttcaaatgctataaattccttgggagttacccagtgtttgggtttttaaggactaaactttcacacatcctgtaatcacttctgactgttgtatggagaaacttcctagcacttctttgtttgttgtggagttgctaaaggctagtcggatagtaattcagtggcaatgatttgagtggaagtaattagtagtcatactgtcaggattgggagcggggatagattgtatatggttatggttggttcctatgtttgccaaaccccttgctagattcttgtttggaccattttccagtatgtagtgggatgtgatacgattcttaaaaaaattaagttggaaacttgtcaaagtggttgtcttgttggcattttacaatgagcatgatcattgtatcttcaagggaaatttttgaggcactcttgagacatttcgatttaatcaaaataatgttcgtgaagttatgattaaagagtaccttttaatgttcttatattttaaatagattaatggcttttctgactgaagtcttagctccgaggtattttgatagttttgacaaatttgtgggaatttttgttatctttgattattttgtttagctttcagtggtgcatccaagtaaaatgcttgaatctgtatatgcaattgagtactttagttcaatttgatgaaattctgactttattcatgtctctgattgcagctggaccaaggccttggaataggcagtaaatttcctttctttaaccgtcatcagctaacattgacgaagttcctccagttgaagcaagtagaagaaggtgctggaaaaccacctccacctgttcttgtcctacatggtcactatggcggctgtgtgggagacctgccaaattatgatgcttttactcttggaggaccctattctgtgaggggttacaacatgggagaaataggtgcagctagaaacatccttgaggtaagagtttttttgttgacagtgattgtattatcttcaatgtttgtacaaaggtagcactctcaaaacctaagtgtgcaactatgatggcatgattagcacttagaaacctttattgaaatttgaaagatatctgatcataagcttgtttttgtctgtagcttgctgctgaactacggataccagttagaaccacacatgtatatgcttttgcagagcacgggaatgatcttggaacctccaaagatgtcaagggaaatccaacagaagtttaccgaagagtcggtcagggctcatcttatggacttggtgtcaagctaggccttgtccgagctgaatatgctgttgatcataattctggcactggagcaatattcttccggtttggtgaacggttttgagctcagttttattggttcacagttttcagtttgtttgctgaggtcaatttagcttctggtagtgtttttgtacaatggtgagattaaattagttttttgagggcgaatgggcagattgtaggaaaattagctccgttgtggttagtcattaagactggaaactgatgtttaattcaattgagtattcaattcgaaggaatcaataacttcattacttgttcttgttccatactgtaatcaatggttattgacttaagtaatttgaacacaagggagagcaaacttcctaaaaaataggattattcctgtttatacaatcatatcttcaaattacaacatgtctctcttatcactcctaagctgctttaaattggccctaaacaatcaaaactcaggttctgaataaaatatatcaaccctcgagcagggaaacacaatgaagatacaagaatttccaactgaaattatcacgatgtatacaagtatatacgtatataacaaaatccaaattgaacataacagaacatgttctatttaagtgtcatagttgctatttcagtgtcatagacccaattccttcttcaattgagcaagggcagcttctatatcgtcaatactgtcctcaatgctattttttccaccagtttcgttttcagcattatttcctcttcgagcaccagaacttccgttagaaccatccctaggtgcctcaacatcgaagtcttcatctgtgatgttaagttctttttctaagaattcaacaaactcttcacctatttcctgcaagtatatcagtttccatatttagctagctttgcagcctaactaatagattttatttaatagcacctagcaccactataaaatccaaactgaagtaataagatagtttggctcaccgataactcttcccacaagctctttggcctgccttgtgatgaggcacttgcctcccagttttgaaattcttcctgtagatctctaaagaaatcacctgcaacaccgaacccggacttgagaagaaaaacagaaacaaactaaagattttattgaaaaataccatgcactagaagggggaaaaaaaaacaagcaacagagaaacaacgccagctaggctaactggatatatgatacacatcaaatcactgtgtccttgtattaatcaaagatgacaattctacctactgtaatttggacatccctcacaaattcacctgcaacagaaacgtgttcagtataaaaatatgatcctacgacagcacttgacaatagacacacaagacagatcatttaaggtggagagttttttacttgatgcctcacaaatattgcaggcttggggcatagaaacatatatgcagacaatgtggtaatgttaatgttaccacagttttgctaccaaacagcaggtaagtcaaccaagaaccagaatagcactaattaacatatctcaattctcctagttgccttttgcagacaatacttgatcacagaacaaacaaagatgaggaaaatgctgcattgacgaacagaaatcattgcttaataagttatgtacactgcttaatacaataggaacaatcaactaagcatacatacaccatcgcctaaattatcaacaagcaaatcagatatgataggtcaaggatgtaccaaatccgtaaaaatcttcctcctcttgggtgctttgacttcttccagaagatgtatatgaataatcagattttcgatttccagagtcatatctatttcgagattcagaattgattattgtattgtatgcatgctttattctcataaatttctcttgagcatttgcctgtgtacatagaggtaactttagttctataagatactagaaatgcataacgaaggttccacagtcaaacaaaagccacacgtgttacttgtgtaaacaaagtaacgttctttccaacaatctactatgaaacaattaatgccaacttacaaaaggtggatagctgttcaaaaatttcataacatagtttatgaagatgcaaaaaaattagcaaaaatgcatgactagacaacatacatgcctctttaaatctggagtgcctcgttaattatctgtcatcactttcatcaaacttgttttgcctacataacaaagcctcagctaattaagttaggttacgaaatcattctcaaacaaaggtcacatgcattattggtatgataaataaatttctgctcaaaaattccagtctacaccatgcaacaatcaataattcaatagaaaattagaaatgtgcaattacatactcaaatcagtcacatgtcttataaacctctctatcaaaatactaagcttacctaacaaagccaccatctcatttaggaggaggagttgggtgaatcagctgtatttattctagtacacaaaggcagttacaaatctctatgtcaaagtccacaacgagttcaaaaacacaactatatcccagtatcatctaatattgccacttatcagtgttgtaagttgtaactacatgaagaagtggcatttagaggtaaatagaaattcgacaaagagagcacacattgaggtggtgattagtattcgccaaggacacttccttcgcaaaatcatgtatggaaacaggctaaaacatatcagtgtcatagcgaatgcctattgtcattgctaaacccaatacattattgtccacactggcaaatgtattaggaaatgcccaagccccagtgtacacgagctgccacggcgctataggaggggcagtgtgaagaacaacgaagttaagttcaagtgcatcttatagatcttaataccttaaactgcaatgacaactcacagaagcatattccaaccatatcaacaacaattatggaccaattaaagctagattgctgatcttttgatgcatataactgaaattcttcatcattgaaacaatgtctacacttagcagcatcttacacttctaaattctaatcacaatggtattcaaactttagtcaaaacttctttagtagcttatttcattctaatacaagaaaatttccaataagctaaacaattcctacacttaattctacccaacaacaatcaaaaatcaccaaccctatccaaataaacagataacttccaacaaaaaacaaaatcctttcttcacaacattaaaccccaaatgaaatattcagtaaaataagcaaaccacataattcaattcaagaaaaaaaaatcaacaaaaaaaacccaataatcaaatcttgcattagaacataaaattacctctttgttaacatctgggtgatatttaagagcaagttttcgataagctcgtttgatttcatcagatgttgcagaaggagaaacacccagaacttcatacggggtttctcttgagcttgctcttacattaccaccgaatttacatctttgccttctatttctgaaactgggtattaaagaatgagaagataaaaccaataaatcaaatgtgtggtttccataacagcatctaagcaaaggaacagaagtttgggatatgaattgggtttgaaagtggggaattaaaggataaaggtatgttctttgtgattgtgattgtgagtgatgatggtttttaacagagaaaatcaagaatgggtgacaatttgttttcaatggtgttgaagggagagtgaaacgcatattcaatcaagtgtgttttgctgttttgggtgaaaaaattgtcaatcattcgaatgaaaatagtggaaagtaatggttggtgttggtttcatggtgagttggtttacttcccgcaagaatggtttttttatggaatggattaaggaagctgcggtggacatatttttgcaaattacaatgacccactttttaaaattttaaagtcgaaaatatttaacgagtcaatcaacacgagtgaaatacaaatgagatacggagtacaattagtatttggcacgtgtaatgcacaggttcactttgtaattgacgttgattttataatagtgtgaagtaatcataggtatacaatgatgaaaaacaatcaagataacaataacaaaa

SEQ ID NO: 319 - DNA, 728 bp, Kochia scoparia
aaaattctctctctatctctcttatcacatggtccctttattctttctctctatctctttcttccctaaattttacctagaagtctgtgaatttgaatgtgtagcgaacattctgaaacggatgaagtacgaaatacaagtattctctaattcattattttttcgatcccatgatacagatgcatcaatacattattaggagtgacaccagacacaaagtctaccgagaaagagtcctacacggcatacaataacggggcacgatcgtgcaagttgccgcgctcggtccgccgagaggtggaggagatgatgaaggaagcgggggaagaaatgagcgggaggctattacacaagattaaagacaaggttgagaagtggtaccatgatgaggggtacatttgtgcccaagttgtgaattttggtgacttggaaacaaatgaattagaagttgtttgtgaagtaatggaaggtgaaattaccaaattggtgttggttaaagagggcaatgaaattgatggcaatgaattacctcttgagttgaaaaagttgttgtgcaacaagcttgaagtggggcttgtttacaacacaaaagcaacaacccaagttataagaaatttcaagtcattggatcaattttcaaccattgaagtttacccactttatgatggggtaaataaaggaggagtgattgttgagatcaagctttgctctaagaccgctacaacttc

SEQ ID NO: 320 - DNA, 257 bp, Kochia scoparia
ggcagcttcttcaaccgcggatttggtggcggtggaggtggaggagacggtggattcttctcctacctcatccccccttacgcatttgccgacgaagagtccgaggcatgggactcccacggcctccccgccaacattgtcgtgcaactcaacaagctcagtggtttcaagaagtacaaggtttccgagttgttgttcttcgatcagcgccgccgctccaccgtcggtaccgaggactcgttcttcgagatggtttc

SEQ ID NO: 321 - DNA, 5473 bp, Kochia scoparia
aatcctgatggttctattaaggttactatctctttccttgagagcacctggcaatctgctgaccgtttcaggttcttctttttattcagtttaaattactggttgcaatctcgcatttcgtttgttgatgatttgtattttgatgatattcaggttttgtttggtttttatgtcaattgaatagaatgtatatgctaattgatgaaggttctttaggcaattctggttttattgttgtagatgattcttgagttttgtgatgttagttcagtactattggaatttagatgctcaattgctcattgatgaaatgctcgtatgaaagccaatgatggaatgtattcatgttttttacagttgtcatgtgatttggggacgtgatttagattttagttattaattcattgacgaatgtgagatgttatcttgctcaatgttgaattgtatttattctccctgataggctgaatctgaccattgtttattcgtttgcgattgcagtactttggaaggtccctttttatttcattatgttttggaactttcaatgtgtatgattgtagatattcatattggcagttcattgatgaaactttttcagaaattttattgaattttgggttttgaggaactacagtagctaatcttttttgggagtgatacatttacgattttggacttttggtattaggtgcatcaatgttgggttgatgccacaaacgaagcagcctgagatggatcctgatatgacggataaagagaagatggagtattttgtaagccaggagaaggactacaggaggaggatggaacgatctcgcccatgcttgttggcagatccaatgtaccgagaggtgttggacctgttgagagagcagggtaaagtgacggcacggtcattgcaaaaaattagagacgcggttcagaaatggtaccatgatgagggatatgcgtgtgctcaagtggttaattttggcaatttgaacacaaaggaggttgtttgtgaggtggtagaaggggatattacccaattggtaattcagttccaggataaacttggcaatgtggttgaaggaaacactcagtatcctgttgtgtggagagaattgcccaagcaggtatgaacattttgagcctttgttgctgttcatttattctttttgaatgtatcttgatcagtcacttaacaaaaaattgaattgtcattagtgatgtgttggtaaaataacctctagatacaagcaggcatcttgagaggagagtatgctaaagcaagaaatttatcttttaacaatttctttttgaacttgagctgtcacttatgtgctgtctaaataggagggaaggagtttgatgattttaatgcctcaaaaaggtatatagtgtccagattttcgaacatattccccgcagaaatgggttggttactgctgaataaaaggatagaaagaagtcaacttataaaagagttataatggaaaatggtggtaaattttttgcatattgaaggatggcgggagatgggacaatatgacattggggtggagcgagtttattttgctgtgggctgtggccttttggtattggaccttgtgttttaggtttctcttgtggagtgttgtgaagaattaccattttagtgtttgaccacacattcgttatggaagaaatatgttactcgttaagtttacaagctatctcagtctctcagaagccattatatgggtgatcatttttgttattgcatattgtttgtgttcaattttttcaaccagacgtgctcatttgttttccttctgtcatttattcgagagtgtgactagtgaaacaaccatagttgttgagtgtattgtctatggtggctgacttttgctaaagcctaatgtagtttgttgtggtgggtattttttgcagcttagagtaggtcatgtctttaacatagaagcaggcaaacaagctctgagaaacataaactctttaggtttgttttcaaacattgaagtgaatccccgtcctgatgaaaagaacgaaggagggattattgttgagattaagctcaaagaacttgatcagaaaacagctgaagtgagtactgaatggagtattgttcctggacgtcaaggccatccaacactggttagtttcatactttcactgttgtttcttacttacatatattatggattatgtattcaggtttactaagacttcaacattgttttatctgctgaaacctgttttgccttaggcttctatccaaccaggtggaactgtctccttcgaacaccgaaacatcaaaggtcttaatagatcttttcttggctcagtgaccactagtaacttcctcaatcctcaggtaatgttacttcatttcaagtcttaatggatttttaaaattttactggaccatatcttgtgattctcgtgtacgacttgatatagatctttgcctttaaaaagggtggatgctccacaactatttatgataaatgtataaaactaccttttggctcttcctctatggtccttgaacttcttctccctgttggttgatgctcagttcagtaatagtgcaaaagatcagttttctaggcctcttgtttgctgttccacttgggtatgttcttcaggttctaactggcacattttcaggatgatcttgctttcaaatttgaatatgtgcatccgtatttggatggtgtatatgatcctagaaatcgtaccttcaaagccagctgcttcaatagcagaaagttgagtccagtgtttactggtggcccagggctggatgaagttccacctatctgggttgatagatctggattgaaagcaaacattactgaggttggtacacctgtacttctaatgttgacttaagcttgtcattagttttgtatcttcactcatctatcttgcaatatctgtggtgcttttgcagaatctaacccggcagagcaagtttacttatgggcttgtttatgaggagataacaacacgagatgaaagcagccatatagccatagcaggtcaaagggtgttgccaagtggtggaattagtgctgatggacccccaacaactttaagtgatactggtattgaccgaatggtatttgctcaggcaaatattacccgagataatacaaagtttgtaaacggagctatagttggtgacagaaatgtgttccaggtaactcttgtgctcttcttattcagtttttcctggtgtactgtacttgtgtctcataatcatgtatttccttgtgacctgatatgctttttactgccacaatttttgtttgagattcccacttccaatatgtaactcaattccctgtggagaactaccagaatgatcaaactggcatttttaaccatcaaaatttggcttctgtctataaattaagtgcatgtcacggactgggcaccagctgtaggtaaatccttttgatttaaccctggattggctagttgtgagcaaattttatcgcaagttctgtttatatattgagtcatatctgataaggcgggtttaagaagtgatgccatttcattaaaatcttagcgacgaatttaaatattaatcataatagaacctcccaaaatgaccaaattggcgtttaaccttcaaattttggcttctgtgtatgaattaagtgcattgttgagtgggcattagttttagaagattcattttgatctaaccctggatctggttgttgtgagcgaattttatcttgtctaatcatatgttgaggcttttttaataaggtggatttgaatgataaacatattgatgtcattttcattgaaggtcatagtatttcagtaataataataataccttctgtaatgaccaaattggtgtttttaaccttcaaattttgtcttctgtctacgaattaagtgcattgcaatgagtagatgtcagttttagaaattctttttgatctaaccctggatctgctagttatgggtgaattttaccgtaaggtccaattatgtgttcaggcttttctaataaggtggaattaaatgagaaacatagtgatgtcattttcatcaaaggtcatcactttggtgattttcgttggtgaagatgaggcttgttcacatagttttctatgatgtcgcaagctcacaaccttgttcaagccttgcactatatctttatcttttttttttttaatataattatggaatttaatctggtgtaggaaatggaggggttaggtagtgctatggctgataagtggtacaagatccacatgactaagcactcttttcttgttccttgctgaaatctaaatgctcacactaagtaataagttaaaatgtaatcatactcgcttgttaaaggggaatatgtctacctggttgtaatacaccagaaaaatatttttgttactcaatttggattacatgaaactttcatatctattgctctggtgtgaatttattttgttcttgtcgtttccaaattactgtgatttgatattttgatgtactcctttaagttcatgccataagggaaattgacactattcacaagttatgagaattttctaaatcctagtcaatacaaaagaagaaacatagttaaaggtcttatcagatttgtcttaatagatctattattaaaagatatacttcctccgtaaccaaaaaagcaacaaaccattttgtaccacatttttatgcaagagaatggtgtaaatgagaaaattaatcaaaaattattttattacaagcaagaatgaaaccataggttactattcttaacattattttgattaatttttttatttacacccttaattctctttcttaaaatgtgtataaagaggttggtttcgtttctttggttacagattaagtataacatataaaattgtagggagtaaattgtactcacacctattactccgtacttcactataactgaagaaagaataagattggtcacgttagggaatcacatatctgtaccttctcacatgaaaaaggaagttatctgtatataatttctgacagaaacatgaatgatcttatgagcattcttatgcattagtagttgccatttctgcttgtaatattttgcattaagtcagctagcagattgaattgaaaactatgacatggtgttcccataaattttacctagctgttaatgttttttttccaatacaattgttattgaaatgaatcaccaatgatctcttcgtatgcgtaaatgatgcatggagaaagaagttgctagagacagtagcaaagaactttaagactcaaaaaaaggagcatgaacgctaggtacagatagaataatagggttgttggattctgttacaacatcattgctgatgttgtactatttattattttctccttgtatattctgatagaaatgaagtgcgggaacactctacaagaccgaataagaaataaagttatccgcatgaaagttggtgttgcagat

SEQ ID NO: 322 - DNA, 1258 bp, Kochia scoparia
  unsure (1)..(1258): unsure at all n locations
  unsure (1)..(1258): unsure at all n locations
aacaatcgcgagacgcagtatgtttcatcactgattnnnnnnnnnnnnngacatttttaggtgtctacatatctactccagcccaattttgtctcttttcatccattgtgaacgacatggtcacagtacgagtaaggtcttgaggactgaggagatagagcattgtcatcagtaagttcacccaaaataccccttttaatcgaattaatcccatgtttggttgtcaatactattgttttaatctaatctttgatcccttttgtttttgcagtgatttgaggaggttgataatgcaatcactgattgcagtgatggtaggttgaagactaagtataactgtgtatgttccggctttccctcttatgaagttctcagagataacatgcattgcgttgctttagcaagtaatacattgtattttgctgacagtatgatcatgatcattcttcttcctccctaccaactggctaaaattatgaaaccctacctacttgtggtatgtttgagcgtgttgattttgaagggaggactaatccttgtggttttattcaagttactatctcttttcttgagagaacttggcaatctgctgaccaattcaggttcctttttccctgtcccaaatttgttcatctacagtttgtttattgctcatgttttgtttgatgatgattcgtgctttgatgaaatttaggttttgttagtttattatgtcgatagaatagaatgtatttgctaattgatgaagcatttttaggcaatttaggtttgttgtagttgatgatatttgagttttgtaaattaggtcagtattctttgaatttagatgctcattgatgaaatggtcctaaaaaactaagaatgctcaatcatggaatgtattcatgacttttgatagttgtcatgttaacccatggtgtagaattattcattgattaagttgttataattgaatgtgagataatacctttgctcaatgttgattctttctgattggtgtgatgcgactatggtttctgtgtttaatattgcagtactctatgtttatttgcttgatattttgttctaattctactatgactctattgcaatggctcatcattccgagtattcatttaggttatggagccatagaattcaaatatgattcgacaaaacccgtagcttctgccaagaatggaacatcacgcttacaatgtccactcccagatacccccaggccaacggattggctgaatccagcaacaagctcatcatc

SEQ ID NO: 323 - DNA, 512 bp, Kochia scoparia
tttttaagatataatttctgtaaaagaaaaaccttataagaaatatttggattagaaagataatctatctttaaatcggattgtaatcctaaaccaaataaataaatttcaattccttgataacatgaagtataccattatatatattgagccttttgcacccaacctttgttttaatcaaccctaaaccattattatcgattgattgtaatactagggagctaagcaacgatgttgaacaacgttgttaacttcttctccgatgtcaagaaaccgaaattcgacaagtacagattatcaagcatgatcttctacgacgaacgcaaccatgtcggcttcgacgccgacgatcccttcatggcatcattgacgtctctgaaattgggtggtttgtacacggtgcatgatatatataaagaagttctgtttttgaaatacaataatggaatgtttgagaaagttgacgtagagtacaagaagacgactaacaaccctgataaaacgattgccgt

SEQ ID NO: 324 - DNA, 1172 bp, Lolium arundinaceum
  unsure (1)..(1172): unsure at all n locations
  unsure (1)..(1172): unsure at all n locations
aatccgcggcagccaaatggcgctcacctcccagagcctcttcttcgccccgtcgcccgccggcccttcgcggcgggcccgggggcgcgccgtcaccatgtgcgccgccgcctcacacaacccgcaaccccgaaacatccccttcgccgtctcatcctccacccccaaatccgaatccaaggactccaaaaacaccctcgccctaggctccgccatcgccgccaccgcctctggcgccttcctcatcgcctcgtcgggcggctttgggggtggccccgggggccccctcggcgggggcggcggaggtggtggggccggcggtggcggcggcggcggcgnnggcttctggtcgcggatcttctcagctggcgcggcgaatgccgacgagaagtcgtcgggtgattgggacccgcatgggctcccggccaacatcacggtgccgctctccaagctgagcgggctgaaaaggtacaagctttcggagctcaatttcttcgaccgtgcagcgcctgccggcggcggtgccacggaggctgggccggaggactccttcttcgagatggtaaccctgcagccaggcggcgtgtacaccaagtcgcagctgctgaaagagctcgagacgctagtctcctgcggcatgttcgagcgggtcgacttagagggaaaggccaagcccgatggcaccctaggcctcacagtctccttcaccgagagcgtgtggagtgctgccaagcagttcaagtgcatcaatgttgggctcatggcgcagtcaggccaggccgacttcgatcaggacatgacagagagggagaagatggactaccttcgaaagcaggaacgagattaccagcagcgtgtccgtggcgctatgccctgcatattgccagaaaccgtcagaggggaggttcttgccatgatgaagaaacaggagaaggtcagtgccaggatgctgcagaagatcagggaccatgtccagaagtggtaccacaacgaggggttcgtatgcgcccaggtggtcaacttcggaaaccttaacaccagtgaggttgtctgtgaggtggtcgagggggacataaccaaagtggagtaccagttccaggataagctcggaaattttgtggaagggaacacacaaattcctatcatagaccgggagctgccccagcaggtat

SEQ ID NO: 325 - DNA, 850 bp, Lolium arundinaceum
gttggcaagccgctaccagctgtgttggttcttcatggtcattatgcaggctgtgtaggagatctgccaagctatgatgcatttacacttggtggaccttactcagttaggggctatggtatgggtgaactgggtgcttctaggaatgttcttgaggtgagtattattacagaacttgaattttctttcggatgcatcatatttgtcacaaattatgtcatgtttttacttttaagagtactaactgccttttcttccgatttattcattagattgaacaagctcaaaatttgacacataaaaatttgtgtaacatatgatagtcattgctatactgataaatgataactatgttttaatccactcaggttgcaagtgaggtgcgcatacctgtgaagaacacatatgtttatggatttgctgaacatggcaccgaccttgggagttccaaggatgtgaaagggaaccctactgagttcttccgacgtgttggccgcggatcttcttatggtgttggtgtcaagcttggcttggtaagaggagagtacattgtagatcacaacactggggttggaaccgttttcttcagatttggcgagagattctgagtgcatttcattcggcctctgaggaaggtgcatttgcactactggggtactgagtcttgaagccgccgtgcacttgttggattcaactggagaagggacttatgttcttctggaataatcaaggtttgttgtatttttctgggcaagggagaagttagtttcaggatgagttctttatttgtaggatatgaggtttgtcttacagagcttcgagctggtgtttaagtagatgaaagctgagt

SEQ ID NO: 326 - DNA, 1074 bp, Lolium arundinaceum
gtattgtgttatttgtttctgtagttttccgttgttttccttttggttaatcatttagttcaaggattcacagggtaagttaagcatgtcattcttgattcagttatctgttcctttcattacactaaatcttggaattgtatttctgtacattgtctacacttccattagcaaaatccttaaacatacttaagcttcaagccttcaactggccactacgttataaaagaactaaacaatggtacaagctatagctgtttagataaagagcaaccgtgtcatgtgtagagactagacacatgcacatggtttctatgtttccagcatcatggacaagctttcgtttcattttggcaacataataacctaacatttgtctatcattccatcctgagatgtttttttttcccagaatactcctgagacgttctatcatttccgattttattcttattaggggaatgcctgattatcgctgttccatatgtatgttcttatccacttttttattggtctttaggatgatctttcattcaagcttgaatatgtccatccttacttggacggcgtggacgaccgtaacaaaaaccgcaccttcaaaactagctgcttcaacaccaggaagttgagtcctgtctttgttgctggccccaatatggaagaagcaccacctgtttgggtcgatcgagttggatttaaagccaacataacagaggtttgcacatgttgatattaccatgtacatcttctatttttcgtgcactattcaagaaatgcctgtaatgtgacgaaaatacgcttcttgatttcagagcttcacacgacagagcaaattcacatatggccttgtggtggaagaggttacaacacgtgatgagactaatagtatctgtacacatggttctcgggcaatgcctagtggtggcttgagcatggatggaccacccacaaccctcagtggtactggtgtagatcgaatggcatttctacaagcaaatataactcgagacaacacagagtttgtaaatggtgcagttattggtgacagatgtattttccaggtatgctgatcag

SEQ ID NO: 327 - DNA, 517 bp, Lolium arundinaceum
tattgtttctgaggcttcagcatttaacttgtgctttggctgctctgttacagcttcgacctggtcatatcttcaacattggagcaggaaaacaagctctgaagaatataaattcacttgctttattctccaatatagaagtgaatccacgccctgatgagacaaaagaaggtggcattgtagtggaaattaagcttaaggaactagaaccaaagtcagctgaagtaagcacagagtggagtattgtacctgggcgtcaaggaagacccactctggtatcgtgtctaataaatttgcaatcttctatttttcatgaatctctatttgaaaactggtaggcatgtgagtaaactacactattgtattcctgttctgcaacctcgtatctgatggcaaatttcttttaggcatccattcaacctggaggaactgtgtcatttgagcaccgcaacatctatggtcttaacagatctattgttggttctgttacatccagcaacttgctcaaccctcaggt

SEQ ID NO: 328 - DNA, 1499 bp, Lolium arundinaceum
taaaattaaattttggttttgcaaaccatcaaagaactacactttcaacgagtagttccataagccacactctttttatggttctagagaaaagtgcgtttttctaatgaaactgtgtattgatgaatgagcagaaatcctacattctacaaaacacagctttcccaaaagatggcatacaaataagaaacaccgttttgtggaaccacataaaattgcagatgatcgattcataggcaagtagaaatacagttaaatttaattaatttactaaaaagattataatctagcttctataaataaattttgcatggtgaatcaagcaaattaatcctctgatgacaagcttcttctgttgtgggctgcagctggacaagggcctaggcattggaagcaagaacctgttcttcaaccaccatcagctaacagtgacaaagttcgtgaatctaaacaagcaaaagaatggtgctggcaagcctccgccagctggcctcatcgcccacggtcgctacgtatgatgtgtaggagatctgcctagctatgaggcgtttgcgcttggagggcctcactctgtcaggggctacggcatgggcgaactcggcgcttctaggaaccttctcaaggttagtagtatggtactaagtgaaactgtttgcaatttttattgaagcgttgtttacaaatatcacttctcgaggtttagaaagtgtcagattcacctgaactgatgcatcatttttgcgccattaacaatctaggttgctactgagctgcgcatcctggtccccatgataaagaactttgcaacaaatgtttggctgttgcaattgtatcaaaatagacttggatacatagtatagaatgatattttctacattgtttaatggaaatggtaaaaatatgactttgctgcatctgtttttgttagggccttcctactttcttgtcctgattgtcccttatgaaatgttgttacaaggactttatgcaattggctaatgtgcatgcatttgattcaggctgtaggggagatcaaagatgacatggcctcgatcttagattcttttcggtatacatggtctcattgaatacaagtgaattgatcatagagggcttgatagaacgaggttaaagagctgaagtttgaacagaaaacagatgaggagtaaaagctatttttaggtaacagagagaagcctttgtaagtcacattacataatttttttttgaacattaataagattcttaatgcaaattgaaatatcatcacactttttgtaactatacactatctctttagtgctagaattagtatcctatgatgaggtggcagcacactttattatttagctttcatttgggtgccacccacggcagcacactttatgatctgcccagcaccggtgaggaggcgcccaaaggggcgccccaaccactagttcatataaatgcatgtgctaatgacgttatgcatgcaagtggggtcatccatgtgcgcc

SEQ ID NO: 329 - DNA, 595 bp, Lolium rigidum
tgtaggtcgccaccgaggtgcgcctcccggtccccatggtgaagaacacacaggtgtacgcttttgccgagcatggcaccgaccttgggagctccaaggatgtcaaagggaatcctacagagttcttccgacgtgccggccatggatcatcgtacggtgtcggcattaagcttggcccactcagggcggagtacgccgtcgatcacaatgctggcacaggagcccttttcttcagatatggcgagaggttctgaactggatgatccgtttcccccatctccagcagttggggacgaggggtaaacagaatttttcaacatgtaatatatttgaccgtgaactgtttgctagataaagtgttcatgcagtatatttgttccatgttggattacacggttttagctgaaggagcccacgtccttcttgttttttttttcgaaatggggaaagctccagcctctgcatcaatcgacacatacggctttttattatattattaaaaaacctacaaatcatggatcactcaaagtctctacaaaaacaagccaaagaaaaatgaacgagaacactaggcgccacaagatcttcatgtgag

SEQ ID NO: 330 - DNA, 268 bp, Lolium rigidum
actgggacccgcacgggctcccggccaacatcacggtgccgctctccaagctgagcgggctgaaaaggtacaagctttcggagctcaagttcttcgaccgcgcggcgcccgccggcggcggcgccacggaggccgggccggaggactccttcttcgagatggtgaccctgcagccgggcggcgtctacaccaagtcgcagctgctgaaggagctcgagacgctggtctcctgcggcatgttcgagcgggtcgacctagaggggaaggc

SEQ ID NO: 331 - DNA, 476 bp, Lolium rigidum
atctcaatctataacttatgccaccctggttaggaggtggtctgcttgttctggcttttagaagcataaaggttttcttgttctgactgtgatgttgagcttgatcatgattctcctatgctcattgcgctgatatgaatgttatccaatacaatgtttgttactgtttctgaggcttcagcatttaacttgtgctccggctgctctgttacagcttcgacctggtcatatcttcaacattggggcaggaaaacaagctctgaagaatataaattcacttgctttattctccaatatagaagtgaatccgcgccctgatgagacaaaagaaggtggcattgtagtggaaattaagcttaaggaactagaaccaaagtcagctgaagtaagcacagagtggagtattgtacctgggcgtcaaggaagacccactctggtatcgtgtctaataaatttgcaatcttctatttttcatg

SEQ ID NO: 332 - DNA, 820 bp, Lolium rigidum
caggacatgacggagagggagaagatggactaccttcgcaagcaggagcgagattaccagcagcgtgtccgtggtgccatgccctgcatattaccagaaaccgtccgaggggaggttcttgccatgatgaagaaacaggagaaggtcagtgccaggatgctgcagaagatcagggaccatgtccagaagtggtaccacaacgaggggtttgtatgcgcccaggtggtcaacttcggaaaccttaacaccagtgaggttgtctgtgaggtggtcgagggggacattaccaaagtggagtaccagttccaggataagctcggaaattttgtcgaagggaacacgcaaattcctatcatagaccgggagctgccccagcaggtatgctgcataccactagcttgttactaaaaccagcatgggggaataattttattagcattactatgatgttctattgtcaattaaaatgtaaaaaagatagtgattaccgtgacattttattttgactaaggaactaaaataaattagcttatagtagtgttctcgaaaatgacaaatgatttttgttatgcgtcgtttttggaaggttagtgtttagtagttgttgcaatatcctgtgaaatcagaatgctgctgggttctgctttcctgttgaaaaccatcttttatcacttatatatgatttttagtagcgtgttggttagctaggagagtagcagcccatgacataccctttcatgacttatgttttggtgattgttcagcatgcaataatctcaatgtataactcctgccacactggttaggaggcggtttgctt

SEQ ID NO: 333 - DNA, 1626 bp, Lolium rigidum
gtgccagggcctgggggacgaccaactcttgtaaagtgcctacacattcacaaccttttgatctttctaacatctgtctcaaaaacgctggacaagttcatgattaagctatgaagctgcccatcattgtaattcagtcctgttgctgaacctgatgtattatatatctgatggggagctttgtttcaggaatccattcaacctggaggaagtgtggcgtttgagcaccgcaacatcggtgggctgaacagatctctcgctggttcggttacatccagcaacttactcaaccctcaggtgagttggtaattggtgattttgtttgatgaatgattatttcagctttgtagtgtgcttcttggttattctagaaacagtcacacgcatgcaaggcattagtttctgctctactacaatctgaaagaactatccaacagcacacgcatgcaaggcattcttgcatttgcatgcaccttgaagctagcatagtactagcatggatcccagatatatccatgtttcaaatgcacttatatatatccatgtttttgttttgttttttaggacgatctttcgttcaagtttgagtatacacatccttacttagacggtgtggaggaccgcagcaggaaccgcatcttcaaaaccagctgcttcaacaccaggaaactcagccctgtcttcgtagctggccccaacatggccgatgctccacctatctggatcgatagagttggaatcaaagctaacataacagaggtttggaagaatcagtacacctcaatttcgaaatgtaaattattccaacatttgccattgaccaataattgcaattacagaacctcacaaagcagagcacgttcacgtatggcctcgtgatggaggagatcacgacgcgtgatgagagcaatgatgtgtgcactcacgggctccggaggacggccaccggcgacctgggcatggacggcccacccacgacattcagcggcaccggcgtcgaccggatggcattcctgcaggccaatctgacccgggataacacagagttcgtcaacggcacgaccattggcgacaggtgcatcttccaggtattgtcctgagagcaatccatccatcttttggaagttcactattcttaagactgcattttgtttatgcaaaccatcaaagaaaatataacctagcttctataaataagttatccatggtgattcaagcaaattaatcctcttgacgacaattgtgggctgcagctggaccagggcctgggcattggaagcaagaacccgttcttcaaccgccatcagctaacagtgacaaagttcgtgaatctaaacaagcaaaagaatggtgccggcaagccaccgccggccgttcttgtcgcccacggccgctacgcaggatgtgtaggagatctgccaagctatgacgccttcgcacttggagggcctcactctgtcaggggctacggcatgggcgaactcggcgcttctaggaaccttctcgaggttagtaatatgaatctctttgcaaatatcactttcaaccgtagcacgcatagcaatggtaaagaatgaaatggacgaataaagttaaagtgtcaggttcacctgaactgacgcatcg

SEQ ID NO: 334 - DNA, 1353 bp, Portulaca oleracea
tgcagctggatcaaggccttggtattggcagtaactttccaatcttcaaccgtcatcagcttacagtgaccaagttcctacagttgaagcaagttgaggaaggtgctgggaaggcacctccacctgttcttgtccttcatggacactatggtggctgcgtgggagaccttccaagttatgatgctttcactcttggaggaccttattctgtgagaggttacaacatgggggagcttggtgcagctagaaatattcttgaggcaagaggtttctctgcacttgtggcattataggcataggatgaaaaacatatcagggttgtctatggagataaaaatagtgactttgcatttgattttaatctgactcatttttttgtggttgtcctccccttgcccacaccacaggttgctgctgaactaaggatacctgtaaagaatacacatgtatatgtgtttgcagaacatgggaatgaccttggaagttccaaggatgtcaagggcaatccaactgaagtttacaggagaatgggtcacggctcctcttatggtgctggtgtcaagctaggtcttgttcgtgctgagtatgctgttgaccacaactctggaactggtgctatattcttcagatttggagagagattctgattctgagctccattttcaagcttggtttgggtgcttcatctaggactctcatcccatcccaggtgttaatgcatgggttaagcaaagcaactactgccatcacaaagcaccaaactgttggcagatgtgagttaccctgaaaattggaaagccatagcagcgcaggcaatctcagcacctaataatttaccaatggggaggtggggacgggagactggagaggcgccttgggggcggcttcggacgaggatttgtagcttagtaattactttcctatagggatgcttgccttgcatagtttgttttaaaaaaaaatattatttgacatccgattctaagacacaggagttttgtagaattaagcgtttgcatttaagcggctattgtttgtaggatcaacggccttttttattttcctcgagtgggtagtcattgataactcaagttttgggtactccaataatattaaattatagacgccatattggacttgtgaagtacaggcctacagggtggaacatggggaccaacctttttttcctgattgaaagtcattaaaagggtaatatttgtgtcaaaaataccaacaaaaactgtagtcaaaacacatcccaaacaccacaaaaagcttcacaaaagcctacttttatcctataggttgattggcctataaattttttccaccctaatcttgtcctattttaca

SEQ ID NO: 335 - DNA, 4897 bp, Portulaca oleracea
ttgaatgagcttttacacatttggtggactggggattggggtggttgtgagaagtgtggaatcaaaagcctaatttagttttgaagtttgagaacaagagtcggaactgaaagtttgtagttgattgtctggattttgttgaattaatgttcttccctccctgttttgatttctattagcaaaaattttcttttttgattcatttttgggtagattaggaacttggccacttgggtcattgttagaaatgtgaaatggaaaacctaattgtttcaagggatttggaacaattgttgaagatagcttttgacattagttttatagtatttgttaaatgaatatgttattcacgtaatcctgtttgaacgattgtaagaaccacaacagattgaagccgctgctctgtcttcttggttctgcttcaaaatagctgcgcggatttcttcacggtatgtgatgtctatttttttctttgtttttgttttatatttaaggtatggtcaactgatcaactgaatcttttccagactgggtcggagcaattcgccatggaattgggggatttgcagctgaatttctagggtttgcgaaagggtggggctggggaaatcgaattgaatttgattgaattgaattgagatgagatttgattggtagtttaaattgaagagtaaaaacaaaggagagttgaagaatggatggaaagggaagattcgtgtggaagagagagaatgattcgatttggatgcataaagttaaattatagaagattgaattatggaggaagaggatgaagagaaagagggatgaatgacagatgaacttaaattagagaaaaaaataagggcattttcatccttcttaacatatctcaccggatttcagtcaaaataaccggaatgtcacccatgagtcatttagttaaatataatatcatctgggaatgcattaataaaaattgtgacccgcgagttagtttaaaaatatgtgtggcaccccagcaattttttgctttaattggggtgatatttttgtaacttttacaaaatttagtggtatttttacggcagaagtgagaaacaatcaaagccagtatacaataaattgcaagtagacgctcgctctgtccctccgattctaaatctgtgtattaaaccctgttttgcctcctcttcagtgttcgccccgctccccttatcccctcgttcatctgtgtcaacaatgtcgttcaccgctccaggccaccttctctcctccaccacattcactccttccgtctcctccggtcgctccattaaaccccaacctccatcctcaactatccactcttcactttctcctcagactcccaattcctcctcctcctcttcccaaaaacccaaatccctcttcgcccacccactttccaaacccgctgccaccctcgcctcctcatccgccctcttcctctgcctctactctggcggtggcggtcactacttaaacggcggcggcggcggtggcggcggcggtggaggtggtggcggccattggtggtctaattttctctctcctcttgctttcgccaaggatgatgaatctggggattctgagggctgggactcccatggcttacccgctaatattgttgttcagcttaacaaactcagtggcttcaagaagtataaggtttccgacatacttttcttcgatcagcgtcgccgctctaccgtcggcaccgaagattccttctttgagatggtctccttgaggcctggtggggtttataccaaggctcagcttcagaaagagctcgaaaccctagctacttgcggaatgttcgagaaggtcgatttggaaggcaagaccaaccctgatggtaccattgccgtcactatctccttcactgagagtacttggcaatctgctgacagattcaggtatatttattattttcaattattctcaattttcatgacctttgctcaattccattactgattgtgtatagttttaagttctatgggactgaaaatgaaaaggtgcccattgatttagtgggccattgctagtgtattaacatgtcatttgatactcctattttttatttgaattcttgggatgacaatgaataactggagcttagtgatagtaatggcttttctcattgattcaggtgcatcaatgtgggattgatgccccaaacaaagcctatcgagatggaccctgatatgacagacaaggagaagctagagtatttcagaagccaggagaaggattacaggaggaggattgacagggctaggccatgcctgctgccaacccccttgcatcgtgaggtattgcagatgttgagagagcaagggaaggtgagtgccaggttgctccagaggattagggaccgggttcagaaatggtaccacgatgaagggtatgcctgtgcccaggtggtgaattttggcaacttgaataccaaggaggtggtctgtgaggtggtcgaaggggatattactcagttggtcattcagttccaagacaagcttgggaatgtagttgaaggaaacactcagcttgccgttgtccgccgagagttgcccaagcaggtaattaagatttttcaactatttgatgtggtccatgatcgcaattacaatcgttatgagtgctcagtatggtgtttgtgtaaaacctgagatacatgaaatatgctgggaatttgaggtctgagttccattatgaatttctagaccatgaacgtaatagagcctaccaatttggttattttttttgcatttttggtgttctactggttggcttgaatatttgcaagactatcaaaagggttatttggtcttgtattcttttttcaatcataaatgacggtgtgcacttcattcctcagcttcgagtgggccatgtcttcaacattgaagcaggaaagcaagctttgagaaatataaactctcttggtttattttcaaacattgaagtgaatccccgccctgatgagaaaaatgaaggaggaatcattgttgaaattaagctgaaagaacttgatcagaaatctgcagaagtgagtactgagtggagcattgttcctgggcgtcagggtcgtccaacactggtaatgtctgattgctaatatgtttgcctccaatgttcttttattgatttcctttagttgtctctgcctgcttctttcacttatttgtttattttgtgaatcttttttcttttttttttatatatatttttcaggcttccattcagccaggtggaactgtctcctttgagcaccggaacttacaagggctaaatagatctcttcttggctcagtgaccactagtaacttcttcaatccccaagtaagttcaataatgcaagatgtgtttattttatttaaacctttttttaagccatgccaactttatcaataatggattatctaggatagagggactgacattttcaattccggaaattagagggtcttatatttggggaatttcataccttggttttttgctaactccagtaggtgttgtttaggagacctttaacttggtccttttacgagtagcaacttcatcatatacagtcatccgaatctcctttcctttttgtgtttttttttttccttttattgcatctgctgtgcatccctaggtcttggataagtggaacaatgtgcttgggttgcatgtaagtgtaacttttcagttaccttatatttaacatttcggctccattacacacaatcactaataaatttcttttttccttaggctttactttgtaccaaactaacaatgactatgaatttatgactatgcattgctactatatgtactcagtacctcatactattcttgagggtttggcatttgtcattcacgttgatgtttcatatactctcctttatgttatgttttctaagaagcatactgaacagattctaattggcttctttcaggatgatctcgcatttaaatttgagtacgtgcatccatattttgatggtgtttataatcctcggaaccgaactctcaaagcaagctgcttcaacagcaggaagctgagccctgtgttcacaggtggtccaggagttgacgaagttcctcccatatgggttgataggtcaggagtcaaggcaaatattactgaggtatatgctggcgtgcattctaacttgctttagacagctcacttcaatcccttattcatctgtaacatctttgtgcgttttggttaaatattttcttgcagaatttcacccgacaaagcaaatttacgtatggactggtgatggaagaaataacaactcgagatgaaagcagccacatagctgcacaaggtcaaagggtgttgccaaatggaggaattagtgccgatggaccaccaacaactttaagtggtactggtgtagacagaatggtttttgcacaagcaaatgttacacgtgataacacaaagtttgtgaatggagctatagttggtgagagaaatgtcttccaggtcagtcttctggttattttgatctctttcttctctctccctgttagtcttctgttgcttctttctgttattgctggtggtttgtttgtcaatgtctacttcagtatagttctgtcagtgtctacttcattacagtttatcgtaagaattgagttgactagatcatctttatgtttgcttaagaaaaggaagaacccaagtaactggtttccttgctgagattgtagcattggtgtcttcatatcttgtttggtaaccactgtagacattgcttctctttcattcttccttggtgctccttatacaatactctagtgtggaatgtgacacctggagcatgtgctccgagtaagtatgaatgaacaattatgttattatgaatgaacaacgggtaggtatagg

SEQ ID NO: 336 - DNA, 5917 bp, Portulaca oleracea
  unsure (1)..(5917): unsure at all n locations
  unsure (1)..(5917): unsure at all n locations
aattcactagaaaagcactaagaccacaagaacttgaacttacttacccaattccttcctttgaagtttgagttctttacacttcccttgttaaacactagaaccttgaattccacttctgaaaatggcataaaaacctcaaataattaaagtatacccatgattctcatgaagaaatcaagaggacagaagaggaaatactttactctttataaagaggaaggaatgagagaagatgatgatggaggtgtggcatggttgccggaaaatggccggaaaatactccggcggtggctggggggtggcggcagtagctgggcagaggtggttgtggtctggtgtgggaatggttgtggaagaggaagagttgagggagtttgagtggtgtgatatgtgattaaaatgaaagctacacccaaaaacatgtatatatataactattataatacttaaggcccaaaaaggaaaacccttccccctctcttttctgtgacaaccggcccatatgacttaaagtggggaattttttatcaattttaatcttcccctcttatacttaaatctccataattttccaaattgccgaaattttttaaaccgtaaaaaatattatcgaaaaccccaaataaatatattcatatccctccataaaagttcctcatattgataaccttaacttaattcgaataaagaagtactcggtacatcggtcccggtaaaagaattcatgtacgattagaatcaccgtaaaaattaccggtagcgttttctcaagaaaagcaaattaaactaatttgttgatgatcgttgcactgttcaagtcttgcaaaatacacccttggttaggaaaataaaattttggaacacgcgctttaattaaacgtgatttattactaaccttgattgattaaactaatttgtatgtattaagggagggattttcttcgtgttgttacaatatgcttgatgggttcctcgtgctcaagtgcagtgtttttggcttacttttgcttaggtcaagctttagtctgtcagtactagctactcacatactcatgcttaatacttagtgaattatgcgcggtcctcctcctattttgtgtcgtccttggcttggtgagggtcgtagcttatataaggaaaggttccacaattatttccttcaattctttttggtgttggtttgttcgagaatcaaacggccctaaaaggggtctactctcccaacatagatccttttcatgcacatgcaaggtgcttaagggatatgagcgtcgcacctctcataccgatctatgcaggtgaaccaacattttcagttttacttgttctcacatttgttttgtgttagtattttttgggattagaacggctcataaatgggatttaccctcctaacacaggctactccgtacacaacaaagtgtttaaagggtaagagtgtcgcaccactcataccaacccgtgnnngtgtaccaacatttttcctttttccattttttcagttttttttttccttaactagtgcatagatatataagaagctaaaacttcacattaacaggccagaagtgagaagtgagaactctaaggaaaccacatggttgcaaatacaggtgaggttattatgtttaggtaaagcaacaaccaagcttgaagcctatcaagcactcactaaccatgcttaactaagcaattgcactattcaagctatcatcaacacaaccatgtatagaaactacctctggatgaaaacaaattttaaaatttgccttttctcagtggtaactcaaaattctttctcttccaaatttttcaggaacatgtgccaccccactcccacacaaaaactgtacaatgtcctcattagaaataataaaagaaaaataaaaagcacacaaaagagaaaatacacaaaagaaaagaaaaatcacacaagctggcataacccccactcccacacaaaaaaaaagccaacaatgtcctcattggaaatagaagaaagcacacacccaaaagaaaagaaaaagaaacacactgaaagaaaacaaagaagcaaagaaagcaatctcactaactgtattaaaaagagaggggaacgatattacctggtcgagtactgagtatacccaaactatgaaatcttggtagaataataagaaccacccatggtgcatcaatcactccatctcacctctagatgtcgggcaccgtctcagaactattcaatgcccgcagaagtaggtcatgcatcctcgaatacatctcaaaagggtgaacgtaagagcacaatctcaaaagtatatcagcaaatatgagtgctctcaacagtttatcaaatgacttggaataattaataaagtcattaaaattgattttgctaggcaaatcctctaggtaagtgctatagggatcagtgaggaatttataccctcctaaaagacctagggacttcatagactcaggctcatgagaaataagagtaggaaaacaaatcacatgaaagggaggcggggaaacaatttcaatttcattataacacaaggtagaatcctcacactcgacctccacgcgattttcatcaaatacatactccaattcacaactttcatccagttcatcatattcatcagtgggtaatattcaaatggagaacaaaaatcaagatacaatgaaacccaaaacaactggaagaaaaaggtaaggaaaggaaggtctcgagatatacccggatcactggttggcttgcatgccacgcgacccgccgccagtccaagatcacgggccgatcccaagtccacactggataaccaatacccggactgggcatgccacgcggcatgcttgtctcgggtagggttgttttgcccattttattgccagaagattttgttatcttacattgattttgtgcacatattgattttgtgcatataatgatagcgggttgagaacccagacaggtagtatgcaaatgaacattatgcatatgcataccaaaaatgatgtgatgatgctttgtaggttacttagttaggcattgactcattttttgaccactatgcatatgaaccctatgcatatgcacaccaaaaatgaacactatgcatatgaacagtactatgcactaactcattttttgaagcttgcagttggagtgcaggttttggtagacatttgaaagcaacaacgttcatctttcattgataaccatttagcaggtttatgtttctaaccaatattgaaatcaacaaagcaagcattcataaccataaatacaataaaagtcaccattttcattcatcaagttgattccaatttacatatttaccatgatcagtaggcaccttacatacaaaaacaggtggttgccaattccactggactacatcaattccatccatacatacaaaagtcacccatattcaccaagatcaaacaagtgatcttcaaaaaatgcatctttcatacttgatgtcattgtcagcatttcctagcccaattatcagcaaaaaatgatcacaacattaacccatctagatcaacatattaaacccaactgattagcataactaaaagtaaaaaattaaaattaaaattaaaattaaaccaacgaattgcccccaagaacacagctaccatccgccgctacacaaacatcaccccaacaaacaccgctaccccaaccaacagaatcagccccagcatcgtcactttcatcttcatcttcttgttcactccttcaaattcttaacctccaccttcttcacttctccttaaagcatgttctcaaaagcgtccttctccagtagctcgtccatcaccaatgtcttcaaatttgggcaaaccaaggatccgcccacttccatgaaccacatctaccttctccctcacgcatttgtagaaacgaagaagaatattttttagggtctttgcagaacttgatctccttcggccaacagtaacaactaactcaactttggaccggttcatggaagttgttactgtagcttcgagatccggatcctgggtaagccatgattatttcgaacaaaaggatgaagaagatgaacaggaaagatgaagaacaaaccgctacaaaagaagaaaaaacaggagaagaagaagaaaaagcgagaacaagaagaaaagtagaaggagaagaagaaaaaacgggagaagaagaagatgaaggagacaatgaagatgaacaaggtgaagaagatgaagaaaagtgcagaagacgaagaagatgaagaaaaatgcagaagacgaagaagatgaagtggcgggtgacggaggaagatggtggtaggcgtttttggtggggagaacaagaaaagtgggaggaagatgagtgggttaaggaaacttgagtgacacttttagggtttttataaatccacgcttcaacatcacctcaacattcccattttattctctctcattatcaatcttgtgagtctccctccatattcacattgtatagttactccccttttaaacactcttcttctattgcccatgaattataactccaactccgacccactccccttgcttcaatatgtcattatgcttgatcatgtcatatgcttgattagacgatgaaatcaacccaaatccttcttcgcccacccactttccaaacctgctgctgccctcctctgcctccactctggcggtggcggtggcggtcatttcttcaatggcgataacggccactggtggtctaactttctctctcctcttgccttctccaagaacgatgaatctgtggagtctgagggccgggactcccatgatttacccgctaatattgttgttcatcttaacaaactcagtggcttcaagaagtacaaggtttccgacatacttttcttcgatcagcgtcaccactctactgagcgaatgacattttcaatttcttttccatcaaatcaaatttacccgaatcagtgcgtcaaatatgaaggtgtgtttttcttactttctgccaacccggtctctaatgttacttcatcttttaatctccaattttttgtcttactatttatttcgtaacagtgtagagcagcaaagctaagcatcttttggagtagaatttgcaacccttccatcaaattagcaataatctgtcataattaagggtgagtattttttggagaaaatttagcatgcatggtgtgtgattcagtgttcttcctccacatccgaggctcgtaaattttgatgaaatctcagctatcccaattttctataatggagaggatcctaccatagctattggccttgtgttcttggatgatttgtggttttctctctgcggatcgtaatgagttattcaactgctagaacattgtcgtcgttggcattatggcggtaaatagggcgctgttttcttttttgtggggtattttttaattaattaatatatttatattacaattaatctataataataaaaataaaattgatgactgtacattctatatagttttggtggctgaaattatgtgagaatagcctttttgaaaatataaataaatacataataatttttaaaagttaggcaaaaaaaaatttaataaaaatactatatgtcaaacactctaatttagtaaagtttctatctcataagtttttttttttttttaaactcgggtaaacaagaaccaacaaaaacttaggggacccttctatcaaggcatctccccaagttatcagcatgaatagtaaaagaaaatcccgccgcggggctacatatccaaagaccggaagagtgtaacgaatgacccaggttagtcgtccaatctgtcgctgaatttgtttctcgatatatgtgacgaatagtagaatcttccaactacctgattaagtgttgatatctctgataatcatatcaatatgtcaaggt

SEQ ID NO: 337 - DNA, 4499 bp, Senna obtusifolia
accggttaaaccgatcgaacacttgtccgagtctctgcccggttcgattcttacaacattgatccaaatattaaaattacttaacaaaactcaggggtaaagaaggaaatacgaggaagctaactggtgcccatcgcaaatgttacgaaccaaattgaaaataagaatttttgtcatataatagctcgctgcaatttgcttaatttgttaatgttgtgtgagttgatttggatgaaatttttgtaccaagatgcagataatcttggagttctcttctgtgtggtaagattaacatggtaaactccaaatttcactgtatatccatcattccactcaaagttgtccatcaacgaccatacaaaataacctcttacatctgccccattccttattgtttggagtactgcgttcaaatgagcatccatgtaatctattctcttgaaatcatagtaatttaattcgttagtggtattttgtccaaccccgtcaccaaatccgttttcagtaatatacattggagtgttattgtatctgtctctcaaatagttgataacattaatcatccctaggggatacacatttagccagacaagtgaagtagtttctccaagtgggactccatctttatcatctctcaaatcgaatgtaccatgtgatctaaagacccattgtcctggagcacaataggaggaaatgcagtctttcacataataacttgcataatggtttatgccaatgaaatccaaacttctcttcagtttcactttctcattgctagaaaatttgggcaacatatttcctacatgttcctccatcactctagggtatcttccaaatatgagtggctccaaaaaccaatccatattccatgctagtgctcttttggatgccaaaatgtcttctttggaattgctcacaggttcaaaccatgcagcattcaggaccataccaattttaccaccatgctccccctgatatttggttctataaatatcaactgcagcagcatgtgagagtataatattatgtgctgccaaatagagttctgattcattatctactactttcttgcaattctgaaagggtccaaaacaatgacatggtggccttgaacctgtgtagtaactatcagggacttgtacattgggttcattgaaggtaacccaatattttactctatcaccaaagtgtttgaaacatgtttctgcataatgtgcaaaatctatctgaaactcaggactaagtaaacttccatatctgtcctcaagttcttgagggatgtcataatggcacagtgttataaatggttcgatcccttttagtaggagagcatcaattaggttgttatagtagttgattccacccatgttcacttttccaaatctcccttttggtagaacccttgcccatgaaattgagaatcggtagctgttgacattaagagcttccattaaatctacatcctccaaataacgatgatattgatcaacagcaatatccccattacttccatcagtaattccatcagatgtgtgagtaaaaacgtcccaattgcttaatcctttgccatcagctaagggagcaccttcgaactggtaagaagaagaagccgtcccaaagagaaagttttgattttcaaattgggaaagcttattagaattagaagagaaagggatactgtgagatggcgaaggaagaagaaacaaacagatcagaagctgaaggaatacagatttccccatcacaaccacttatctcctgcgacacctccaacaccaccatgtcctcctccttctctgcttccaagcacttgagtgctacgctctctacccctctccctcctcgccggcacaattctcatcgaccttcttccctcaaatgccacctctcttcttcttcacaggactccgattcctccaatcaaacccttctcaaaaccctctctaagaccattgctctctcatccgccgccgccctcctccttcacaccacccctctccctaccctcctttccaatggatctggagatttcggcagcggtggtagtggcctcggaggcggcggtggcggtggaggcggaggaaactggttcggtggcggcgggggagatgggagtggagggttctggtccagacttttctctccggcttctgctattgctgacgaatcaccttctcaggagtgggattctcatggtctgcccgccaacattgtggttcagctcaacaagcttagtgggtttaagaagtataaaatttcagaaattctatttttcgatcggaggaggtggaagacagtgggcacagaagattccttcttcgaaatggtttctctgcggcctggtggtgtatacaccaaagcccagctgcagaaagagcttgagactctagccacttgtgggatgttcgagaaggttgatttggaagggaaaaccaatgccgatggaacaattggaatcacgatatctttcactgaaagtacgtggcagtcagccgataggttccgctgcatcaatgtgggtttgatgccccagtcaaagcccattgaaatggacacagatatgaccgataaggagaagctggagtacttcaggagccaagaggaggattacaagaggagaattcagaaggcaaggccgtgtctattgccaatgcctgtgcatatggagattatgcagatgctgaaggagcaagggaaggttagtgccaggttgttgcagaagataagggaccgagttcagaagtggtatcaggatgaaggctatgcatgcgcacaggtcgttaatttcgggaatctgaacaccaaggaggttgtctgtgaggttgtggaaggggatatcactcagctggtcatccaattccaggataagcttggtaattttgttgaaggtaacactgatgtcgcggtggtgcagagagaattgccgaaacagcttcgcccaggttacacttttaacattgaagcgggtaagcaagctttaagaaacatcaactcccttgctttgttttcaaacattgaggtgaatccacggcctgatgagaagaatgagggaggcataattgttgaaattaagcttaaagaattggagcagaagacagctgaagtcagtactgagtggagtattgtacctggacgaggaggacgtcccacattggcttcactgcagcctggaggaactgtgacttttgaacatcggaatttgcaaggattgaatagatcacttattggttcagtgacaactagcaactttttcaatcctcaggatgatctagcctttaagcttgagtatgcacatccgtatttggatggtgtgtataatccaaacaaccgcactcttcgtgtaagctgcttcaacagccgaaagctgagtccagttttcactgggggaccaggggtggatgaagtccccccaatatgggttgatcgtgctggcgttaaagccaatatcacagagaatttcacacgtcagagtaaattcacttatggacttgtaatggaagagataacaacacgtgatgaaagtagtcatatctgtgcaaatggtcagcgagtactgcctagtggaggaattagtgcagatggacctccaacaaccctcagtggcactggcattgatcggatggcatttttacaagcaaatattacaagagataacacaaagtttgtgaatggagctattgtgggagacaggaatgttttccaggtagatcaaggcattggcgttggcagcaatttcccattctttaaccgtcaccagttaactgtgacgcgatttatccagttgatgtcagtggaggaaggtgctagtaaaccaccacccccagtccttgtcctccatggccactatggtggctgtgtaggtgatcttccaagttatgacgcctttactcttggtggtccttattccgtgaggggttacaacatgggcgagcttggtgcagccagaaacatccttgagcttgcggctgagttacgggtacctgtgaaaggcacgcatgtgtatgcgtttgcagaacacggtaatgatctaggaagttcgaaggacgtgaaagggaatcctacggaagtgtataggcgaatgggtcacggttcgtcctatggtgttggtctcaagcttggtttagttagagcagaatatgccattgatcataattcaggaactggtgcattattcttccgttttggagaaagattttgagcacatttagtgaaacaaaatactatgctgagctgagttagtagagtagcttttcttcccttagcttgcggaacaacttttgcaaaccacccttcgatgaatgggcaagggcatgtgtggaatgcgaaatgcttaaattaacaatgagattttgagatcatcgtgcttgtagtaatgaactcttttctttcaattttttgtggtatagaattctgtattatgtcagattatcatgctggctactattatttaaatgtatttaatgtttcagcggctaaataattaatttccaatccgtgag

SEQ ID NO: 338 - DNA, 7428 bp, Sorghum halepense
ggatttggccgaattgtgggatgcaggctaggcttgctttgaggacagcactagcctgcatatgggcttgtgcagataaccagatagggatgaattgtactacggggacctggacaagggcttgtgcaggcaaccaatcagaacctaggcactttatacttgtaagaggcatgtgtttaacagcgagcgagttaagcatggcatttctaagcttatattactctgtctatttcattagactaccaggtggaaaatgtgcatttttaagtgctgacaagttcatgtctaaaattactgaacaagtagagcaatgactctgcattagcctccggaagggattatatttacctaggacttatcaatcttaaacttgattattgactgttctattgaaatatatttattaaatagtaacatcattaagaaataatggtttgtttcatggttggtgattattctatttgtatttgataggctaacatctgtctaacagtatttatttaggtctttatactttttttttgtcagcaacaacacttatattttttgacctcgtgcacttattcatgtgtattctgggggatctttaggatgatctttcattcaagcttgagtatgttcatccttatttggatggtgtggatgatcgtagtaaaaaccgcacattcaaaactagctgcttcaacacgaggaaattgagtcctgtctttgttgctggtcccaacatggatgaggctccacctgtttggatcgatagagttggatttaaagccaacataacagaggtttgctcgagttcttccacattttttttctattttatgagcaagtactgttccagaaatatttgtaacatgatgaaaaactgtttggattctcagagcttcacacggcaaagcaaattcacatatggtcttgtggttgaagagattacaacacgtgatgaaactaattctatctgcacccatggttcccgagcaatgcctagcggcggtttgagcatggatggacctcccacaaccctcagtggtactggagttgaccgaatggcattccttcaggctaatataacccgtgacaatactgagtttgtgaatggtgcaattgttggagacagatacatttttcaggtaagctatctgtacaattatggtttcaaggacatacagtaaagttaccctttgatgctcaagcatttgccttgtgactgtaagactctttgaagtgctacacttccaaggcttgccacagtgcactaaactttcattgactgattgcaattcaatgttttttttcagttacttttttcttgcccagtgctcttattgtttacgaacctttatgttgaactttgcacttgttcttttatcgttccatgttgttatttagtctttgccatggtaaaatacataaactggagaattttcttgattgcagttagaccaaggtctcggcatcggaagcaaaaacccattcttcaaccgtcatcaacttactctgaccaagttcatcaatttaaataagcaagagaaaggtgctggcaagccactaccagctgttttagttcttcatggtcattatgctggctgtgtgggtgatttgccaagctatgatgcgttcgcacttggagggccttactctgttaggggctttagtaacggtgaactgggcgcttctaggaatattcttgaggtatgcgttactcactctagattttcatttgatgcatcattgtattaatagtttgatgcacctttttcatccccagtattattgttggcattgattattctggtttccttcattaaaagaatacctgtaattggcaccgtgacatcacaaaatgtgttgttgtttggtaactaatgtttgtctgttaatctgtgcaggttgctactgagttgcgcatccctgtaagaaacacacacgtttatgcatttgctgaacatgggactgaccttgggagttccaaggatgtgaaaggaaaccctacagagtttttcaggcgtgttggtcatggatcttcatatggtgttggtgtcaagcttgggttggtaaggggagagtacattgtagatcacaatgctggtaccggaaccattttcttcagatttggtgagagattttgagtacgcttcattccgccactgtggaacacagacttttgaggcactctgtttagcgatgcttgtggactgtgataggactcaaacggcattggagctctgctgaaataatgaagctattttctgaggaagagtgatagctagtgtgagattagcttttctttatgtaggatgtaagatctgttctttcagagcttggagctcataaatagatgaatgttcagaaatattggcccaatttttaccgtcaattgtgttgtttgtgcttctgtcaaattgttgaattcgttttgcccttcaccatctgtcagttgcttatctacagttttgttccattgtcatttttcagattgtgactaaagtataatagctttctgttgatgatgatgccctcattgggtggctagtgccgatactagcttcaaattcagaaatacgtacaagatttagtggcatcgttttaaatacgattctttggtatagcatgatagtaattattagttaatttgaaaaattaagttttgtttgctgatttttttttgaaaggatgtattttgttgatccggttggctattacagtataatgcttaatgcttcggggaaaatcttatgataaagcgaaaaaagtacataagtgataatactatactgtatacgtatggttgtcccttgtttaacaagcttactactctcggtaccatttgcaagaggtgcattcgttcggcttgaagtttcacattcaagcttcatagacatggattaacgtgagatgaggtagaggcgtagagctaatgtgcgcacgcacaaccaccagctcatggatgaagcagctgacgaacgcttcccggcaaggccgccacggccgcgttctccacctcttcttcgctcacctccgacgcggcgatcgcggcttggtggacctgcaccccgcggccgtccccacggcgctccgcgcctgcgcgcgcctcggaaacgcttcctccggccgcctaatccacgcgctcgtcatcacccggttcccgttcctcgccgccgacgccgtcgccgccaccgcgcttctcgacatgtacgccaaatgcggcctggtcgcgagtgcccagagggtgttcgacgaaatgccgcgaaaggatgacctcgtcgcctggaacgcgctggtcgcatgctacgcgcgccacgccctcccggaccgggccctggcgctagccatcaagatgcggggccaatgcctgcgacccgacctgatgacatggaacgccgtcatctctggtttcgcgctagctggcgacgaccagatggccggggaattggtcggcgccatggaggaggacgggttccagccggacgtggtcacttggacatcgcttgtatccggctcggtgctgaacttccagtatgccagggcgcgcgtgctgttccggagaatggtgaccgctggcaaccccgtcctgccgtgctcggccacgattgccagcatcctgcctgccttcgccaatgtcgctgacgtgaagcgtggcaaggaagtccacacctacgccgtggtgaccggcgtcgaacaggagcttactgtgggcagcgctctactagatatgtacacgaagagcgggttcctgctggaagcacgccggctgttcgacaggatggcggaaagaagcacggtgacttggaattccatgatcttcgggctggcgaattcaggccactgccaagaagccatcggtctcttcaaccggatgctgtgcgacggagcaaggccggatcacctgacgttcacagccgttctgacggcttgcagctacgccggcatggtggagctcgggaagagcctgtaccgcgacatgcaggaagagcacggcatcgagccgaggctggagcactgcgcatgcatggtgcatttgcttggccgagccggctggctcgccgaggcttatgatttcatcaaagccatgcccctggagcctgactgcttcgtctggggggcgttgctgggggcatgccggagccatggcgacatcaagcttgccgagctggctgcgtcccacctgctaaccgtcgagccggccaatgcagctagttgcctgctactctcggactcgctggcaggtgcaggcagacaagatgatgttacgaagatgaagaggctggcaaagagacggcgcatgaagaagctggatggctgcagctggctgagtgagtctacataatcgagagctctgagatcatcagaagtacatgattgattgattgatcacagattcatggttgcctagatttgtagaagcaaacatcccagagttcaggttacctcgtccaattagccgctttcctacaaatgcatgtattggtctgtttgatgctaccatggaaatagaaatgctgtgctactgagatttggtagatgaaatgtttagtattcacaccgtttactcaacgtctgacacaacacatctgtaactattaaagcatcataataacataattgggagtcactagtactatacaagcataaacaacaacatagtatttacttatttgagactggatactaggtccctagatcctaataacattacataatactcgaagcaacttatataattacaaggcagcagcacggtctgcttcctttctccattcctcacgcacggtctcaccacccagaaagatcagtgacggggggaatttgatctaccatctggtgctggacccaaaagcaaaaccatacctaccccagtttcatcccctggatctgatctatcaacagggggtgtcctcctagcagaagcttggcgcattggctcaaagaatctaccagccacatcaggaggttgttcgaaagattcctccccaggcagaacaaggaggccttcattgcggagcatggagggttcatggtagcatgtgatccacagtgagtcaacaagctgcctctcttctcgtgcagcatccaaatcttcaggagtcatcgtccttatgctttccatacgtccacagagaagccgccgtaacctgtcatgttctgctagtagactcctatttccaagtgttgtgtcccttgctagctcaagcaagccccctaatgctgcctctcgaacaccagagtcatcgctggatgccaaacgcatcataaggtgggggaaacctaactgtgcaaatactgaacaatctgaatggctttcgctgagcagatagtgagtcagactcaacgctttcctgacacacaaaaaaccaaaaaagaccaagaacatctcagtcaatctcagtcaaataacatgttagcaaggcatttgccagaaaaacatcacctcagaatttcgaatcaattgtgttacctctgaaaccttgcactttctgaattcaatgcatctcttagtcctgtatatccgttggctaaacgaaatgcagaaactcctggtttgttgttccgtatcagagctgaatatttaatgaggacatcattagacatgtcaatttagaatataatatactgtggccatctaaaaatgtggacaaaatacttacaagatagtgcaccaagagcttttatccgagcagtaaggtcaggatctgatctgaaattggataagagaggttcaaaaccactagcttccatgaccaactgctggctggtcggattgttctgaaccactgttgttaccacatcagctgctttcgctcggatacgagcattagaatttctgaggtacttgataactggaaccaacccaccaacagaatgcaaatctagagcacgacatagaaataacaaaataagtcatccaaataacaaattgtgagtataaaaattgatagattcacataaagaacattttaagttaagacttatggctattattgcttcattgtaaacaattagttcatcattcagtcaactatttttattctaatggatcagctccccttgaaaagttgcacggtagcatattaaaaggggaagctgagagttcacctgaatagcaatgttctattgccaaaaaccactatagttgcctccatccatttgtttagccacctcaacagaaactacgaatgccattttgaatcatccaatgatgtgaatgtattcagtttggcaccaagaatgcatgactccaggtgctaccattgtctcctacatatggaattgtagatttcacttaagtaataatttgagttcatgtatgtatgaatgaaatatgttcatattcttaatgcaagcagcaattacgaactgacactaggagaattctaatggacacacacattacacatatcagatagctcaagaggacttttgtcatgtgatttgtaattgtgcaaaaatatggccccaatgagccatccacatcaaggaccctcaagaatcccaaaaaggtgcagcaagttgtattgtataccacaaatggagccatattgaggtaagggtggggttatacaaagattatgactataaaactagaagatgattgcaaattgagatatgaaacatgagaatttctgaaatatacatgaaatgataacaagacatggggaaaattaaacatgaatctgggacataccatttgccatgtcgatagattccacatgcacctgcagctcactcagcaaatctggaattttcagaagcatgcagattagtatcgaccaggtagtggcatttgaaactaaatgcaattaaggcccagattgtcagcttgaaggctgttacaatctgcaagttgaaacaaacacattctagattatagccagactttaacaattaacaatctgcttccccttaacttgcagattgttacactcaaactgggcccaaaacatgcctatgcctataaccgttagacagatgtcagttcttcaaacaatcaagtaaggagaagacaagtacatcggaaagctgcatagaaatatatctccaccaacctagaaaagggtgaaacagggaataacagtggtacttgctatctaactaccacagtccacagatattcaacggtataatacatataggaaaaactttttttcttttttttttgcggggagggaggatcatttgtctaatcgttactgtgaacttactgagctccaattttatgattggaagattcataaagccagaaatgtccctatgttccttcatgtgaagtggaaactttctgtaaagaaaaattgcctgcccaattccacatccatcgccccttttggttacaaagcaagttgggggcaggctagagttgaaattatgagccagaaatcgcccattttggttacaagcagttgggtgcaggctagagttgaaattatgagc

SEQ ID NO: 339 - DNA, 3573 bp, Sorghum halepense
ttctctcataacaaatcagcgaacagtactttcagtcatggcttatcagccccaatgatttctgttttctgtctccacgtctgaaacggccagttggagcaggagctccagtgtgctggccaacaggtatggtcgtcatgtactcatcttgtgctctttggattcgacaaaatctgcatttcctgttgaacaaaaagttttttcaacattttgctacttgttcagggcattttaaagttttttcaacattttactacttcttcaaggcacttttattcctactccgtaagacggcctcattcaactggtgaaaatggtgatttactgttattttgtctcaaatgtttagatcatattggccagtatcctgaactaagctggtattcgtttttatagatgctttggcatttaacatggactatgttcaatggcaagatgatcacaaattcacaaaaaagcagagaaatgaactgaaggctgcactcaacgcacatgccagtgatgatgatcttcggtgtattatttatagcattatttcaactagaatgaaaaatatttacgtcccggtagatatgtttcctcttcgtagatataaattttccaagatctttattataatttggttgatttagtttgcatatatttcgtttttaatttgtatgtgtctaaatgttaccgtagcgttagcacgggtattatactagtcaaataaaggcaccaaaaacagcatcagaaaagaaagaaaaagggaaaggaaaaaaaaaaagcccatcaagtgagcgttcaaaccgcagcgctttccgcaagccgcaacacgtcatcacgggccgccgtgtgaggtatccacgccgcccggcgctcccacccacggcccaccgcagctaaaccctcaacagaaaactcgaaaacagtgggggtgcaaaagataggagagacccaacacccaaacccttacccagggagaggcgaggaagacacccctccccggctccccctgcccctcctcgtcctccgccctttctcccccctcgccgacacctaccctcaccgcatccgcggtcgcaatggcgctaacctcccaaggcatcaccctgcgttccccgccagcggggccccgcggccacggcgggaggcggtcctcttccgtgcccgccgccgcggtcccgcgcggctgggggcagcatcacgcggggcaagccttatccatctcgcccgccaggtacgaacccgccgctcgcccaccacggggtggctcctcctcctccgccatacgcgccgccgcctcggccggcgcgcagcccggcagcgacccggtccccgccgagcccagaatcgagctccccgcgatatttaccgtcttctctgaggccgctaagaccggcgctgccttcttcatcgcctcgtcgggcgcggcctttcttctcgggtcgtttggggggttcggaggcggcgctgggggtctcttcggcggcggtggcggagggggtggatggggcgcggggggtgccggtggcggagggggtggagacttcttgtcccggctgttctccgtcggcgcggcgcacgcggatgacaagtcgtcgggggattgggacgcgcacgggctccccgtcaacatgacggtgccgctcacgaagctgagcgggctgaagaggtacaagctgtctgagctcaagttcttcgaccgtgcagctgccggcggtggtgcctacacggggccggaggattccttctttgaaatggtgacattgcagcctggtggcgtgtacaccaagtcgcagctgctgaaggagctcgagacactcgtctcctgtggcatgtttgagcgggttgatctggaggtgaagcccaagccggataacacaattgggctcacagtctccttcgtggagagtgtgtggagtgccgcaaagcagttcaagtgcatcaatgtggggcttatgtcacagtcagggcaggttgacttcgaccaggacatgacagagagggagaaaatggattacctccgcaaacaggaacgtgattaccagcagcgtgtacggggtgccaagccctgcatcttgccagaaaatgtacgtggagaggtgctgggaatgatgaagaagcaggagaaggtgagcgccaggatgctgcagaagatcagggaccatgtccagaaatggtaccacaacgagggtttcgtatgcgctcaggtggttaactttggaaaccttaacaccaatgaggttgtgtgtgaggtggtcgagggtgacatcaccaaggtggagtaccagttccaggataagcttggaaatattgttgagggaaatacccagcttccgatcatagaccgagagctgccccaacaggtacccaattacatccaatcactaaagatattacattgattagcatattgtaacgcctgtgacattttattttcactaatataactcagtgatcagttgtgcactaggatgtgtggatcaataactaaaatgtcatgtagcatgcaaacgaacttgcactcagtgttagccatcacacatgattcttctggtcttgtgctctctatgacgttgtttgacgtgcaacaaaaatacttgctctatacatttttactaaatagtcgttgtcctgacatgaattttctcgtagcatgtttgtgacttcagttgttaatctgtgactactaatcttttacagcttcgacctggccacatctttaacattggagcagggaaacaggctctgaagaatataaattcacttgctttgttttccaatatagaagttaatccacgtcctgatgagacaaaggaagggggcatagtagttgaaattaagctcaaggagctggaacccaagtcagctgaagtaagcacagaatggagtattgtacctgggcgtgaaggccgaccaactttggtaacgtacctatttattcatctgttccttctggaacctctctatataaggaagggtggatctaggattttaccatacctagggctggattcatgcgtctcaaactagattgtagatttctttgaacttatcttgaagttcgatgatatttctataggcgtatttgtgctgcacctagggccataactgccgtaggtgcaactcctccactgtatataattgttaggctacactatttcaataaagtacatcttgtttgttatctgtcatgaacctcagatcttatggctattttcttttaggcatccatacaacctggaggaactgtgtcatttgagcaccggaacatctatggtcttaatagatctattgttggttctgttacatccagcaacctgctgaaccctcaggttagttgctgatgagtgttcttttgggagttctgttgttttgctgattttggttattgttaccttggtcacttggggttgcattgtattaggggttatacagcatatccttaacctgcataaggctatggagttagctgttgtttggtttgtctgaataggaagttatgtgtgtaattggtttcctatgtaagtggtcatactgagtcttgggcggtagagcggatgcgggtgggaaggcgggggggaggggggg

SEQ ID NO: 340 - DNA, 15189 bp, Spirodela polyrrhiza
  unsure (1)..(15189): unsure at all n locations
  unsure (1)..(15189): unsure at all n locations
ccctccctctctctctccccttcccccgcggtcgcatttattgtcacttggctcgtggagctgccgcagccggtggcctcggactggcctcaatgttcccctcaatgggtctgaatttatgccatgttgatgatgatgatgatgatgatgatgacgatgatccctctctctctctctctctctctagggtttcttggatcaagatgaccgcttttttcttctgtagggtttgtgggtgagataaagatgcctccttttttctaaagatgcgatcagatgccagcttatgaaggagttgctcgacggtatcaacccccctatttccatttttgtgttataatatttaaaatgtcttttgagggaattcttggggccatttcccgtagaaaaaggcggctaaacagccggaaaatcattttttattggaatctggaatggggattttttttaagaaaaggaaaagcgctcccgccggggggagggggataagaattttggtggcgtctgagggggtctgcatgcgtcctagggacgcgccattcgcctacttggaaaagggtcacgcgatctttttgacccacggcttgtcgaccactgcagacgagtcaacggccctccaggtcgtggcccccaccaacggacagctggtggccggagtggggggcgtgggggaggtgcggcggcggtgaggggcgttgtgggcagccgccggtgacgatggcgggcaatgaagaaggccgcagcccccctcgtgctccccctcacgccggcgaggtatcgaccatggcaggcccaccgtagaaatatccctcgcattcgcatttaccgctgctcatgaggacggccatctcctcgtttaaggccctcacccaacaggccgtcgcctctcacagtcttggtccgcattccttaaccccgctccacaccggcggccgcctccccctccgccgccctttaaagccgaggtcattgccggaggaggagaccccacagcgcctcgtagctcctcctcccaccctgcatgcatgctacggtcgaagaaattattcttggcagggaggcagacggggttcagagaacggaggagatatcgttcttctacttcctgtcagacccttccaccctttcagtctctgtctctctgcccctctgctcctctgtccttctctctctctctctcnnnnnnnnnnnnnnnnnnnnnnnnnnnnnnnnnnnnnnnctccctctctccctctctctcgccgctgtccggagcagaggattaggctcatggagaacagtctcttctgcgacgaggccttgctgagcagccccccttcttccccggctgcggccgtctccggcgccgtcggggaggacgagggggagagccttctaaggggctgcttgaggaggcagcacggcttcctcccccgagaggactacgtggagaagctccgggggatccccgaattgtcgaggttcagactcagagcagcaaggtggatcgtcttggtgagtggattcttcgaccctggtagatgacagtgcgatatctcgcctcttttctgattctctcctccgagaaccaggctcgcctgcagctggatctcgcgctggggacggcgttctcggcagtcaatttgctcgatcgcttcgtctccatgtacaccaacctggtacggcccgggagcttgttcttctctctctggggagccggaattctgactgttgatcttcttctgcagaaatgggaaggctggatgatggagctgctctccctggcttgcttgtccatcgccgccaaattcgacgaggtcgtcgtctcttccttacattcgtttccggtgagcttcttcttcttcttcttcttcttcttcttcttcttcgaatccagccgacgagattcatcgctcttgcccccgaaggtggaagacttcgaccactcgttccatcccaacgcgatccagcgaatggagctggcggtgctcagggccttggactggcgcctcaactgcgtcaccgcttactcctacgtgggcccgctgacttgctgctgggggacctccctccatccccatctccggcgagccatctgcgatcgcactgccgagctcctcgcaggcgcagcattaggtaaccgggaatcttccccacctacccactggttttccagtggacgctccaaaagccactaacgatccgccatggacagaccttgaattcctccagttcagcccatgcgtcgtcgctctctcggcggcgagatgcgccctcgaggagctcgcgctgcccgagcccgccggcttcatctccgacctcgtcagcctcattccccatgaacacatcgtaagaaaacccccacatcccctagtccctcctcgccttcccatcgatgtgatccaattctccgccattgccgtctgctccaggagatgatggagctctgccacaggtgcatggaggagcgggtggccgatccgctccacggcctcgccatggacgcgcatagcccctactctgcgggcagcccggtgacggtcatagtgccggagagggccgaggccctcgacggcgccttcgacgtcggcgtattctcagagatggacatcgccgtcgcgaagaacgagccgaagagcagccatcgccggaagaggaagaagacggagcggacgcaggattgaacaaacaacacttccatctctcaataattcgtaaaattctcaactgggtgcaaccaagcaccgtttgacctccactttcctcattaatttcccatcttactcgcaccggggatccttccggagctcgatgagagcgtgcatcgcccgatcatgcaatgatcgtttacatttactaattcagggttcttttagtttccaatgcattgactaaattatgagttcggtcagcaaatgtggtcgcgctttacagattaaatcgaacggaagaagaaatttagatagatgggctgctgcgatgaagaagaaattatctataaatggactgtttcgatgaagatctagaagcaaaacctataaatttacatgcagcagaccagtgtttgtatttttttgcgctcatttactgaattatcaggataaaaaatgacctgagattatctatacatgggccactgatgaattgtccgggcccatagcgatcgataacaatttgtaattttttgtgattttagttttgaatacatttactgaattgtaatgctcgagtaattggtgggtgatttgtagattaaatagtagtacggaagaaattatcttcaaatgggctctttatatagatctaaactatttaaaatacccagtagacgaatatatagatctagtattctttagttttgagtcatgtaattaattacaagcacggtcgagtaatctgtagctatataaacagcttaaatctaggtatagaagatttatctacgaatgggcagcttcatcgggatccgcaaggagaaaaaaaccttaaaacttataaatattggccgagtaagtggcagtagtcgatagattacagcaaagtatagaagatctacagaaaaaaaaaattctataaattcaaagaaaataccaggccaaattccctcatacgacatatgggatcatatgcatgcatttatctatatatatatatatatatatatatatatatatatatatagagagagagagagagagagagagagagagagagaggcagccaagcccttcaaaaatctcaaaagctctgagaactacgtgatacattaataggtcaaggtgttctcaggggcgtttacaagactctgctgatgcgggtatccacgatggcagcctcggcaggctccgatgtccccagagcttggtcgagggagaggcgagggcacctccactggctctccgctagcctcctcagtctctctccttcctccttcctgctttgttgaacgcacaggatctccgcgtatccaccttcaaagaaaaagatccatagaacaaatggtactactgggtgttgaaattctttgatgatttctgtttgattatataatgttggatactaaacaaactatcaaatgcccatttttctgtctgtatctctgtctgtgtgtgtgtgtgtgtgtgtgtctccctccctttctctctctctctctctctctttctctatctcacactgctgtatctaaatcttatcacacacagaaataggcatcatgctaatgggcggcaaggggagaagagtgagagcaggagaggccgagaatggagaaattcttcaaaaactaggtgaaaattttattccgactcttgttcatgaaagatctaatcattgatcacatcgtttgatgatttaagccctcagtggaccagggcagagtaaaacgatatactgagttgcattaaaaatacctcttttgaggatataagggcccgaagcattaccatgagtgatcatcgggaaacccgtgttttatttcttattgaataatcaattctttcagtcttttcaagttcctcaattaattccatttcatatgcagaatctgattgtgtgtaaatccatgtatatattagagaacaaatttggaaataacagacatgacataggggctccaatagcaaggagaagcccagatttatgcccagtactctctctctctctctnnnnnnnnnnnnnnnnnnnnctccctccctccctccctctattgaccttctcagactggaatggggttctctagtccaggcttcataaagctgaagccagaagtctattttcagatattttcaagcacaacccattgactcctcctgggaatgactaccttttggttattgtacccaaatgagcatgcaaagataataataaaccccgattctaaaattagagtcatggctacgaaaaagaattataccacatcatctaatcttacctcttgcaagagcaattatatctcttctctgatcttgcccattgctatctgcatttacagaataaaagaaatagctttaatttaaaggaatctacatagggaaagggcgcggtccagtagcagagaatgggggtaaaccttcatcaatcgaagctggagccttgagataatcgatggctcttctatagagtccctgaaaaatggacgtataacaagttagaagattcagagggtcatggaacccaggaatgagagtttaaagccctaatctaacagttcaaccggattcctggcaagcccagtcgattctcatttatggctggagaaaacaagtcatgaattcctgccactggctataaatttggtggatgatgagtaaacctcttggattagaagtgaacttgagcgctccatctttgccttctgcccaaacatcatagctatgcaagtcaagacgactccaacttttggatgatttgaacctaacgatgtcaggaaaataatgataatatacgagtagtctcttctaaatgattcctagaagactttaatgaggataagttacgaagaacaatggagatcattttttttttgggagaaaaacaaaccgaagatatcttcagccttgttcagtgctttcgtcagaagctcttccgcaccctgaaaatctctgagaaagttacaaagacgacaaaatttcagccgattggagaaaatattgtacaatcttttcagacttggataaataattcgtttcgaatgcgtgctataattagagattaaaaacagacgcatattggcggcgtgagcaatccaatctattcagtgttaagatcattttcatctataggatcacctttgtttcaaccaccacaaattcacaatatattattctaaaatggaatggaaaataagtttacaattcaactcatatgtaaaaacaacactcatcgctttaatttcagaacaatgcaagtcccagcacactttccatagaaaaaataagagaccagtcgctacgtccgggccgattttttgtgactgttattttatacccactaagtgcgagatgataaataatagagatggaatacacaggaatatccgtcacgtctgctatgtgaaaactagagagcgagcgcaattatggcaataaagtcaatgaggctcacataaaacaggagaaataaaactgaccacgaagataccttgaatgcattaaaagttgtccgagtgcacatgtggcacccaaggacacttcatcaggaaccatgttagcggccgccaatgaagagaattcggttccaccatttgcctcggatatctgaagagccctctcataaaagtcttttgccaaagaaacatttccagttgcatgtaaaaattgaccacatgatagagcaaggtttcctgaaaatagaaaaactggactgttaaagatgggggagaaaaaatacgggtcaaccaatgggtgaaaaactgaccgcaacgatattttccctctgttgactcacagtcctcgcattcaccaaagttcagttcagctggcacagaggcttcaagtcaacctctctggaacacaagcaacgaatgtgggccagtaaagaacagtccaaacctgactgaaggtccccacgaaccatgtcgacaagccccctgatggctttgccccgcagatataatatatttgacttgggtgcattttcttctcttttgtttctcagttcttccaaacattcatcagcaagaaccgacgaagaatcatcctgcaggagagaactcttcattgattctgccaatagaaagaacaaaactgaacgcaaatctgactacagacctgcccggcctccaaattgagacccaccaagccttcccatgcggcaactgcaacaagttcaacacagaaagcatggattacatgccgtcatctgtttatgtggaggcaatttttcaggttcctaggaaatcacagcgtgctgtcgtttgacagggaaaaatcacgcataattttatgagatgaaaaagttttggttgcaaagggaaagatacgacatccagatcgggcgtctgagcctggccacacgaaacttacctcgggtaccaggagagcagtgctccaactgatgaatcatctgtagcttctccatggcatcgttaatctctcctctgatataagaaaaacggaagaagagagaggacgtgaacaaaggcaaaaaggctgacggaaatggaggtagcgaggagattagacgggcgggagatttcatcgatttaagaaactgaacctctcatgaagcaaagtggacatggcaatcaagagcattcccacggcgtcgtcacctccttccccgccccctgcgtgcagattggagagcccctgctcaagcaccagcaacgcctgtgcgtacgagtccgctacagattcaattctcagtaagggacgcgaggaaaataaatttacagaaaaaaaaacaattcaaacatcgaacggagtaggaggggagattctgctcaattcgcaaagtacatttcaagggcgatcaagagaaacaaagaacgaacctgatttttgagatcgagccagtccaagagtgtactggatcatctgccgggcagtttgaagctgcttctgctgctgctgtcgctgcgagtcatccaggccgctgcctccataagatctaagggcgccgatgccagccgcggccggagggcggacagaggaagccctgggtctgagagactcaagaggcgagctcaaagcacccgccgccgccgccgccgccgccgccgccgtcgatatccttctcaccgccgatcggaacatcgcgccaccccccctcggctctcactggcccaggaacgagcagagagaagaggagctcagctccaacggagaagaccacctccgcagtctctacgcacgtgtcgtcaagcgtgcgagcccctctcttggcccaaacaatacccatttagtacggaccccggaccccataatgggctatattgggccgacccaggggaaacaatgggccgtgcactttgaaaagtgttatcaccattataccctccagcaaggaaaaccccccaaaacctcgaaggacgagacgctctttctctcctctctctctctctctctccctctctccccgcagcttattccgccgcacctgatcctcatctccctctttgctcttccacctcttcccgcagaggcatctcggggccatggcgttgcccctgcagaagcagccgctgggggtgggcggcggcaacctcgggccctcccgcgcctcctccaaggcctccaggcacgccccgcggcaggactccgtcctgatgctctccgctcccgcggcggcgcgctctccgagctgctgcctgccatcgtcgtcgtcctcgcagaaggccggctccggcggcgccaaggacctccgcacgaagtttctggccctttcatcgggggccctgggggctggcctcattttccacctgtcacccctctcctcgatgctccccagcgccggcggtggcggtcccggtggtggaagcggggattggggaggcttcggaggaggtggggccggcggcggcggcggcggtggagggggtgggggccatgggttctggtcgtggattttttcgtcgtcttcggcaatggcgaagatggacgaacaggacgccactggaccagagtgggacttccacgggcttcccgccaatctcatcatacctttggctaagctgagtagtatgaagcggtacaagatctcggagattctcttcttcgaccgtcgtcggggtaacaccgttgccagcgccgaggattccttcttcgagatggtctcccttcgccccggaggcgtctacaccagggcgcagctccaaaatgagctcgaaaccctagccacatgtgggatgtttgagaaggtcgatcttgacggtaagacgaaacctgatggcacgctggcgctgacagtgtcgtttgtagagagcacttggcagtcggcggattcctttcggtgcatcaatgttggactgatggcccagtcgaagcctgtagaaatggaccctgacatgacggacagggaaaagcttgagtacttcaggagccaggaaagggaataccgtcgcaggatcgaacgctcaaggccctgcctgttgccagagcctatcaagaaggaagtcaggcagatgctgagggaacaagggaaggttagcgccaggctgctgcaacggattagagacagggtgcagaagtggtaccacgatgaggggtatgcatgtgcccaggtggtgaattttggcaacttgaacacaaaggaggtggtctgtgaggtggttgagggggacgttacccagcttgttatccagtttcaagataagctggggaatgtatgtgaggggaatacccagcttggagttgttcggagagaattaccctctcaggtgaatgattacttcgcatattagcaagtgcatattagatgaactcttttttatggttgacgttgggaatgattttattcgattattgcatatactgattatctttatggcatagcttttttctctacgctgcataaattgattttacgtgtgacactttttcacgattagtgccggtcggtttctgagcaacgactgtcaactgtttttcaacattttttttatgtctcgtagtgtgccatttaattaatgtgtagttaatttttttgggtgtctttgataagaaaaacttttccacgtgtgtctttttacctatagtgcgctcgttcgtgatgaataattgtggaatttttttgggataaaaaatctaatgagattatcacgtgcagcttcaacgagggcatgtcttcaacattgaagccgggaaacaagctctaaggaacattaactcgcttggtttattttccaacattgaagtgaatccccgccctgatgagaagagtgaaggaggaatcatagtggaaataaagcttaaagaactcgaacagaagtcggctgaagtaagcacagagtggagcattgttcctggacgacaagggaggccaacactggtatgcatctggaagaaaaaaaatctgactgtttgtagataaaagttcttgcttccatagttgttagcataaaataagacaagatcctgatcctttttttttcaaagcaatcctccctattacactatgaacgttttacgtttgcatggaagatcccttgtgctgatagtaattccagattgaagaatttatgaaagtattacaggaaacttgatgaatcgaattttttctgtcatcgaagtgagaattgcaagtaattttttgtgaacattttattttaggcatccattcaacctggtggtacagtttcattcgaacaccggaacatcaatggattgaataggtccatccttggatcggtgacatctagcaatctttttaacccacaggtatgacactcgtatgtattgctcagaaagtatttgtgctattttttcttctcttcatgccttgtcacttgttgaaaattagtttatgaaaggaaaagcatcatatcagtttagttcttgttcagcgtggtgtgctgtacttccgcggcacactctcacgccggcatgtgacggctgagtgtttagacaacatgatgaggagcacgctttattttgcattcttaatcttccttctgactgcgctgcatcacaagggccatactaaacgtactagtgaaagttttcctgaaatatactctggcgactttcttttgaaagtaatacgacgtgcagcagactgagagtcacaacatcaagaaaagttatcaatttttgcattcgaatccttcgcaaggggaacgtcaaagcatgttttccatttaaaaatatttgatgaaaatttaaaacctacatcttcaattttaaacttaataatagccaaacttgtctcttatttgagagattttgttgtctcccaaattcaaattttcatggcttttaatcttttgacctcaatatatctttccgtattcaaggtccatggcataggaaaagtgatttacccggatatgtttgagaaccaagcgacttttcaattttttatttattttacatacagttatgtacagtttttttttgtgaggatagtctttttctgtttttgtccggttgttagtactgggtgagttgtttgactattagtctttgtaaagttaactgggttctctttacgcactttagcaaccagctcaaacgtttactgagtctatacccttttcccgtaagatattttacttggtctccatttttattgggtataaaagaaaagagaatagaaaaattacctggatctaattttcagccatgacaatggtagctgcagaatctgtatcattttgatattggaaatactgttggctgaagtgggtcaagtgaaagcagcaacatgccaattatatttgcgtgagaccattgaattgcagtgtagtctttttgcgtcctcgagttttttgggtaaaactgacatttccatgtttccttctccagagattcaaccctctgaacgtgaagcagatcggttttcgtgtgtatttccctagttttacatgatttggtttgattcctttcttctcgttttttaaatcaaacaagctgtcagggtttttcatgggacagatctggcgtttctatccttgcacagattggatctgaaatcattcaataatcatttcagcttaattcactacaaaaccaatatcactggtttgactttaataattaagacaacgaaggcagcagtatacgtgacaatgtgtcagagttggttggctaattggtcctggcttagtcgaccttttaagccatacttttgttacttgtgtttcaggaacaattttagtcgacatagatacagatccataattctgctgtcatatctcgagcaaattaattatatttcctaatttgttcaactatttgacgaagcttttttttttcagccgacttgagcttatggcaacgattcatttgtttataagtttgcatgaaatttatcctctgttaagggtttgacttggcaccttctttcaggatgatctttctttcaagcttgaatacgtccatccatatcttgatggcctttatagttcccggaaccgaacatttcgtgccagctgcttcaacagccggaaattaagcccagtctttactggtggtcctgggatggacgaggttcctcccatatggattgacagagtgggggtcaaagccaacataacggaggtacaggagattactttgttcactggtctcattggatttcctggagatggattaatagtgggaattgttatttacatgcttcaattgggttaattatatttgcagaacctcactcggcaaagcaagtttacatatggtttagtcatggaggagatcacaacacgtgatgagacaagcagcatttgcacgaatggaactcgtaccttgccatctggcggattgaacatgaacggacctccaacaactctcagtggcacgggcattgaccgcatggcctttgcccaggcaaatatcacccgtgacaataccaagtttgtgaacggagcgatcgttggtgaaaggaatgtgtttcaggtaatatatgctctatttataccgaaattactcgtcatcctgataagcccaagattcatccatattgagagggtacttcttgtctaatctacaataaaagaatctatgacctctgtgaagtgcagaaatatttgttttgactttggtcttgtgtttgtgagacttttctttatatatgtaataaacgcttctttggttttgagaagtcattaaataatcttcgttgtgaaaaattctacatgcagtgattcggttttggaagactttgaactgtttttttttttttttgcgagctccatgttacctccaaactattacttataattacatacgagtatcttaatgattagaaacttggactggtaggaacatgtcactatatgcaaacttttgtggtgtagtcgtattattaatggttctattgttgcagcagcttaatattcatccaattttactgtatgattctgtctttgcatttcattttcttgggatctttatgtagaacaaattcgtaggaaacaaaagcggcccaaaaagcacactctagaaggttgaaatgcgttttattttcgtagggtcattactttccatttcctagggaatgattatttctgatcttactgttttggggatctgcaactacttttgacctatttaaagaggcacggagtcttagccaagatgattatgtgtgttgaccatcaaaaagtttttcgcatctctctgcttgtggattcaagcaaccgtttctggaatcaaggaacgggatcgcatcactctaatccgatccatgttgattcaaggtcatgcaaatcaattcttgtagactcaaggactgtggatcccgttccttgttgattcaagttacgattttctttcatccccgcatcagatttcatgtgctattattcttctgcaatattccttcctgatcaatttgagtgcgtaaagactggcttggagtgggcggataccaaatcacagagtgtcttttccactgatgtattgccttttcaattcacaaagtccattttgtgctacaagaagacagcacagaggtggacttatcacacgtcttgaatcaatgtaacaaatggtttctggggcgggttcgtgatcaaattctaatttttttgtccaaatcctctttacaacttgatttgacttgtagtgatacacaacttgaaagactcttttgccgggcccgttctttggttttctgctcacggcgtagtatataatcgccattcttgggcaaacatgattggagatcgagggccgctctcttcttcttcttcttctnnnnnttcttcttcttcttcttcccgtgttcttcagcttataactgctcccctatttgcagctggaccaaggtctcggcatcggcagcgcattcccattcttcaaccgacatcagctgacaataacccgattcctccaactaaaggaagtggcagaaggcgccggaaagccgccaccgccggtgctggttctccacgggcactacggcggctgcgtgggtgacctaccttcttacgatgccttcactctcggcggtccttactctgtccgaggttacaacatgggtgaattgggagcgtgtcgaaatctccttgaggtaggcgactctgacccaaagttatttctcatgattcttccaccagtcaacgatggtagatattttgactctctctcctcaaatcagcttggttcctccatcttctcggatgaggaatttacacccagaacctatacatcatcatggctggctcacatcagcccgtgattaattatttagctgctcctccccatcttgcccacccccatttatactctggattaccgcggcatggcctgtcacaagcccgtgatgaacctacttgcatatatatatatatatatannnnnnnatatatatatatatgtgtgtgtgcatataagttgcggtttttatttttcgatatcgagaatttagggttggtggtcgttgctgagtcggcttttctggtcttgtccgcttcgcagctcgccgcggagcttcgggtacccgtgaggaacacccacgtatacgtcttcgcggagcacgggaacgacctcggcagctccaaggacgtgaaggggaaccccaccgagttcttccgccgggtggggcacggctcctcctacggcctcggcgtcaagctcggcctcgtccgcgccgagtacgccgtcgaccacaacgccggcaccggcgccgtcttcttccgcttcggcgagcgattctaggcggccccctcccttttcgtgcgcgaaccagcagaacagcccggcccggcccggccatttcttttctcgaggactcgtagctacctggaagaggattcttcttcaagtatcacagacggccatttctttgcccttgctacttggatcgttgagccgttcgatcgatcgcgctgtattgggtgttatatgacgcatctggcgctggacggtgaagcagacagaaaacgggctcccgtgaaaatggcgattcttaactgacggagttttgcaatggttgaaggcgatccatcgatcgatagaatcctctgttggtcatgtctggggatctcggctccccccgggggggccgaggccgaggagcagggggggggccgctttcttcccgccggtggag

SEQ ID NO: 341 - DNA, 6272 bp, Taraxacum officinale
tataagtaaaaataacactcatataatttaagtaaataacaccgtaatgatactttttatttgttacagaccatttcattacttctcctatcggcttattacaaatttcttggagggtttccattggtagctgtaggggctctacttctttatgttggatgctaccaggtaaataattaaatatcacatggttgtttatactatttacttataaacaaaaaaaggttaataaatagttgagttgaaatttgggatttttcagatatcttttggaccgataagttggctaatggtatcagaaatattccctcttcgtacacgtggcaaaggaattagtcttgcagttctcacaaactttggttcaaatgccttagtcacatttgctttctctccattaaaggttacaattccattcctttctcaattctcaaaagtcaacattgaaaagtcaacgttcatctttttgtgcaggagttgctgggggcagaaaatctgtttcttctttttggtgcaattgctttattatctcttggattcgtgctgctatatgtccctgaaacaaaagggttaagcttggaggaaattgaaaacaaaatcttgaaataagatttttaatcaatttttgtatcatatgtatatgttattaacttattattgtatgggttacatatatctgaaatccatctttatttaatttatgtgatgtagaggtaatgattagattcagtgataagaatccaataggcgtaaataccatgaaaagattgctataatatggttgcttgaggacctagtcaacctccatttgctataatatcttgttcacaaaaagtccctgaaattgtggcataaaaatagaaaaaaattagcttcttgttaaatttcgtgattgagctatccaaaaaaaaccagagagccatgcttttgtgaaatcatagcaatggctcaatcagacaatggtcgaagcacaacgaccatcgatgctgtcaatgctccacgaccccaaaactcgccaggctccaagagtgcaagaacacacggtcattttttaatcttcgccatggctttctgcttcaattttgtgaaattcgaatcgaaatgtgatttttagggttatgtttatctgttttgattcgtaggtgattcttcaagctggtcgtctatttcttcattgaagctaagaagaaaccatgataacgacgatagcggaagccaccctaagagatccgttttctcaaaggtgaaagagaaggcaagaaaattgaagaaatctttgagcgggaaaaaacgtcgagacgataatgagttgcgaagccctaatttcactactcctccgggatccgccggtcctgtcaaggatactaaacaacatccccaattttttagttccccagcgccatgtaataatataattcgctataatttacattttacaccacttacaatacactttttacaaataatattagtttcaaataacaaacgagagggagagataacgaattttaatataacgaatgtaattttttagtgcaaggatcttcggtttcaatggacacaaagaaagattcaccaaaagagcatcatcaagaaactaaaaaagggtcttccgaaacgggttcaccacccaaggctgagccaccacctaccactggcggttcgccggaaaccaccacgaaacatgatgctaacgatgccaaaactagttccgaaacggacaacattcaaagcaacacgcaaacacaggacaaaggtgtctcggtgaaggaatacttgatgaacaagctagagccaggggaagatgagcgggctctttctcaagtgattacacagacaataagtcctaaatgtgaaaaggtgaaagaggcggtgacctcattgcttggaaccgaagaaaccgtaagcgaggctccaagctcggaacctgatactacacctgctgactctgattcaaatcaagatgtcggggatagatcttcggttgaatctgttgatacgaagttgacttcattgaaccttcatgatccgagtgatggccctgaaacacgtatttctaacgtgtcggatataagtcggggctcggaatcgatgtcggcttcttgccaaaacaaaaaattggaacaatcggcgtagtgtttgtgaagctcgttgaagctcggggagaagggttgaaagcactggagtctgtggaagttgaggtcgtgatagtagctttcttcttcggtttgttgtattttattggttctcatttgttatcgttgaattaggacttatttttgtatattttgctttataaatgtaaatgaaagttattgcaataacttgttggatacttgatatcttagggaatgcatgataactgtgtttgaatgttgaacactacaaacctgatttaacgtggttcagtcaatatgatataaattctatagacataaatgtctattggtattcaacgtacaatacaaaactttagctatttgtcctaaaatatatagacattactctataattttgaactcactacatgttctaattgtttctcttaaaaaaaaaccctaaaatgtttcctagtataacaacattttacgtttgagcccaaaacgccaaaataagtacagttttaatagttaaaaggttaaaacgtgttttagacatagtatatagggaccgaacatgtatttttcaaatttaatttcaaaataagttgtaaatctcgtccggttcaagcgagtaatctggactcacctactcactcataaaccccttctctctctagctcttatctccaatggcgtccttcgccgccggctcggggcaattcctcagcctccatccaactcgctcccgctcccgttcaaaattaccccgtacttcgtcatctgcctctattaccaccaacattatcagatgcgaacaaatttcgtctcaaaaccctaacaaaccctcaaacacccggcattcgaattcgcccttgacttccattaagaatctagctatatccgccgcgcccttgttgtcctttaagaatctagctatctccgccgcagccggggttttatttcatgtagcttacaagaatcctaacctcatcggcatcggagggggaggaggtggcggtggagcgggcggagggggaggaggtggcggaggtggtgggggtggaggcgagttttggaagaggctgctctctcctgcagctaatgcagatgaaaatcagtctccagaatgggattctcatggcttccctgccgatatccttgttccattgaacaaactcagtggatttaaaaagtacaaactatctgcgatcgagtttttggataaagttaaatccatggttgtaggctcagaggattcgtttttcgaaatggtttcactcagagctggtggcgtttacaccaaagctcagctccagaaagagctagaaaccctagctacttgtggtatgtttgaaaaagtcgatttagaagctaaaaccaaccccgatggaacaattggtttaactgtatcattcacggaatccacatgggaagaagccgagtacttcaggtgcatcaatgtggggttaatggcacaatcaaaaggcgctgatatagaagaaaccatgactgagaaagagagaatggataacatgcgcaaccaagaaagggactatcgcagaagaatggacaaggcaaggccatgtatgttgccatctgcagttcatagtgaaatcgtgcagatattaaggcaagggaatgtgagtgctcggatgttgcaaaacatccgtgatagggttcagaaatggtatcacgatgaagggtacgcatgtgcacaggttgtgaatttcgggaatctgaacacaaatgaagttgtttgtgaagtagtggaaggtgatattacaagagttgtgattcaattccaagacaaacttggaaatgtctgtgaaggcaacactcaaactggagtggtgaagagagaactccctaaacaggtattttattaatcatcacttttcttcttcttcttcttcttcttcttccatcaagtgtttgtatacatcatcacttaatcacgttctaatttcaatcacagcttcaaagagggaatgtattcaacattgaagcagggaaacaagcattacgtaacataaactccttatctttgttctcaaatatcgaagtcaatccacgccctgatgagaaaaatgaaggaggtatcattgttgaaatcaagcttaaagaacttgaacaaaaatctgcagaagtcagtaccgaatggagcattgttcctggacgtggaggccgtcctactttggtattttccattttccattttcatcaatcaaattctgtttttcaaactataatcaaatacacattttatcgtccattgtttaggcttcaatccaacccggtggaactgtttcttttgaacaccgcaacatcaaaggactcaacagatccgttcttggttccgtaaccaccagtaactttcttaatccccaggtaattactaaattcatcttaaaagtttacaaaatctcgttcgattatgtcaacaacattgtttttttgcaggacgatcttgctttcaagctcgaatacgttcatccgtatttagacggtgtaacaaattcccgcaaccgtactttgcgtacaagctgcttcaacagcagaaagctcagcccagtcttcacaggtgggcccggagtagacgaagtcccacccatctgggtcgaccgaaccggtgtcaaaaccaatatcactgaggtaactaaacgtaaaaccgtaaaaaaaacccaccctaattacattaaatcaaaataacatttattatttccaaacctcagaatttcacccgtcaaagcaagttcacatacggagtagtaatggaggaaataacaacacgcgatgaaagcagtcacatttcttcaaacggtcaacgggttttgccaagtggcgggatcagtgcggatggcccaccaacaacattgagtggaacgggtattgaccggatggtattcgcacaagcaaatattacacgcgacaacaccaagtttgtaaacggtgcaattgtgggcgaaaggaatgtgtttcaggtcagttaatccattctgttacttttagtggttagtttgttacaactaacatggatggaattgtcgtaggtggatcaagggctggggatcgggagtaagtttccgtttttcaaccgacatcaactgacactaacaaaattcatccaactgaaagaagtggaagaaggtgccggaaagtccccgccacctgtccttgttcttcacggacattacggtggatgtgtcggggatcttccgagttacgacgcgttcactctcggtgggccctactctgtgagaggttacaacatgggcgagatcggtgctgctagaaatatcctcgaggtaacataaatgataaatgataaatgataataaacttaaaataataccaaaataattaaaatgattatttaaaagattaattaatgtgtgggaaggttgcggctgagatacgggtaccggtgaggaacacgcatgtgtatgcgtttgcggaacacgggaacgatttagggagttcgaaggatgtgaagggaaacccgacggaggtgtacaggaggatgggacaggggtcgtcttacggtgtgggtgcgaagctggggttggtacgggccgagtatgcggtggatcataactcggggactggtgctttgtttttcaggtttggagagagattttgaactttgacttttgttttactattttggtttttgttgctatccggttttgcgatttcggtagatgggacttgacttgagtgttgtgtgtgtagaaagagaattcgtgatgattttggttggacttatttaagatgtagttattgtttacatacaaataacctcaggaataaattatgttttgattaaatgcaattggttggattggacactggactgaggttgagacctgaccactgttggataacttccatggtgagaaaagtcaataagagaaagaatgtttggatagtttatgtatgtaaaatgacaaaaaaaatcatgtttagttgtctataactattaggtttaagagcatattatctcaaaaagttatttcaccttattgatttttcaaaagactaataactaataagtccgtaaattgttttcaaaacattcacaaacatcctttagagaaaccaattaatttatttaatgaataaatatacgtatctatttgtcttatttaatgaatagaaacaatcacttacgaa

SEQ ID NO: 342 - DNA, 2087 bp, Trifolium repens
  unsure (1)..(2087): unsure at all n locations
  unsure (1)..(2087): unsure at all n locations
tttttacaggccaatattacgagggataacacaaagtttgtgaatggagctatagttggaaacaggaacatgttccaggtgactattatcctattatcattgttgagaaaaagttcattctatttcaaataagtaactataagtgaaccgtatttagtatatgcttgcacgacttccatttttagttagaatttaaatctagactttagtggtatgtgtgtggggatgcatcaagcagagtttcaacctcgttttatatggagatatcatggcctcctaaatattttcaaaatccatagatcatatctattttatattgttaaaaataaatccgagttgcaaaaaatttcttacatggccctgttattccattggcattagtcggcgcttcaaatgtctaatcttaagcgtgaaggggtgttgtttgtcccacattgactaaatatatactactgggtagggcttcttatagacttggtcattcctgaacatagtcacgagattgacgttttataaatttatgatcttgaagtttgctatgctatgttctgtgctgacagcatgacactgttatctctctatactaactgcaggtagatcaaggcctcggcgtcggtagcaattttccatttttcaaccgtcaccagttaactgtgactaagtttcaccaattgatgcatgtggaggaaggtgctggtaaaccaccaccaccggtgcttgtcctccatggccactatgggggttgtgtaggcgaccttccaagttatgatgcttttactcttgggggtccctattctgtaagaggttacaacatgggtgagattggagcagccagaaacatcctcgaggtaagaacggttacaccttatgattgtttcttttttttttggtcatgtagcctagtggtttgaaattccacaaggtggataagtgggatgaccggggttcgaaccccgaccccctgcannnnnnnnnnnnnnnnnnnnnnnttgagctaagctcacgggacacaccttatgattgttaatggtgatatagtagttttaattatctcaatcaatacattatccggcaaacaattatctgatttcttgttcttcctacagttggcagctgaaatacgtatacctattaaaggtacacacgtgtatgcctttgcagaacatggcactgatctaggaagttcaaaagatgtcaaaggaaatcctacagaagtatataggcgaatgggtcaggggtcctcatatggtgctggtttgaagcttggtttagtgagagcagaatatgccattgatcataactcaggaacaggtgcaatatttttccgttttggagaaagattttgaggtgcatgagtcgtagggtatgtttggttatttttttcgtctatggaagaaatctttcagccataggtgcttgaatattgtagaatttggtttaagtgaactccacgttggtgctgggtttttgttttctgtaggttactcaaaattgtagtagggttcaatgaaaatattgagattttagactatcttgctgtctactattgataatttctgcggcttaatcaatgtccaattcacgagaacggatctaaattcgaaatgtagtgatttataatgaatgtatttcgtttatttccttgtgatgatgaatattttgttggagtactagcagttattgatttggtattagtctaaattctttagttgatgaaaaattctgccaaatattttttttactcatttgtctcttctggtagtaccatttgtcatttatgagtttagaaatatgatgaacaagaatttatttgaacaccaaatgtaattgcattttagtcaaggggtaattatatttgaacacctccaattttctaacaccttattgttttgtccgtctctctttttctatcatcacatcactccatcaattatcatgtctaaatattattttcctttaatccgtgttaaaatagccataatctcagcgtaaaagactctcaagtaagtaacctcggaaacaatttacctagccaccgtcaattttggacatcacactaccaacatggccacacttttttttttttt

SEQ ID NO: 343 - DNA, 287 bp, Trifolium repens
tgtattggattaacagctgtttccgggtaacacctttaacattgaagcagggaagcaagctttacgaaacataaattcccttgctttgttttcgaatattgaggttaatccacggcctgatgagagcagtgagggaggcataattgtggaaattaaggtaaaagagttggaacagaagacagctgaagtcaatactgaatggagtcttgttcctggacgaggaggatatcccactctggtatttccataaaattaaacatcaatttcttcaacaactgatggatctt

SEQ ID NO: 344 - DNA, 409 bp, Trifolium repens
ttacttttgaacatcggaatctgcaaggattgaataggtctcttactggttcagtaacaaccagcaacttcttgaacccccaggtacccttttactggtccatttagtttctcatctatgtagaagtaggcattggtatttggttaaatgcgcgttatatactgttgtaggatgatcttgcatttaaaatggagtatgcacatccgtatttagatggtgtagatacactacgcaatcgaactctccgtgtaagctgcttcaatagcagaaagctgagtccagtattcactgggggaccaggggtggatgaagtgccctcaatatgggttgaccgtgctggtgtaaaagctaatatcactgaggtaatttgactggttattttacattagtcttcttgacatggctattt

SEQ ID NO: 345 - DNA, 1851 bp, Trifolium repens
attctactagcttttcagctatcaactagcttatagcttaattttaccaaacagagcctaagacaaatgttttttttttatgaagacaaatgcttcttaaaatcattcaacttaaacatttttaataagttttttctttaagtatttttagcaaaataaccttttaagtaataaaatatctgtactattttttttcttcttcaattctgctaaaatgttattctgtgatcatttattgcaaaagtgataggtcaaaatttattactctatttaaactgaagttcataaaaatgtattattcaatcttgatcaaatttgaataaaaatattaaatataacaatactaatattctcagtttaaatatattttacgaattttgtcaaaaaaatatattttacaaataaaattagtacttgtgtttttactagaagaaataaaatgaataaaccatggatatataaataaataaaactcaacaaaaaccctggtgtggtttatccttctttttttcttcacactctacagcgacctcatctcaactctcaactcactcaaccatgtcttcttcctttattacttcaaatcgcttaacccctaccctatcaaaccctcctcctcgtcaccgccgtaacagccaccaaatcacacgaccttcttccctcaaatgccacctctcttcttcttcttcttcctccgacgataacctcaacaatgattcctccaactccaattcctccattttcaaaaccctctccgtcaccctcgccgtctccgccgcagcctccggtctctacctcaccgactccctccctaatttctccggcggaggaggaccttcttccggcggcaatggaggcggaggaggtggtggtggagatggcggtggttggttcaacggcgacaatggatccttctggtcaagaattctctctccatctagagccatcgccgacgaaccaaaatcaaaagattgggattcacacgaattaccggcgaatatcacggttgcaactagcaaattaagcggattcaagaaatacaaagtctcagatatctatttcctcgatcggaacacgaggaggagaatcggagccgaagattcgttcttagatatggtttctcttaaaccaggaggtatatacacaaaagctcagcttctgaaggagctagaaagcttagcttcttgtggaatgttcgagagggttgacatggatgctaagaccaagccggacggaaccttagcgctgtcgatttcgtttgccgagagtatgtgggagagagcagacaagtttagatgcatcaatgttggtttaatggctcaaacaaaaccgattgagatggaccctgatatgactgataaggagaagcttgaagtttttaggagacaagagagggagtataagaggagaattgataaggctaggccttgtcttttggctcctcaagtttataatgagattaaggagatgttgaatcaacaagggagggttactgctagattgttgcagaggattcgtgaccgtgttcagaaatggtatcatgatgaaggttatgcttgtgctcaggttgttaattttggtaatcttaatacacgtgaggttgtgtgtgaggttgttgaaggggatattactcagatgaatgttcagtttttggataaacttggtaatgttgttgaaggtaacactgaatatgctgttgttagtagagaacttccaagacaggtgtgtattagtgtgtatgtttgtaacagtgtttgttgataatgtttgtttggagttatgtgattcatgtttgtttgcgttggtttgataatacagcttcgaccaggtcaaatttttaacattgaagct

SEQ ID NO: 346 - DNA, 1168 bp, Trifolium repens
gaatagtgccatccggctgtagcactttttagcttgacctctaggcattgttatcctgtatttataattatggatctgatatgaattcaagatggtaatggtagtttagtgtatctgatctttttgaggttaacttgttagaggatcatacctcggctaatgttagcatgattccatcttttggatgtggaagcattctttttaaccaacaactaaaccttttccattatatgacaccggctggataaatcaataccgtcgaactctacctacaacatattttcagttaacccttttaattcaaggtccaatttgcagtacctttgaggacaagttattgatgttttttattttaatagactcttgaagtatgctatacaatactttctgattacagtttccacaattgcaaactgcaggtagatcaaggcctgggcattggcacccagttaccattcttcaatcgccaccagctaactctgacgcgatttatccaattgatgtctgtggaggaaggagctggtaaaccaccaccaccagtgcttgtcctccacggccgctatggcggttgtgttggtgatcttccaagttatgatgcgtttactcttggaggcccttactctgttaggggttataacatgggtgagcttggtgctgccagaaacatggtggaggtaggaatgaactagaactcatttttatgattcttcgtcaagatttaattttagttcatttttattatctgtgtactaatttctttttcttaatacagcttgcagctgagttacggatacctgttaaaagcatgcagttgtatgggttcgcggagcatggcaacgatctagggagttcaaaggatgtcaaagggaatcctacagaagtctataggcgaatgggtcaaggttcatcttatggtgttggtgctaagcttggtttggtcagagcagaatatgccattgatcataactcaggaactggtgcattatttttccgtttcggagagaggttttaagttgcaaattagtcacagtatattgtcaagaggctttattaaactacattttttttgggtttaattggacgcagtgctaatactagaataatagatttgttttctttttagtactggagaattgataatttaatacaaagttatggaatacaaatt

SEQ ID NO: 347 - DNA, 2330 bp, Trifolium repens
agtttagcatcaagtggaatgtttgagaaggttgattttgaaggaaaaactaattcagatggaacaattggaatcaaggttttgtttagtgagagtacttgggaaattgctgaaaaatttcgttgtataaatgtcggtatgatgccgcagacaaagccggttgaaatggatcctgatatgactgatagagagaggatgaaatactatttgagtcaagagagggagtacaaaaggaggatggaaaaggcgaggccgtgtattttgcctgagacggttcatatggaggttatggatatgttgaggaatgagaagactttgagtgctaggttgttgcagaagataagggatacagttcagaagtggtatcatgatgaagggtatgcttgtgctcaagtggttaattttggaaatcttaatactaaagaggttgtttgtgaggttgttgaaggagatattagtaaattgtctgttcagtttctcgataagcttggcaatgttgtcgaaggaaatactcaagcccctgtcttacatagagagcttcccaaagaggtacaatgcaatctacattgcatagttatgtaatgtgttatgttatctgttatatatgggagattcctcggcatctttttgtttgtcgattttgaaggttatgtgtttttgttatctgctgcacaattgatatttctagtatggttaattgctttcgaattcaatgatgttattatatgctttgtgatttgttactagtatagttactcacttgattgatgtttgtattggattaacagctgtttccaggcaacacctttaacattgaagcagggaagcaagccttaagaaatataaactcccttgctttgttttcaaatattgaggttaatccacggcctgatgagagtagtgagggaggcataattgttgaaattaaactaaaagagttggaacagaagacagctgacgtcaatactgaatggagtcttgttcctggacgaggaggatataccactctggtattttcataaaattacacatcaattttcttcaacaactgatggatctttcctgctcaattaatctgattgtttgttgttcaatttttgttcaggcctcacttcaacctggtggaactgttagttttgagcatcggaatcttcaaggactgaatagagctgttagtggttctataacgaccagcaacttactcaaccctcaggtactcttgagctactgctgagtttcttcattttattctgcagatagttttgtgtttccactcaatattggtatctgaaaatgttcatcatgtttttctcctaggatgatcttgcatttaagctagagtacgcacatccgtatttggatggtgtagataatccacgtaaccgtactctccgtgtaagctgtttcaatagccgaaagctgagtccagtattcactggagggcccgggcttgatgaagtgccaccaatatgggtcgatcgtggtggtgtcaaagctaatataacagaggcaagttacttgttctttattgttatgtgaactcaaactttggagtgcctaatattaatatttaggctaatgcagtgattttttatcttaatttttatggtttgtgtgccgaacagaatttcacgccacagagtaaattcacttatggactagtaatggaagagataacaactcgtgatgaaaatagtcaaatctgtgaaaatggtcaaagagtattacctaatggtggaattagtgcagatggacctcctaccaccctcagtggtactggcattgatcgcatggcatttttacaggcaaatatcactcgtgataacacacgttttgtgaatggagctgtagttggacagagaaatatgttccaggtgacttatctagtcctaccactaaatgtctttaaagttgctcaagtggatgctttatacctttttattattcttgtgggtttggaaatagttaccaaaaaattattcttctataaaagaaccatttctgaatatagagcctgttagacataatagttttgtcatgcagttgaaccatgggaacaagttaaaggtccattctaagtttctcctttttatcatttttttgtttgtttgtatgttatgtatgattgaaacaacaatcatcaagcattcttccatttggtgaggtccatcacatcacattgatcaaacaacaaacaacaccattgttccatattatcatgtgttgagttcaaagatagacaagtttcctctctatctttcttaatagtttgacttgtttttcttgatctccctcaacctctaaatattggactatccttcatctagtca

SEQ ID NO: 348 - DNA, 2387 bp, Xanthium strumarium
tccggtggcggcggtggtggcggcggcggcggtggtggtggtggtggtggtggtgggtggtggaggttgctctctcctgaagcaaatgcagatgagaatcagtcatctgaatgggatacacatggtttgccagctgatattaatgtgcagttgaataagcttagtgggtttaaaaaatataaggtgtctgaattagtgttttatgataaggtgaagtctgtagttgtagggtcagacgattcgtttttcgaaatggtttcggttaaagggggcggggtttatacgaaagctcagttacagaaagaggttgaaaccctagctacttgtgggatgtttgagaaagtggatatggaagccaaaacgaatgcggatgggacgattgggttgaaggtgtcgtttacggagtctacttggcaagtggcgaatcggtttaagtgtattaatgtgggattgatgcaacagtcgaaagcggttgagtttgatgataacatgactgaaaaggaaaagatggattatatgaagactcaggaaagggagtataagagaaggatggagcgggcgaggccgtgtatgttgcccagggaggttcaaggggaggttttgcagatattgagacaggggaatgtgagtgctaggatgttgcagaatattagggatagggttcagaaatggtatcatgatgaaggctatgcctgcgctcaggttgtcaattttgggaatttgaatacgaatgaagttgtttgtgaggtggtcgaaggggatattactcgggttgtgattcagtttttagataaacttgggaatgtgtgtgaagggaacactcagatgggagtagtcagaagagaattgcctaaacagcttcagaaagggaaggttttcaacattgaagctgggaagcaagcattacgtaacattaattctctatctttattttcaaacatcgaagttaatccgcgcccggatgagaaaaatgagggtggaattattgttgaaattaagcttaaagaactcgagcaaaaatcagctgaagtcagtactgaatggagtattgttcctggacgtggtggccgtcctactttggcttcaatccagcccggtggaactgtatcttttgagcatcggaacatcaaggggcttaatagatctcttcttggttctgtgaccactagtaactttcttaatcctcaggatgatcttgctttcaagcttgaatatgtacatccttacttagacggtgtatctaatcctcgcaatcgcaccttgcgtacaagtgttttcaacagcagaaaactcagcccagttttcacaggtggacccggagtggatgaagttcctccaatatgggttgatagagctggcgttaaaaccaacattactgagaattttactcgtcaaagcaagtttacatatggaattgtaatggaagagataacaacacgtgatgaaagtagtcatattgcttcaaatggtcaaagggttttgccaagtggtggtattagtgctgatggccctccaacaacactaagtgggacaggtatagatcgaatggtatttgcacaagcaaatattacaagagacaacaccaagtttgtcaatggtgcaattgttggtgagagaaatgtgtttcagcttgatcaagggttggggattggcagcaaattcccaattttcaaccgtcaccaactaacaatgacaaagttcatccaactgaagcaagtagaagaaggtgctggcaaaccaccaccaccggtgcttgttcttcatggtcattatggtggttgtgtgggtgaccttcctagttatgatgcatttactctgggtggaccctactctgttaggggttacaacatgggcgagattgctgctgctagaaatatcctcgaggttgctgctgaattacgcataccagtgagaaatacacatgtatacgcatttgcagaacatgggaatgatctggggagttcaaaagatgtgaaaggaaacccaaccgaggtttacaggcgcatgggtcagggttcttcatatggtgttggtgctaaactagggttggttcgtgcagaatatgccattgatcacaattcagggactggtgccttgtttttcaggtttggtgagagattctaatcttcttttggtttcggtttttgcaactcggataaaaaaggttcttgtgtgagattcaaacctaagtatcgaatagaataataatatttttgctataatcaagttctgatgatctagacagacgactaatgtcttgaattgggtatgttagtgttttatcaagttgtgccttgtgatgttctattgacaagctactaatgttttgaattgtgtatgttgagttttattaagcaagaaactgtaaaagatgtgaaaattcttag

SEQ ID NO: 349 - DNA, 568 bp, Abutilon theophrasti
ttatcaaggacttctatggaagcccacttactgcaagtggtaagccttatgaccatatgttagtggctaaacttgaaagtgtctatactggttctggtgatcaaggttcctccatgtttgctgttaacatggaacaaggacttcctgtcatgcctgagtggctgtttttcaacagagtgaatgcccgggcaagaaaaggtgttgaaattggtcctgctcgccttcttttaagtttgtctggtgggcatgtggtgggaaatttttctcctcacgaagcatttgctatcggtggaacaaacagcgtgagaggttatgaagaaggtgctgtaggctccggacgatcttatgtggttggctctagtgaagtttctttcccagtgctggggcctgtggaaggagttatttttgctgattatggacatgatctatggtcaggccaaaatgtgcctggtgatcctgcgggggcaagatataagcctggaagtggatacggatatgggtttggcatccgagtggactcccctttagggcctttgagacttgaatatgcttttaacgacaaacaggc

SEQ ID NO: 350 - DNA, 800 bp, Abutilon theophrasti
gttgaaccaaaccaggagttccgtggattggtttgtgaaggagccaatgttctgccatcaaagtttcttgaggacgcttttcgtgatggacatggaaaagtggtaaatctcaagcgcttagatgaattaataagttctatcaatgggtggtatatggaccgtggtctttttggtttggtttctggagtggatattttttctggaggtattattaaggttaaaagttgcagaagcagaggtcaatgatatatccttacgattccttgatcggaagactggtgaaccaactaaggggaagacaaagccgacacaatacttaggcaactcactaccaagaagggacaggtgtatagtatgcttcaaggaaaaagagatgtggatactgtgtcaactttgggtctcatggcggatgtcagtatcattcctcaaccagctggggatgctggtaaagttgatttggtaatgaatgttgttgaacgtccaagtggtggtttttctgctggtggtggaatatcaagtgggattacaagtggacctttatcaggacttattggaagctttgcatattctcatagaaatttgtttggaagaaaccagaagcttaatgtttccttagagaggggccaaattgactctatattccgcattaactacacagacccatggattgaaggggatgacaagaggacgtctagaacaataattgtccagaattcaagaaccccagggacacttgtgcatggtaaccaacatgataatagcagtctgagcattggccgtgtaacagctggtgtagagtt

SEQ ID NO: 351 - DNA, 1170 bp, Abutilon theophrasti
ggtgtttgttctggcttttcttcagaggtaaatttctgaaaagtagcaccttaaatttagtttttattctaaatctgaatttcatatttttgggggaatatggcgaatgtttcagttatatgatttatgtataatatttgaatatgcagcatgctggtgcccgtgatgaaaaaggaaatccaattatcaaggacttctatggaagcccacttactgcaaggtctgcatgtctgaggcctggtgttgtgtagcttcgataagatctatttcacagcattaattttctgttactaggattttttcattcttataaccttgtaataaatcccccttttttaaatttaactctttatgtagtggtaagccttatgaccatatgttagtggctaaacttgaaagtgtctatactggttctggtgatcaaggttcctccatggttagcatctgcaccctgtgtttttcatcacttattgcatggacaggcctaacttctgttaccttggcagtttgctgttaacatggaacaaggacttcctgtcatgcctgagtggctgtttttcaacagagtgaatgcccgggcaagaaaaggtgttgaaattggtcctgctcgccttcttttaaggtattatgcttattgtttacttttttgcgaaaaatgaatgatacattataattcttatggtctatatttgggaggttaatcattaccggcaactctacttctcttaatttgttttctgaacttcaaatttctgtgtagtttgaccctgagcttcaatatttctccaaagatagaaattggagagaggaaggggtagagagttgtatagtttgctgacttgctctgttttttgattgctagtttgtctggtgggcatgtggtgggaaatttttctcctcacgaagcatttgctatcggtggaacaaacagcgtgagaggttatgaagaaggtgctgtaggctccggacgatcttatgtggttggctctagtgaagtttctttcccagtggtaggttcataaaaattccgcctcttctttgtcgttttcatgagtatcatgtgcaatgtgtgaggatgttgaataccttgcacctagcctactttttatggctcggctacggtacgatgaacatgtttcggagcaaaggttctgtttagcaagagtcctg

SEQ ID NO: 352 - DNA, 208 bp, Abutilon theophrasti
gaagcttccttcagtttctttatcgacacttgggtgtgcgtttacttaaataggcacactctctaacatacgtatcagactttttaatttgttagtattagaaaacatgaccagaaatgcttgtaattgtttcagtggtgaaccaaccaaagggaagacaaagcctgacacaatacttaggcaactcactaccaagaagggacaggtg

SEQ ID NO: 353 - DNA, 3991 bp, Abutilon theophrasti
tgatagagtggtagactgtttcttggagctggtacatgacactgtgactcaaattcttcgggtaacagcagcctaatgaagacactgaggctcctgctacagcagaacagtggctgctgtgtcttcatacatatgcattcacatatattgtcttttatatgaacagtgtggagttgggggcttggggcggttagtgtctttggcactattatactttttttccctgttaaaaacagttcaggagggttggaggtaaattgttcacattgtgctcccttctgcctgtgttagtatgtatccagaaaagcagagcacatggttgcttcatagagtgttgctaggaaaacttcatacaacgagataccatatggagtgagtaaaaggaaagatgttggttttggctggtgtttcacatgtgtcatagtttattcgttgtcatatagtttctgcttttgagcaatataagcctatatctgaagcatatatagaattgatttgactgaaactgggttcttgttgtataaggttgaaccaaaccaggagttccgtggattggtttgtgaaggagccaatgttctgccatcagtttcttgaggacgcttttcgtgatggacatggtaggttttccttttgcattgttaagtatggatgtatatacattttagatcatctgcttaaagatctgctttctaattttggtcatagtaggccttcattattcacttatggtgtcaagttctgcaggaaaagtggtaaatctcaagcgcttagatgaattaataagttctatcaatgggtggtatatggaccgcggtctttttggtttggttagtgctttgctttctttaatctggagctgtaaatgttctcttccttgatctttaaatatagtcatgtccaacaaactgttctttaatcttataggtttctggagtggatattttttctggaggtattattaggttaaaagttgcagaagcagaggtcaatgatatatccgtacgattccttgatcggaagacgtaagaacctcccttcagtttcgctttacccgcacttggggtgtgtatttacttaaataggggattttacaaacatgcatatcaaactttttaatttattagtgttaggacatgaccagaaatgcttcgatgttgtctcagtggtgaaccaactaaggggaagacaaagccggaaacaatacttaggcaactcacaaccaagaaggggcaggtgtgactctagatctagctatttgtacataaatggacatttaattgataacaagtcataaagatttgtacattctgatccaagagtatgcctatcgaaagcaaaatatatcctgactagcttgtattgcttcttttgaattatcatcctacaggtgtatagtatgattcaaggaaaaagagacgtggatactgtgtcaactttgtgtctcccggcagatgtcagtatccttcctcaaccagctggaggtaagtgaatgtatttttttaagactcgtgaatgcaaatactgcatattgtattctgaggcatgcgtagctggttaacaaaatgtttaagctaattcctggaaaatgtacttgttgtgcaatctcctcctgagtttttagtcaatgtttcatgctgaggaccttacctgatttaaagctgaatttcagacacataataatgttataacaagaatgtctacacctcaatggaattttattgtggaattttattatgggctaacattaaccataaatattatgcaaaaattgtgtgtaccctcagtattaccctaaagttacttggtcatattattatagactaaaaatagcactaaatagctcatgcagtgtcagcagcataagggaacaatcccattgcttgacaccccaatgaccaaggttcatatcctgttgatgtaattccccctctgccaattattaaaaaacacacacacaccaaatattattatggtgcttttgtgttaatattttgagtgcttgtccattattgttttgattgtgcaccattgtagatgccggtaaggttgatttgataatgaatgttgtggaacgtccgagtggccgtttttctgctggtgctggaatatcaagtgggtaagactagttgaattgcaatactgcatgtcctagcttctacctcacctaatttagttaccaaagttcatgcttattataccatggtatctctaaatgaacatttattgaatcaacttttaattttgtaggattacaagtgatcccttatcaggactctttggaaggtatgcttcttttctggctgattactttttccgttcatctttttctatccggagtttcttctaactagtgaagatgattgatatgtttgatctctgtgaatgtatctttccatgcttcggggagcaagttcaattattttatggaatgtaattcacattggttaatttattccattattcatcagaactgtgcattttttgttatcactctgcaaactgcaagcaggatttgttttcgggaataaatttgagtgaaaaagctaactcatagctgtttcttattatgttcctgtttctttggtgggtgctttcttatatgctactgtccatatatggtctgcttttgtcgctatgaatttcagtttgtctcgattctcccaattgttattgagataaataggagaggaatttatattttgctctatatatgttatggcatatgatatgctgtttatattgtctcatactctgttatttcccatttgcagttttgcgtacacacagaaaaatttggttggaaaaaaccaaaagcttaatgtttccttagagagaggccaaattgactctacatttcgcattaactacacagacccgtggattgaaggaaatgacaagcaaacatctcgaacaataactgcccaggtgggttttaaatttaagtttcgcatgattggaagattggttcttatctgagctattttgtttattttagaattcaagaagctctggaacacttgtgcatggtaaccagcatgataatagcagtctgagcattggccgtgtaacagctggtgtagagtttagtcgaccactccggccaaaatggactggaatggctggactcttttttcaggtacagcatgttatttcatttgatagcttgtttttttctagtcaggtgggtatctgttcttagtttttattgaaacaaagtttgtgaaaagagtgccgtaaatttagttttcattctgaatttgttactctcttttgggggattaaggcttatgtctcagttatatgatttgttttaatatttgatcttaatactctagcaagctggcattcgtgatgaaaaaggaaatccgattgttatagactcctatggcagcccacttacggcaaggtatgtatctttgatgcttgttgtatggcttctgtaaagatagattgctctgcattaattttctgttaatactttaatggtttatttgcttctaatcttgcgtgaaatccccttttcttaatgtagtggtaagtcgtatgacgatatgttactggccaaatttgagagtgtctatactggttctggtaacaaaggatcctccatggttagcatctgttcggcttttccctgtggatttccatcacttattatattgatgggccttagttctgttacctttgcagtttacaattaacatggaacaaggacttcctgtcatgcctgactggctgtacttcaacagagtcaatgctcgtgcaagcaaaggagttaaactcggtcctgctcgccttcttctaaggtattattcttattgtgtacaatgtactttcttatacacacggtgcaaaatgtggtagcttgcagctttattgtgttatatttgtattctgaacttttaagttttttcacagttgcttggttcgatgtagagcttcaatatttctccacgaaagcgcaattaacagagagagaaaggggaggaga

SEQ ID NO: 354 - DNA, 2398 bp, Abutilon theophrasti
tttctttctttctttagaattcaagaaccccagggacacttgtgcatggtaaccaaaatgacaatagcagtctgagcattggccgtgtaacagctggtatagagtttagtcgaccgctcaggccaaaatggagtggaacagctggtcttctttttcaggtacatgttacttcatcccatcgccttttttttgtcagctaggtttttgttctggcttttcttcaaaggttaatttctgaaaagtagcgccttaaatttagtttttattctaaatctgaatatgatatttgggggattatggcttattcagttatatgatttatgtataatatttgaatatgcagcatgctggtgctcgtgatgaaaaaggaaatccaattatcaaggacttctatggaagcccactcactgcaaggtctgtatgtctaaggcctggtgttgtgtacttgtgtagcttcattaattttctgttactaggattttttcattcttataatcttgtaataaatcccccctttttaaatttaaatctttttgtagtggtaagccttacgaccatatgttagtggctaaacttgaaagtgtctatactggttctggtgatcaaggttcctccatggttagcatctgtaccctgtgtttttcatcacttattgcatggacgggcctaaattctgttaccttggcagtttgcagttaacatggaacaaggaattcctgtcatgcctgagtggctgtttttcaacagagtgaatgctcgggcaagaaaaggtgttgaaattggtcctactcgccttcttttaaggtattatgcttattattaacgatacattataattcttatggtctatatttgggaggttaatcattaccagcaactctacttctcttaatttgttttctgaacttcaaagttctgtgtagtttgaccctgagcttcaatatttctccaaagatatagattggagagaggaagggatagagaattgtatagtttgttgacttgctctcttttttgattgctagtttgtctggtgggcatgtggttggaaatttttctcctcacgaagcatttgctatcggtggaacaaacagcgtgagaggttacgaagaaggtgctgtaggctccggacgatcttatgtggttggctctagtgaagtttctttccctgtggtaggtccataaaaattccacctcatctttgtcgttttcacaggtatcatgtgcaatgtgcaaggatgttgaataccttgcacctagcctagtttttatggctcggctacggtacgatgagcttgtagaattccattcattgttttattttatcatattttatttgttgttgtgtagctggggcctgtggaaggagttatttttgctgattatggacatgatctatggtcaggccaaaatgtgcctggtaaatcttttaactttattgtcaatcttcattttcatttcttgtttaatctgcttgtgaaatttatgtcctttaaacattctctcagtttcttatgaactgttggttttggttttccaggtgatcctgcgggggcaagatataagcctggaagtggatacggatatgggtttggcatccgagtggactcccctttagggcctttgagacttgaatatgcttttaacgacaaacaggcaaagaggtttcactttggggtaggccatcgaaactaaggagagaagtcacacttggagggtttgtccatcgaaaaccgacaacccttctgcttaatattcttcgatgttagttcacaattttgatgataaatgtctatatattttggagaaagattctggatcataaatgtccagatagattcatgatgcacgaaatatttattatagttgtagcgaagcaaagtaatgggtgatagaagagttcctttgattatttgagttgcatgtgaagtgagattaaaatacaaatccgaaatttgttgtgcatatgaaataatcttgttgttaaagaaaatattttgttataattaacacatagtataaagaggtgcattcatcatgttacctctattttacgggaagagctatttgaaataatgataaagaaacccagtggtagagtgataaaaacacatcaaatgttaaaagcaacttgttgcctcgttcattcataatattgttaaaagctcaaaattatggggagccaaagagattaggcaaagccagcaaaatgcacttcttgatcttatatagatatctattaaaattttaaacagtaatggacttccaccaagtctaaaaagggcaatcaaaattgaaccttgcagggtctaccatcctgcattcttctgttatttcctactctatgagagaagcagctgctgagtgtcggaacttatagagccatcccccgagattc

SEQ ID NO: 355 - DNA, 1497 bp, Abutilon theophrasti
tctgatcgaagaagagtgcttgtggagagcacaatttgtcctcactatcttttgtttctcccctttaactatcctcctacaggtgtatagtatgcttcaaggaaaaagagatgtggatacagtgtcaactatgggtctcatggcggatgtcagtatcattcctcaaccagctgggggtgagtgaatatatcttttaatgaagcttgcaaaaaattgcatgtcttgttctgaggtattcttagctggttgagaaaatgcttaagctagttcctgaaaatgtatttgatgtacaatctccttgtgagttttcggttgattgttttatgctgagaaccttacctgataaatgctgcgttttcaaagtaagcttttgaacattccaattttttgtccaaaatactcccatacttgttctgtttttggcgaaggtttcttgtaattttttataatatatcatcctaagaaactttcaatgttttcaagaatgcattttctttgtaatagtttggaagtaaagatgttaatgttttgtcagagcttttctatgtatttattttttcatgattgtcaacatggtagatgctggtaaagttgatttggtaatgaatgttgttgaacgtccaagtggtggtttttctgctgggggtggaatatcaagtgggtaagtcatgctagtttaaattgcagtcttagatgttctagcttatctccttgcctaatttagtttcctaagtccatacttatatctgtgggatgtttgaaattatatttatgcaagtaatctgtaattttgtaggattacaagtggacctttatcaggacttattggaaggtaacattgcatatttagtttcttgctggttcccttttttttaatatctttcaccatcaattcacttgatttgtgcatacagataataagtttcatatcattgaacttttcatgcttttgggagcaaattccatttttgaattggatgaatttacattgtagatttattcatcactcgcacatatcagaagtgtgcagtatttgttattacattataatacaagcagggatgttttctggaataaatttgattgaaaatgccaagcaacagataggttttgctgttctttcgtaccctttcattttgtaaattaaaatggctttgcatgggctgtgagagtccacatcaattccgttaattgtcaatcttgtggagtgtggtttcttatttctcagtgttctcatcgagtgataatgtccattgtaattgataccgtgaagttgctctcttggggttgcatttttcagaaccagggtactccggtactgatagagaatcatatttgtattgatgatttcattggatgcttttatgtttccttttcatcttggcttcttattttattcctctttcttcggtgaaattttcttacatggtacagcatattttgtcttgtaatgttactgcttatcttgtctcatgtgttatttccaatgtgcagctt

SEQ ID NO: 356 - DNA, 798 bp, Abutilon theophrasti
tcaggagggttggaggtaaattgtccacattgtgctcccttctgcctttgttagtatgtatccagaaaagcagagcacatggttacttcatagaattttgctaggaaaacgtcatacaacgagataccatatggagtgagtaaaaggaacaatgttggttttggctggtgtttcacatgtgtcatagtttattcgttgtcatatagtttctgcttttgagcaatataagcctatatcttaagcatatatacaactgatttgactgaaactgggttcttgttgtataaggttgaaccaaaccaggagttccgtggattggtttgtaaaggagccaatgttctgccatcaaagtttcttgaggacgcttttcgtgatggacatggtaggttttccttttgccttgttaagtatggatgtatatacattttagattatctgcttaaagatctgctttctaatttcggtcatagtaggccttcattatatgatatcacttatggtgtcaagttctgcaggaaaagtggtaaatctcaagcgcttagatgaattaataagttctatcaataggtggtatatggaccgtggcctttttggtttggttagtgctttgccttcttgaacctggagctacaaatgttctcttccttgatctttaaaaacaatcatgtccaacaagctgttctttgatcttataggtttctggagtggatattttttctggaggtattattaggttaaaagttgcagaagcagaggtcaatgatatatccgtacgattccttgatcggaagacgtaag

SEQ ID NO: 357 - DNA, 2628 bp, Abutilon theophrasti
gaaagacgtaagaagcttccttcactttctttatccacacttgggtgtgcgtatacttaaataggcacactctccaacatacgtatcaggcttttaatttgttagtattagaaaatatgaccagaaatgcttgtaattgtttcagtggtgaaccaaccaaagggaagacaaagcctgaaacaatacttaggcaactcactaccaagaagggacaggtgggaccctaggtctagctgttattacatgctaggtgtttaattgatgataagtctcaaaggactgtctattctgatcgaagaagagtgcttgtgcagagcacaatttgtcctgactatcttctattgctcccctttaactaacctcctacaggtgtatagtatgcttcaaggaaaaagagatgtggatacagtgtcaactatgggtctcatggcagatgtcagtatcattcctcaaccagctggaggtgagtgaatatatcttttaatgaaagcttgcaaaaaattgcatgttgtgttctgaggtattcttagctggttgagaaaatgcttaagctagttcctgaaaatgtatttgatgtacaatctccttgtgggtttttggttgattgttttatgctgagaaccttaccctgataaatgctgcgttttcaaagtaagcttttgaatataccaattttttgtccgaaatactcaggtttcttgtaaattttttttaatatatcatcctaagaaactttcaatgttttcaagaatgcattttctttctaatagttcggaagtatagatgttaatgttttgtcagagcttttcgatgtatttatttgtccattattgttttgattgtcaacatggtagatgctggtaaagttgatttggtaatgaatgttgttgaacgtccaagtggtggtttttctgccggtggtggaatatcaagtgggtaagtcatgctattttaaattgcagtactagatgttctagcttatgcccttgcctaatttagtttcctaagtccatatttatttatgggatgttttaaattatatttatgtaggattacaagtggacctttatcaggactgattggaaggtaacattgcatatttagtttcttgctggttccctttttctattatctttcaccatcgattcacttgatttgtgcatacagataataagtttcatatcattgaacttttcatgcttttgggagcaaattccatttttgcattggatgaatttacattgtagatttattccatcacttgcacatatcagaagggtgcagtatttgttattacactataatacaagcagggatgttttctggaataaattcgagtgaaaatgccaagaaacggataggttttgtcgttccgtaataccctatcattttgtgaattaaattggctttgcattggctgtgagagtccacatcaattcctttaattgtcaatcttgaggagtgtggtttcttatttcttagtgttctcatcgagtgataatgcccattgtaattgataccgtaaagttgctctcttggggttgcattcttcagaatcagggtactccggtactggtagagaatcatatttgtattgatgattttattggatgcttttatgtttccttttcatcttggcttcttattctattcctctttcttgggtgcacattttcttacatgctacagcatattttgtcttgtaacgttactgtaagccttcaacgtttctggatttctgccctattatcatcgagacaaaaaggagaaagtctgctatatttatgtgatgacaggtgttatcctgcttatcttgtctcgtgttatttccaatgtgcagctttgcatattctcattagaaatttgtttggaagaaaaccaaaagcttaatgtttccttagagaggggccaaattgactctatattccgcattaactacacagacccatggattgaaggggatgacaagaggacgtctagaacaataattgtccaggtaggtttttttgttcatacttacgaatgattgaagattgattactatcttgagcttttctttcgttccttctttagaattcaagaaccccagggacacttgtgcatggtaaccaacatgacaatagcagtctgagcattggccgtgtaacagctggtatagagtttagtcgaccactcaggccaaaatggagtggaacggctggtcttctttttcaggtacatgttacttcatcccatagcctttttttgtcagcttggtgtttgttctggcttttcttcaaggttagtttctgaaaagtagcgccttaaatttagtttttattctaaatctgaatttgatattttgggggattatggcttatgtttcagttatatgatctatgtataatatttgaatatgcagcatgctggtgctcgtgatgaaaatggaaatccaattatcaaggacttctatggaagcccacttactgcaaggtctgtatgtctgaggcctggtgtcgtgtagcttctataagatctatttcacagcattaattttctgttactagtacttttccattctaataatcttgtaataaatccccctttattaaatttaaatctttatgtagtggtaagccttacgaccat

SEQ ID NO: 358 - DNA, 803 bp, Amaranthus graecizans
caaaaatccccaaattcccttctttcaccttccattttcttctcaatcccaaaataccaacctctcacaatcgaaattctcaaccacccacttcataaattccatttttctccctaaaaaccccaacaagtttcaatttatatcaccgccattgttatcgtgctcttcaacattatccctgagtcgacccacgaactcaactcagtccaaaaacccttcaatttccttctgtcaatccctaaattctgctctcttacaagccaaattctcaattacccagttcattaatggcatcaaactccacgtaaaccccatgaagtttcaatcttccccatcaacattgctatgctcttcaacattgtctttgaacgagtcaactcagcctccatccggaagtggtagtgtggttgaggttactcaatcgaaatcggcttcagtgagtcgtactcgaagggaggatgaagagagagtgttgattagtgaggtgttagtgaggagtaaagatggagaagaattagagaggaaagatttggaattggaggcattaatggcattgaaagctagccgagcgaattcagctttgactgtgcgagaggttcaggaggatgttcatagaattattgatagtgggtatttttcttcatgtatgccagttgcagtggatactagagatggtattagattggtctttcaggtagaaccaaaccaggagtttagaggactggtgtgcgaaggagctaatgttctcccatccaagtttgtagaggattcatttcgtgatggatatgggaaagtggtcaata

SEQ ID NO: 359 - DNA, 1367 bp, Amaranthus graecizans
aagtgattgattctatcaatggatggtacatggagcgtggtctttttggcatggtttctggtgttgagatcctttcagggggtatactaaggttacaaatttctgaagctgaggtcaatgatgtttcaatccgcttccttgatcgtaagacacgtgagccaaccgtggggaagacaaagccagaaacaatacttcgacaacttacaacaaaaaaaggacaggtatacagtttgaatcaagggaaaagggatgttgagactgttttgacgatgggaatcatggaagatgtaagcattttcccccagcctgctggagatacaggtaaagttgatttggtaatgaatgtggttgagcgtgtgagtggaggtttctcggctggtggtggtatttcgagcgggataacaagcggaccgctgtcaggtttaattggaagctttgcatattctcacaggaatctgtttggaaaaaatcaaaaagtaaatgtctctcttgagagaggccaaatcgactctatcttccggataaattatacagtcccatggattgaaggtgatgataagcgtacacaaaggtcaatcattattcagaactcaaggactccgggtactttggtccatggtaatcaacctgaaaatagtaacttaactattggccgtgtaacagctggcattgaatttagccggcccctaagacccaagtggagtggaacagctggacttacgtttcagcatgctggtgtccgtgatgaacaagggaaccccgttataaaagatttctacaacagcgctcttacggcaagtgggaatactcatgataatatgctgcttgccaaaggtgaatgtgcctacacgggtgacttaggatcctcaatgttagtcttaagcatggaacaaggtcttccgatctatcctgagtggctgtgttttaatcgagttaatgctcgtgccaggtcaggggtggacatcggtccagctaatctttttctcagtttgtctggtggtcatgtggtcggtaaatttcctcctcatgaagcgtttgcgatcggtggtacaaatagtgtgagaggatatgaagaaggtgccgttggctcaggtctttcatacgtagtgggctgtggagaagtttccttccctctgtatggtccagtagatggcgctctttttgctgattatggaacggatctcggatcaggtttatctgttcctggtgatcctgctggtgtgagattaaaacctgggagtggatacggttatggatttggtatccgagtcgagtctccattaggtcctctacggttagaatatgcatttaacgacagacaagcgaggcggtttcattttggcgttggtcatcggaactagcagttc

SEQ ID NO: 360 - DNA, 471 bp, Amaranthus hybridus
ggagctaatgttctcccatccaagtttgtagaggattcatttcgtgatggatatgggaaagtggtcaatatcagacgtttggatgaagtgattgattctataaatggatggtacatggagcgtggtctttttggcatggtttctggtgttgagatactttcagggggtatactaaggttacaaatttctgaagctgaggtcaatgatgtttcaatccgcttccttgatcgtaagacacgtgagccaactgtcgggaagacaaagccagaaacaatacttcgacaacttacaacaaaaaaaggacaggtatacagtttgaatcaagggaaaagggatgttgagactgttttgacaatgggaatcatggaagatgtaagcatttttccccagcctgctggagatacaggtaaagttgatttggtaatgaatgtggttgagcgtgtgagtggaggtttctcggctggtggtggt

SEQ ID NO: 361 - DNA, 1071 bp, Amaranthus hybridus
ctctatcttccggataaattatacagtcccatggattgaaggtgatgataagcgtacacaaaggtcaatcattattcagaactcaagaactccgggtactttggtccatggtaatcaacctgaaaatagtaacttaactattggccgtgtaacggctggcatcgaattcagccggcccctaagacccaagtggagcggaacagctggacttacgtttcagcatgctggtgtccgtgatgaaaaagggaaccccgtcataaaagatttctacaacagcgctcttacggcaagtgggaatactcatgataatatgctgcttgccaaaggcgagtgtgcctacacgggtgacttaggatcctcaatgttagtcttaagcatggaacaaggtcttcctatctatcctgagtggctgtgttttaatcgagtcaacgctcgtgccaggtcaggggtggacatcggtccagctaatctttttctcagtttgtctggtggtcatgtggtcggtaaatttcctcctcatgaagcgtttgcgatcggtggtacaaatagtgtgagaggatatgaagaaggtgccgttggctcaggcctttcatacgtagtgggctgtggagaagtttccttccctctgtatggtccagtagatggcgctctttttgctgattatggaacggatctcggatcaggttcattggttcctggtgatcctgctggtgcgagattaaaacccggtagtggatacggctatggatttggtattcgtgtcgagtctccattaggtcctctacggttagagtatgcatttaacgacagacaagcgaggcggtttcattttggcgttggtcatcggaactagcagttctttcctgttcatttggtagcttacatgtaattatcaaggttttgtcctaaagaaaatagaaattgtaagtggctaagtgcagtcctgttcctcccctttttgtttgcttggtgtacaattgatgagatgatgatgattgatttgattcagtatttacctgtaaaaaggtcaacacattactgtaatgaattctgttctataagtacatactg

SEQ ID NO: 362 - DNA, 694 bp, Amaranthus lividus
taaaagatttctacaacagcgctcttacggcaagtgggaatactcatgataatatgctgcttgccaaaggcgagtgtgcctacacgggtgacttaggatcctcaatgttagtcttaagcatggaacaaggtcttcctatctatcctgagtggctgtgttttaatcgagtcaacgctcgggccaggtcaggggtggacattggtccagctaatctttttctcagtttttctggtggtcatgtggtcggtaaatttcctcctcatgaagcgtttgcgatcggtggtacaaatagtgtgagaggatatgaagaaggtgccgttggctcaggcctttcatacttagtgggctgtggagaagtttccttccctctgtatggtccagtagatggcgctctttttgctgattatggaacggatctcggatcaggttcattggttcctggtgatcctgctggtgcgagattaaaacccggtagtggatacggctatggatttggtatccgtgtcgagtctccattaggtcctctacggttagagtacgcatttaacgacagacaagcaaggcggtttcattttggcgttggtcatcggaactagcagttctttcttgttcatttggtagcttacatgtaattatcaaggttttgtcctaaagaaaatagaaatagtaagtggctaagtgcagtcctgttcct

SEQ ID NO: 363 - DNA, 560 bp, Amaranthus lividus
taacattcccttctttcaccttccattttcttctcaatcccaaaataccaaccctcacaatcaaaattctctactacccacttcatagattccatttttctccctaaaaaccccaacaagtttcaatttatatcaccgccattgttatcgtgctcttcaacattatccacgagtcgacccactaactcaactcagtccaaaaacccttcaatttccttctgtcaatccctaaattctactctcttacaagccaaattctcaataacccagttcattaatagcatcaaactccacgtaaaccccgtgaagtttcaatcttccccatcaacattgctatgctcttcaacattgtctttgaacgagtcaactcagcctccatccggaagtggtagtgtggttgaggttagtcaatcgaaatcggcttctgtgagtcgtactcgaagggaggatgaagagagagtgttgattagtgaggtgttagtgaggagtaaagatggagaagaattagagagaaaagatttggaattggaggcattaatggcattgaaagcttgccgggc

SEQ ID NO: 364 - DNA, 523 bp, Amaranthus lividus
cagtttgaatcaaggtaaaagggatgttgagactgttttgacgatgggaatcatggaagatgtaagcatttttccccagcctgctggagatacaggtaaagttgatttggtaatgaatgtggttgagcgtgtgagtggaggtttctcggctggtggtggtatttcgagcgggataacaagtggaccgctgtcaggtttaattggaagctttgcatattctcacaggaatctgtttaggaaaaaaatcaaaaagtaaatgtctctcttgagagaggccaaatcgactctatcttccggataaattatacagtcccatggattgaaggtgatgataagcgtacacaaaggtcaatcattattcagaactcaagaactccgggtactttggtccatggtaatcaacctgaaaatagtaacttaactattggccgtgtaacggctggcatcgaattcagccggcccctaagacccaagtggagcggaacagctggacttacgtttcagcatgctggtgtccgtgatg

SEQ ID NO: 365 - DNA, 2010 bp, Amaranthus palmeri
atgttatccctgagtcgacccactaactcaactcagtccaaaaacccttcaatttccttctgtcaatccctaaattctactctcttacaagccaaattctcaattacccagttcattaatggcatcaaactccacggaaaccccgttaagtttcaatcttctccatcaccattgctatgctcttcaacattgtctttgaacgactcaactcagcctccagccggaagtggtagtgtggttgaggttagtcaatcgaaatcggcttcagtgagtcgtactcgaagggaggatgaagagagagtgttgattagtgaggtgttagtgaggagtaaagatggagaagaattagagaggaaagatttggaatcggaggcattaatggcattgaaagcttgccgggcgaattcagctttgactgtgcgagaggttcaggaggatgttcacagaattattgatagtgggtatttttcttcatgtatgccagttgcagtggatactagggatggtattagattggtctttcaggtagaaccaaaccaggagtttagaggactggtgtgcgaaggagctaatgttctcccttccaagtttgtagaggattcatttcgtgatggatatgggaaagtggtcaatatcaggcgtttggatgaagtgattgattctataaatggatggtacatggagcgtggtctttttggcatggtttctggtgttgagatactttcagggggtatactaaggttacaaatttctgaagctgaggtcaatgatgtttcaatccgcttccttgatcgtaagacacgtgagccaactgttgggaagacaaagccagaaacaatacttcgacaacttacaacaaaaaaaggacaggtatacagtttgaatcaagggaaaagggatgttgagactgttttgacgatgggaatcatggaagatgtaagcatttttccccagcctgctggagatacaggtaaagttgatttggtaatgaatgtggttgagcgtgtgagtggtggtttctcggctggtggtggtatttcgagcgggataacgagcggaccgctatcaggtttaattggaagctttgcatattctcacaggaatctgtttggaaaaaatcaaaaagtaaatgtctctcttgaaagaggccaaatcgactctatcttccggataaattatacagtcccatggattgaaggtgatgataagcgtactcaaaggtcaatcattattcagaactcaaggactccgggtactttggtccatggtaatcaacctgaaaatagtaacttaactattggccgtgtaacagctggcatcgaattcagccggcccctaagacccaaatggagcggaacagctggacttacgtttcagcatgctggtgtccgtgatgaaaaagggaaccccgtcataaaagatttctacaacagcgctcttacggcaagtgggaatactcatgataatatgctgcttgccaaaggcgagtgtgcctacacgggtgacttaggatcctcaatgttagtcttaagcatggaacaaggtcttcctatctatcctgagtggctgtgttttaatcgagtcaacgctcgtgctaggtcaggggtggacattggtccagctaatctttttctcagtttgtctggtggtcatgtggtcggtaaatttcctcctcatgaagcgtttgcgatcggtggtacaaatagtgtgagaggatatgaagaaggtgccgttggctcaggcctttcatacgtagtgggctgtggagaagtttccttccctctgtatggtccagtagatggcgctctttttgctgattatggaacggatctcggatcaggttcattggttcctggtgatcctgctggtgcgagattaaaacccgggagtggatacggctatggatttggtatccgtgtcgagtctccattaggtcctctacggttagagtatgcatttaacgacagacaagcgaggcggtttcattttggcgtaggtcatcggaactag

SEQ ID NO: 366 - DNA, 14202 bp, Amaranthus palmeri
aattaaaacaatagaaaaataaaaatttaaaaactaaaatcaaaattataaaaataaaaaatttaaatataaaatttctaaaattaatttttttttaaaaaataagtttttatgatccattcataatgaagattgaagagagtaggaatagaagttttaaaaccaatgaagattgaagagagtagaaatagaagtcttaaaacctagtccatactattttagtgtgaaccaaattcacacaagagattctctttattttaggagtgtatatgatgagtttaattaaagtgattacttatacttataacctcaacgcggtgacttcaaaaccgtgaagcagaggatgaaagataaccatttccattacaacttacaagcaaagaaacggttacatgagtgtttagtatactaaaacaattgtttttttttattaactttttaccttgttttccttaaaaaaaaaaaactctttaccttttttgtttctaaatttttaaccgtttttataatttttttaataaaaaatagaaaatgatctgagcgatattaaatcgtctcacggtataacagtttgtcaaattctttacatttacaagtcaggatgcacatagttcactcatccacttaaaccaattaataaataaactaaataactaatattctaattcagtttgaatttcaatttttagtttttagttaatttcaacctaatccaaacaaaaaaattttacttttacattccaaacataatttttattggatttggagcggtttgattttcaatatttatgccaataataataattcagaagatgagtgatctatagcaaagaccgtctagagtaaaatttgtgataatcattttaaccttgaacaagaatacaagataataggaaaagggaaaaaccctcccccaagggccaaaaaccctatatcaatgatgattgatgaagtatcaaagaacaataatattcagaaaatttctttgcttcaaacttgtaattctcccttctccatttctcaatcaaacaatgcccagaaatgacgacgttcagttcttatcatcctccattaatctttcttcaatcaaaaatccccaaattcccttctttcaccttccattttcttctcaatcaaaattctcaaccacccacttcataaattccatttttctcccaaaaaatctcaacaagtttcaatttatatcaccgccattgctatcatgctcttcaatgttatccctgagtcgacccactaactcaactcagtccaaaaacccttcaatttccttctgtcaatccctaaattctactctcttacaagccaaattctcaattacccagttcattaatggcatcaaactccacggaaaccccgttaagtttcaatcttctccatcaccattgctatgctcttcaacattgtctttgaacgactcaactcagcctccagccggaagtggtagtgtggttgaggttagtcaatcgaaatcggcttcagtgagtcgtactcgaagggaggatgaagagagagtgttgattagtgaggtgttagtgaggagtaaagatggagaagaattagagaggaaagatttggaatcggaggcattaatggcattgaaagcttgccgggcgaattcagctttgactgtgcgagaggttcaggaggatgttcacagaattattgatagtgggtatttttcttcatgtatgccagttgcagtggatactagggatggtattagattggtctttcaggtagatagatactatttttccagagttaaaatgttgagttttttaatttaatttaatggatatttatatgattgaatgtttatttttcgacatgggaaatttaattggtgtcattttgaatgtgattggttagaaattgaattttaagctgtctgtctttaggaatgcactctattgttgagcctttgaaagtgtaggattggtgaaagatgactaatctttgaaaaatttctatctaaagcttatttatgtgaagttgcatataatatgtgctacaagggtcaatcagaaacaatctttttgactgatttatcattaataagatacaattaaggctgtgtacattcgatcctctccaaccccaccctaggtgaaagccacctaatagcattgggtaatgcaatgttgttgttgtgttgttttttgaaaattaggttaaaagaggttgaatttactctgccattaggattataagtgcaaataggattttatggattgaatggagtattgtgtagtagggaattcaaataatccaaccgcatatgtggtttcgttgtagcatcatcccatagtacaaaaggaagggcaaggaaccacagagactaggggagatataggggtttataacaccatataactttggtttaaaaacgatgggaaaaataattacataatcatcatttgccaagaaatctattcaagttttcttgcaactaaacacattactgtactctgctatcatctgtaacctgaattcgagaatttttctgaatatctctgcattttgttttcaagaagataattgcacggtcctggtgaatatgctgccatgatggaatgtagatgcttttcttttcttgagatagctactttgtttaatttactctattttgtccaacaaggtagaaccaaaccaggagtttagaggactggtgtgcgaaggagctaatgttctcccttccaagtttgtagaggattcatttcgtgatggatatggtagttctcctgtattattgttgctagagtttgtgaattactaaagcctttcctctattaatttgaactttttcatcaagctgtgcagggaaagtggtcaatatcaggcgtttggatgaagtgattgattctataaatggatggtacatggagcgtggtctttttggcatggttaatatctgaatttcttttctatgctgaatgttttagtcctatcctgtatgcttagctaccccttatggcttgaaatgcaatgttttgtaacagagattcattgttctgttactacaggtttctggtgttgagatactttcagggggtatactaaggttacaaatttctgaagctgaggtcaatgatgtttcaatccgcttccttgatcgtaagacgtaagttccaacctattatttttgctactcagctgatacaacatgctattgcctcaatgtcaagtatttaatttactatatcttgttaagacaaaaaaggctaacaaaaaagtggagtcgatcaatatgggctctaatgattatattttgatataacaaccccggttcattaatgacggttcaactgtttattctatttgcataattagacgtgagccaactgtcgggaagacaaagccagaaacaatacttcgacaacttacaacaaaaaaaggacaggtagtattaagtggtttccgttgcattaagtgatgttgcactttctttgatgttttaatgtaaatttttagattgggatgctgctgagagaaaacagtttttccgcttctcgacgttataaatcatacgcatgcttgcacacattggctttcgaaccaccttgtttgctataatttaagcttgagaacttaattccttttacttgatagataaaggcattaggctacgtttttatagacaaatgaaccagtagtaatgtgatgtttgtaaaaagagatataatgcttcgccagtatcaaaaattgagtttcaacattcaagcttacttgctaaattgtgatctcttaggatttttattattgattttttttttcactgatgatattcattttcaatattgattttccaccataaatatctttggtatgatttttatattttgaaatatgtacaaacttcacagctgacagtgtggtggggtctgatgtggcctgcaaacttttttttgcaggtatacagtttgaatcaaggtaaaagggatgttgagactgttttgacgatgggaatcatggaagatgtaagcatttttccccagcctgcaggaggtactataagctgcactacattctttttacaacggacttaaaattctggtttttccatgttattttcttgatgattaggttttaatctttgttgtccgattcaatttatgttcaaaaagtatcacttgcatggtttcttcaaataatcctttctagattttttttcagtcaactaaaacagtgaggtttttaaatctatggacccttacaaatgctaatgtttactgaggtttctgtggaatggcaaatgaaaacatattaaattatatcacaaggaaccatacttctttgtcttctttgtttttggttaacatttcatactttttcagagattgtccctatatatatgttggagaaatgcattttatgttggatggaatgtggattttggcttttatctggatttatcttattactaatatctttcttttacttctggctttagatacaggtaaagttgatttggtaatgaatgtggttgagcgtgtgagtggaggtttctcggctggtggtggtatttcgagcgggtaagaaaagacgatgttatgatcacatgatggtctacggaatcacttctatcatagtttcttttggttttgtggtgtttattctgattcactatggttttatatgcatttacaggataacaagtggaccgctgtcaggtttaattggaaggtactattttgtctctttatttgttttagagaagatttttcattcaggaatacttgtcttagtgatgtaaagccccctagaaaagttggtcatcaattatatgttgttaaagtatgatgatgctccacgagatacaaacaagtgaaagagaaaagcttttgaagttcacaaaataaagttgaatctcttagtattttgtcctctcagtctttaactcacgactcttcaccttctgtttgagttttcatatgtcttaggttgataccaagatacaaatagtcagaaaactcttatattagcttgcaattctcttgctaacttttgtgtttactgcatgcggttggttgaggctctgtttgctcatttggagatgtatatcattccctttcctgtgtatattgagataaatgagggggttcctgtgtattttatctggaattatataaagctttagcatttgtactttgcctttaaaatggaatacgtgaataatctcatcgctgccacaaaccatgcaccaccatacgtaggccttagccatctaaaagctcaagatgaggataaaggcacttcacttgcacatcctttccactatatgtagccttctaaaaaagctgaagatgaggacaaagccactttaataacttacacatcattttcgttgtattgcaaaatttcaagttacactcttaatcaacaaataagaacagattattaaggtccttgtgtgttgggtgtctgatatggaaggaagaaaagaactttttatgtgaaaaagatagtgaaagtccggaaggtggtcgtttttgcggtgatgtagtggtggcattttggtggtgtcagatatgagggaacaaagggtagtagatggaataacggactaagcatttgagctagaaataggaagatggtggaggttgggaatcggttgttgggaaaggagggagggtgtcgccgtgctggtgggtttcttttagacctggttggttatttttacctatgtgcttgtcaaatagttgtacgttttccttgtcgaaagtgggctgtggtatttataaaagttacctagaacagctggttgatgatcaattaggcgacttatggaatgtcaatgaatggttcctgttggaaataggttgttgatcttcattttatttggctagggtgacgatttgaaaaggtaatagaagtttggaaggaaaaaattggctatttagaattggtattatcccacttctaatagttcaataaacatggaggatgactgatgcattatatgctgttgaagtgcgctggagatccacaacataaataagtaaatgagagcagctttgaagtttacattacaaagtcaaacctctgaggagttttcttctggttgtcaaacacagggtagttcttttggttaagctttcatgtgttaggctgattcattgaaagaaactggccaaaaattcctgtgtagcttgtgtctttcttatgcatacctcggcggtcattgcattttgttttaggcatcatatcccactcctatttgcacatttggagctgtttttcctctataatttgagggaagtaaggatgcagttcgtagatcttttattaggcatcatattgatcttatagtaatcatagctagccttcaagatggaacatatgaatgatctcatcactttcttatacaacattgcattaccctaatgctatcaagtggctcccatctaggagaggttgaaggggtcgatgtaggcaacctttgatgcttgattgcaaacattatatgtaacttcaattgaataagaacacacgacgtttgggctgttactatgggttatgattagacctgtgcaatgggccggataagggttggatcgggttcacatggaaacgggccgggtcttgtaaattgaaatatggattttaaatgggtcgggctattaaactcggcccggcccatttattataatttattgattaaatggcaaattaatttataaaattgactgcatctgcatctcacaaataatacttcatgaaaaattaatttataaaactgtaagaattaagtaagtctatagctcctgattcgtaagtcttggtggaaaaacaagcatatgaagtatattctattccttacaactacacattaaatgctccatcatgaataatttatgcttcaacttgaagattgcaaacccttccataaacttactggagagattgggatcgatgatagaaatttcataaaattaaaccagttatagtacttcgaacaattaaaccaatttcattgatacaaacattatttacttgagtgataccttaaagaaaagagaaattaataattatgtgtttgtgaattaggaaatatttttagggttattaatttggaaatttaagtttataatttggggaaatttttatctgatttgtaacttgagagaagagggagaattgtaagagagtttgagggagaatgatgtgtgaggttgagattcagaagaatataccagagaagaagaatcaaacccttttcagatttgaagaacccatatacaacccttgtgtagaacccttatccagcccatttattttaacttgtataaggcccgtttggagcccaccccgttttcaacccttgttatagtgggttggatcaagggccccaatggaggcctagcccgttgcacaggtctagttatgatcaaaatccaaaaacaatattaaccatacaataaatattgactggtggatcaaacttttcaggttagatgtcagcttaatcatgtgcacttctcttttatgttaagttacatatgttttaggtttattggaagcacctctttattttcacaagggtcaggttttgtacattcgatcccctaacctagccaagatatatgaaaaccacttaatgacattgcgggactgaaatggtgttgaagtcaaagcttttttggtgacttcttactcatttatcttttggttctagatgtttagatgcttttgatgtgcttgtatagttgtatgggagcctaatttctctaagatgtactgtttgtagaaactaattgttttctttctgtatgaccttttgattctcactagacgccttttcttgcatatggctgcagctttgcatattctcacaggaatctgtttggaaaaaatcaaaaagtaaatgtctctcttgagagaggccaaatcgactctatcttccggattaattatacagtcccatggattgaaggtgatgataaacgtacacaaaggtcaatcattattcaggtgatatgcgaacaacttttttatattcttctcagatgaaaagagtgctgctgtaacggttctctaagttgatttttttattgctcgttcagaactcaagaactccgggtactttggtccatggtaatcaacctgaaaatagcaacttaactattggccgtgtaacggctggcatcgaattcagccggcccctaagacccaagtggagcggaacagctggacttacgtttcaggtatcttcgatgtagctttgagctttttggttgtggaaatggatttgggtcgttgaacattgtgtagtaaacttacatgagttgttggctacaatcatcctgacaatttgacattattcccattaatgcagcatgctggtgtccgtgatgaaaaagggaaccccgtcataaaagatttctacaacagcgctcttacggcaaggtgtatattttttggaaacatcagctttgcttgaattctgagattcctatttgcttgtgctttctgttgtatttgatgatggatatttttgtgtttagtgggaatactcatgataatatgctgcttgccaaaggcgagtgtgcctacacgggtgacttaggatcctcaatggttagttttcagttggaaataattgcaaacttttcgtgcatattctcttctgcttatatgaatcgtttatgcagttagtcttaagcatggaacaaggtcttcctatctatcctgagtggctgtgttttaatcgagtcaacgctcgtgctaggtcaggggtggacattggtccagctaatctttttctcaggtttgttgtattcctaacatcccaatatccttgttttgcataggaatgcttctagctgaacagaatttcacttgacatttttttgtgtttttctcgcacaaaaatactggtttttcagtttgtctggtggtcatgtggtcggtaaatttcctcctcatgaagcgtttgcgatcggtggtacaaatagtgtgagaggatatgaagaaggtgccgttggctcaggcctttcatacgtagtgggctgtggagaagtttccttccctctggtacctcaaattctcatctttgtgctttttagtttttgatgtaatgtaaagcgcaatagaaagggattcgtttgagcatatgtttattaacaagctgcatttgcatcatatatacatgtacttgactacttgaaaacaatattcgtttgcagtatggtccagtagatggcgctctttttgctgattatggaacggatctcggatcaggttcattggttcctggtatgtacatctttaactattactattattcaactttaaactaacaaagttttcatggcgtggtacaatgcaatctgagtgatgaccttatttatttatctatttaaaaggtgatcctgctggtgcgagattaaaacccgggagtggatacggctatggatttggtatccgtgtcgagtctccattaggtcctctacggttagagtatgcatttaacgacagacaagcgaggcggtttcattttggcgttggtcatcggaactagtagagttctttcctgttcatttggtagcttacatactacttatcaagtttttgtcctaaagaaatagaaatagtaagtgcagtcctgttcctccccttttcgtttgcttggtgtacaattgatgagatgagatgatgatgattgattgatttgattcagatttacctgtaaaaaggtcaacacattactgtaatgaattctgttctataagtacatactgtcccttttttgtctcttaatattttattttatttgtttcttcgtctcttcagagataacttgttaaatgctcttggttgacaacatttaacaatggctaactgggtgtaagttgcaggctttcggaaagttttaggatcctctctcttagaaaatcctttagagccgaaggactctttaaccgcactcttctatatgggtatgagctgtcgtctatatttcctccacagatcctgatcatagtttgtatatgagcagaatacactaaagatgatgataataattcgcctataggaacataggattcataatttttgcatcactaaaatttaggaacccatggactcataatattggcaaatttgcaacagtattgctttgggcggttcttaagtaacatagtttggtttatgtaatacgtgctcaatttcaatcttttgggattaaaattttgggattatttttattactccttacgtcccattgaatttaaagcattttttattttggtctgtcacacttgatttgtatcatttctatatttagacaatgactcatcactttgttttaatctcattcatatattttaactctcttttaatcttaatcacacatttcattctctctcttcatttattatcacttttttaaaaatcctccatttctctttgatgcaattctatcacgacaaatgattattcttaaaattcattaagtcggcgacaacgacaaagaaggtggttagttgtcggcttgtggacttagctttgcttgatccatttcgttgtattaacctctttttctgaggatttatttatatatctttctttagttgagggattctttggtcacattttcctttatgtgtataaattaccacctttatttctcctcaaccctgataatagtttctatgagcagtgcacattggatataatgatgatgacaaatgataaagtgaatttgtaaaaatattcactaccaagtttagcaacagttcattagtaatagggttaaaacgtaaaagttaaaacgacgttattaatatttctggtactattggtattcaagttattgtatgatggcacatctgtatttgttaaggggtaagcaatacttttgtaactactaactactccatatactttattgaaatattatgttcataattggtgaaaaaaatatcaatatacaaatataatataacgaaatgaattttaatattaaaagaaagtgttagctaacgaatgtttggggtcattcgtcaatgagaacaaaatcatcatattaacgagtacattatgaaacataataatatttgacacttgatttaatgataatttccaattttaacttaacttttaaataataaaattaatatttacataattcaaaatataaaatattttataatttagtatttaagactacttgagcagaaggtttggcgttcgacccctactgggtgcaggtatcaattgggggtttcttgactgcgcgcatctctctttactccctccttggggtacgaccgtacgagtatgatttgtccgcatctttcaaggaaaagaaaacccctactcggaccctgccttgtgcgggataccaaaaatgtcctttccctttcctttatcctcatcaagcaacatccctcgagatccaaagtaataaaaaaaagtgatggacatgaggacaagcaaaaggattaaagaaatgtacactcgtgctggtttgttttatctggcccatcggcccatgttggtctacttttgcggcctttatttcactaacatcttgttcaatgagaactcaacatcctccattttttctatcttatatttcaccattctcactattttgattcttggattttcttgtgtacaaatctacaaaaatgaggattatccaatatatttgttactttgtctattttttttggttttaataaattttttttaaaaaattttgtcattttgtaataatacattgtacttgaattattatatattatattcaatattcaatggctttatcatattgtactcttcccattatttagaaacttaattcttagggctcccccttcctcccctaaaatcaaaagatttacaatggattaaactaatgacgtatttaattgtcttttaattaacgtttttgcattggaagtattctctaacttaacatactatgattaatatgaacataaattatgttggataaaatatgtagattttttttaaaataataattcatttaaaatgaatttttgtctactaaaaagatcaaatattctttaagctataacgaaatgcacatatattaaattgcttatgcttattaatgaaaatatgatagtgatgatgcacacaaaattatgtagtcaaaaattaattagaccagaaagtctatatgtttgatcaactctttatacacacatctcgtgtataataacccaagctatttttaaataaaaagaacatccaagatcaaaaagtacaatccaattacgaaaaccaatttcaatcttttttgattactatgagttaatcaaaatccttctaaaaaatcttgttatatactgcttctatgtatttttcgagatcatttcatataatataaataatttgaacattaatagaacaatctagctcaaaaaatcttaaggaagtacaagtaaaccttggaaagtctttcaaacaagtttatagtactaggcttgaaaccctcaaggagtgtttgtctcaaataaagacatgaattcctttttagatgatgaagcaagtaatatacaattagatcaaaacaatagtatgtgggtttattgttttatgtgctaaattatattggttagaccaacctgcaacaataaaggtatttaatgtccccctccttccctccttgtgtttttggaaaatgtcacaattgatttgggaatttgcaaatccccaagattaatttatactccctatgttcaaagatatagtctcaaatacagattgatgaaaatcaagaaaaatgagcaaaactgataaacaagtactactattttataaaaaaagtgaaagaaatgtgtaggtgtgacgaaaatgtaagttaattatgtatgcgatattcagaaatcaagagagtgagagcatatgtattaatatctttctaattatttaagtgcggtttttaagattgagggtagcataatatttttttaggaggtcactagtcagtgccctcatttgtgcatacaagagggcacctggctccgcccctgtctgcgaaaactaaaaaaagatatgacatatgataaaaattaaaatgagataaatttaatgggaccgactgatacgaaaaatgagtgtgaagtataatcaatggtggttttgtttgacctaatttgattttacccttgttttcttcagctctgttttggctgctctcaatattataaaatagtgagccatgtcttatccaaaacaagcagggttttcttccccaaaagcttgcctcctaaggcaactccctccatttttcgctttcttttctcgaactcaactatatttttaattatgttatttctaacctaaatagggttttgagttattttagattttttgcgtctttagtaaggaaggtggaacactaattaaggttttaattgtgttccactgacaatcatgaccatgaccatgaccatgaccatattattagagtatataacatattttgaggcctcaactataagtttaagcttttagttgagttggttctttgatatgacatcagaagccagagtgacaagaggtcacaagttcgaatctcaaccatccctaatttaaagtggaatatttagcgtcatgtatgaggagggcatgtgatgcatctacacttctatttcaaaggactttcgtgtgagggggcttataaattattagactatatataacatatcttggggactcaactaaaaacttaagtttatggtttatgcctcaagatatgttacatactctaatacatataagacatctgaaaacctagctataatatttggtaattggtggtaataaagtgatgataattgtgtagctaatatgtgaaatctataacttgataataagtaggtgataggttaatctcactgtaatttaacgaacttacgaaaatttctatataaaataatctcgtagaaaagtagtgttaactaataaaataagaaaagataattttattttagctttcaaaaattctttctatcatttaaaattataatctataaaagataatcattaacttaattttttgtgtctacaaaataaaaaggtaaagaataagataaattcttatatagatttgattatcaatattttaatatgcatcaaccttaaaaattattacattggtgataattttacaaagaataagtgttcaagtataaaacctagata

SEQ ID NO: 367 - DNA, 511 bp, Amaranthus rudis
ggagtttagaggacttgtgtgcgaaggagctaatgttctcccatccaagtttgtagaggattcattccgtgatggatatgggaaagtggtcaatatcaggcgtttggatgaagtgattgattctatcaatggatggtacatggagcgtggtctttttggcatggtttctggtgttgagatcctttcagggggtatactcaggttacaaatttctgaagctgaggtcaatgatgtttcaatccgcttccttgatcgtaagacacgtgagccaactgtggggaagacaaagccagaaacaatacttcgacaacttacaacaaaaaaaggacaggtatacagtttaaatcaagggaaaagggatgttgagactgttttgacgatgggaatcatggaagatgtaagcatttttccccagcctgctggagatacaggtaaagttgatttggtaatgaatgtggttgagcgtgtgagtggaggtttctcggctggtggtggtatttcgagcgggata

SEQ ID NO: 368 - DNA, 1178 bp, Amaranthus rudis
ggccattacggcgggataacaagcggaccgctgtcaggtttaattggaagctttgcatattctcacagaaatctgtttggaaaaaatcaaaaagtaaatgtctctcttgagagaggccaaatcgactctatcttccggataaattatacagtcccatggattgaaggtgatgataagcgtacacaaaggtcaatcattattcagaactcaaggactccgggtactttggtccatggtaatcaacctgaaaatagtaacttaactattggccgtgtaacagctggcattgaatttagccggcccctaagacccaagtggagtggaacagctggacttacgtttcagcatgctggtgtccgtgatgaacaagggaaccccgttataaaagatttctacaacagtgctcttacggcaagtgggaatactcatgataatatgctgcttgccaaaggcgagtgtgcctacacgggtgacttaggatcctcaatgttagtcttaagcatggaacaaggtcttcctatctatcctgagtggctgtgttttaatcgagtcaacgctcgtgccaggtcaggggtggacattggtccagctaatctttttctcagtttgtctggtggtcatgtggtcggtaaattccctcctcatgaagcgtttgcgatcggtggtacaaatagtgtgagaggatatgaagaaggtgctgttggctcaggtctttcatacgtagtgggctgtggagaagtttccttccctctgtatggtccagtagatggcgctctttttgctgactatggaacggatctcggatcaggttcatctgttcctggtgatcctgctggtgcgagattaaaacccgggagtggatacggttatggatttggtatccgagtcgagtctccattaggtcctctacggttagaatatgcatttaacgacagacaagcgaggcggtttcattttggcgttggtcatcggaactagcagttctttcctgttcatttggtagcttacataatattttatttacctgtgaaaaggttgaacatattcctctattgaattttgttctataatatgagtatatacactgttcccttttttttgatttacttgttttggctgttaatattttaaaaaaaaaaagaaaaaaaaacaaaacatgtcggccgcctcggtctcta

SEQ ID NO: 369 - DNA, 782 bp, Amaranthus rudis
aatcaaacaatgcccagaaatgacgacgttcaattcttatcatcctccattaatctttcttcaaccaaaaatccccaaattcccttctttcaccttccattttcttgtcaatcccaaaataccaacctctcacaatcaaaattctcaacttcccacttaattaattccatttttctcccgaaaaacctcaacaagtttcaatttatcaccgccattgttatcgtgctcttcaacattatccctgtgtcgacccactaactcaactcagtccaaaaacccttcaatttccttctgtcaatccctaaattctactctcttacaagccaaattctcaattacccagttcattaatggcatcaaactccacgtaaaccccgtgaagtttcaatcttccccatcaccattgctatgctcttcgacattgtctttgaacgagtcaactcagcctccagccggaagtggtagtgtggttgaggttagtcaatcgaaatcggcttccgtgagtcgtactcgaagggaggatgaagagagagtgttgattagtgaggtgttagtgaggagtaaagatggagaagaattagagaggaaagatttggaattggaggcattaatggcattgaaagcttgccgggcgaattcagctttgactgtgcgagaggttcaggaggatgttcatagaattattgatagtgggtattttcttcatgtatgccagttgcagtggatactagggatggtattagattggtctttcaggtagaaccaaaccaggagtttagagg

SEQ ID NO: 370 - DNA, 617 bp, Amaranthus rudis
acgaccttatttataatctatttaaaaggtgatcctgctggtgcgagattaaaacccgggagtggatacggttatggatttggtatccgagtcgagtctccattaggtcctctacggttagaatatgcatttaacgacagacaagcgaggcggtttcattttggcgttggtcatcggaactagcagttctttcctgttcatttggtagcttacatagtattttatttacctgtgaaaaggttgaacatattcctctattgaattttgttctataatataagtatatacactgttccctttttttgatttacttgttttggctgttaatattttattttatctgtttcttcgtctctttaaatttgcaacattaattaagaaaatttaccgtaattgtgatcaatgttgagagctaacaggaatataggattgatatttttcggcggttcttctttactaaacatgttcaccatacaacatttatatccattttttcttctaaccacttgaattgtaaccgatcaattggttcatgtatgtgatcaactctaatcttttaggattaagattttgttattattttcatttttctttcaattcattataagtcgttaatc

SEQ ID NO: 371 - DNA, 232 bp, Amaranthus rudis
aatcaaacaatgcccagaaatgacgacgttcaattcttatcatcctccattaatctttcttcaaccaaaaatccccaaattcccttctttcaccttccattttcttctcaatcccaaaataccaacctctcacaatcaaaattctcaacttcccacttcataaattccatttttctcccaaaaaacctcaacaagtttcaatttttatcaccgccattgctatcatgctctt

SEQ ID NO: 372 - DNA, 2369 bp, Amaranthus rudis
tcttagtgatctaaagcctcctaaaacagtaagtaatcaattatatgttgttaaagtatgatgatactccacgagatataaacaagtgaaagagaacagcttttgaagttcgcaaaataaagtcgaatctctgagtattttgtcctcccagtctttaactcatgacactccaccttctttttaagcttcatatgtcttaggttgataccaagatacataggccagaaaactcttatcttagcttgcaactttcttgcaaacttctgtgttcattgcatgcggttgcttgaggttctatttgctcatttggagatgtatatcattccccttcctgtgtatattgagataaatgaggagggggttcctgtgtattttatctggaattagataaatttttggcatttgtactttgcctttaaaatggaatacgtgaatgatctcatcgcagccacaaacccatccaccaccatacgtaggccttagccgtctaaaagctcaagatgaggacaaaggcacttcacttgcacatcctttccaccatatgtagccttctaaaaagcttaagatgaggacaaagccacttcaatcacttacacatcattttttatgttaggcaaaatttcaagttatactcttaatcgacaattaaaaacatattattaaagccctccttgtgtattgggcgtctgatatggaaggaagatagagaactttttatgtgagaaagatagtggaagactggaagcctggaaggtggtcgttgcggtgatgcagtgttgtcactttggtgttgttagataagaggaaggaacaaagggtagtagatggaataaaggactaagcatttgagcgaagaaataggaagatggtggaggttgtgatttggttgttgggaaaggagggagggtgtcagtgagtttcttttagacctggttggttatttttaccgatgtgcttgtcaaatagttatacgttttccttgttgaaagtgggcgcttactttatgtggtatttattatcgagaacagctggttgatgatcaattaggtgacttatggaatgtcaatgaatggttcctgttggaaacaggttgttgatcttcatttattttgttagggtcacgatgtgaaaaggtaatagaagcttggaaggataaaattggctctttagaattggtattatcccactcctaatagttcaataaacatggaggatgactgatatgaattatatgttgttgaagtcagctagagatccacaagatagataagtgattgagagcagctttgaagtttacattacaaagtcaaacctctgaggagtttttcttctggttgtcaaacacacggtagttcttttggtcaaactttcatgtgttaggctgattcaatgaaagaaactggcaaaaaattcctgtgtagcttgcgtctttcttatgcatacctcggcggtcactgcattctgattcaatgaaatgttgtcggagtcaaagctttattagtggcttattactcattcatcttttggatctggatgtttaggtgcttttgatgtgcttgtatgggagcctaatttctctgagatgtacatgtatttgtagtaactaattgttttctttctgtatgaccttttgattctcactagatggtttttcttgcatatggctgcagctttgcatattctcacaggaatctgtttggaaaaaatcaaaaagtaaatgtctctcttgagagaggccaaatcgactctatcttccggataaattatacagtcccatggattgaaggtgatgataagcgtacacaaaggtcaatcattattcaggtgatatgaggacatcttttttatattcttctcagatgaaaagagtgttgctgtaacggtcctctttgttgattttttattgctcactcagaactcaaggactccaggtactttggtccatggtaatcaacctgaaaatagtaacttaactattggccgtgtaacagctggcattgaatttagccggcccctaagacccaagtggagtggaacagctggacttacgtttcaggtatcttcgatgtagctttgtgcttttttagttgtggaaatgggttaaacgactttgtttggtgctctaaatggttttgggttgaacattgtgtagtaactatcttggtgaacttgcatgagttgttgactacaatcatcctgacattatattcccattcatgcagcatgctggtgtccgtgatgaacaagggaaccccgtcataaaagatttctacaacagcgctcttacggcaaggtgtatatatttattataaacatcagctatgcttgaatcttgagattcctttttgtttgtgttttctgttgtattt

SEQ ID NO: 373 - DNA, 1136 bp, Amaranthus rudis
tccgttgcattaagtgatgttgcacattctttgttgttttaatataaatttttgtattgggatgctgctgagagaaaacagtttttctgcttctcaacattataaattatatgcatgcttgcacacattggctttccaaccactttgtttgctacaatataagcttgagaacttcattccttttacacatttcttaatagatagtggcattaggctaagtttttatagacaaatgaaccagtagtaatttgatgtttgtaaaaatgcttcgccacttttaaaaaattgagtttcaagtttccacattcaagcttacttgctaaattgtgatctttaggatttttatcattgatttgtttttcaatgaggatattcattttcaatataggttttccactataaatatctttggtatgatcttgataatgtgaaatatgtacgaacttcacggctaacaatgtggtgaggtctcatgtggcctgcaaactttttttgcaggtatacagtttaaatcaagggaagagggatgttgagactgttttgacgatgggaatcatggaagatgtaagcatttttccccagcctgctggaggtactataagctgcactatattaacaacggacttaatattctgattttttcatgttattttcttgatgataaggttttaatttttgttgtcaaattcaatttatgttcaaaaagtaacacttgtatactttcttcaaaataatcctttctagaattttttcggccaactaaaactgtgaggtttttaaatctatggacccttacaaatgctagtgtttactgaggtttctgcggaatggcaaatgaagacattaaattatatcacaaggatgaagcttccaaaaaaatgtcaatcgagaaggatggttgagctcacttgctaagactctattatgttgagttttcctttagaaattgggctgctttagcacacatattaacagcctaagacttgaaattctgattgttgtttaaagatatgttgttcttctagagctaaggcttaaagttatctttactcaatgatttgcacttcaaattgaatctttagttaccttggttgctcaccacttcacctaatgtaaaccatacttctttgtcttct

SEQ ID NO: 374 - DNA, 600 bp, Amaranthus rudis
tatcaccgccattgctatcatgctcttcaacgttatccctgagtcgacccactaactcaactcagtccataaacccttcaatttccttctgtcaatccctaaattctactctcttacaagccaaattctcaattacccagttcattaatggcatcaaactccacgtaaaccccgtgaagtttcaatcttccccatcaccattgctatgctcttcaacattgtctttgaacgagtcaactcagcctccagccggaagtggtagtgtggttgaggttagtcaatcgaaatcggcttcggtgagtcgtactcgaagggaggatggaagaagagagtgttgaattagtgaggtgttagtgaggagtaaagatggagaagaattagagaggaaagatttggaattggaggcattaatggcattgaaagcttgccgggcgaattcagctttgactgtgcgagaggttcaggaggatgttcatagaattattgatagtgggtatttttcttcatgtatgccagttgcagtggatactagggatggtattagattggtctttcaggtatattttaatgtagatagatagctatttttccagagttaaa

SEQ ID NO: 375 - DNA, 837 bp, Amaranthus rudis
attgcacggtcttggtgaatatgctgccgtgatggaatgtagatgtttttcttttattgacatagttagtttgtttaatttgcttttattttgtccaacaaggtagaaccaaaccaggagtttagaggacttgtgtgcgaaggagctaatgttctcccatccaagtttgtagaggattcattccgtgatggatatggtagttctcctgtattattgttgctagagtttgtgacttactaaagcctttcctttataaatttgaactttttcaccaagctgtgcagggaaagtggtcaatatcaggcgtttggatgaagtgattgattctatcaatggatggtacatggagcgtggtctttttggcatggttaatatctggatttctttttgacgttgaatgtttttgtcctatcctgtatgcttagctaccccttatggcttaaaatgcaatgttttatagctgagattcattgttctgttcctacaggtttctggtgttgagatcctttcagggggtatactcaggttacaaatttctgaagctgaggtcaatgatgtttcaatccgcttccttgatcgtaagacgtaagttccaacctatttatttttgctacttcccaataaaacaacacgccatttcctcaatgtcaagttgctaagtaaaaaaaatgctaacaaaaaagtggaatcgatcaatatgggctctaatgattagattttgttataacaaccctggttcattaatgacggttcaactgtttattctatttgcgtatttagacgtgagccaactgtggggaagacaaagccagaaacaatacttcgacaacttacaac

SEQ ID NO: 376 - DNA, 755 bp, Amaranthus spinosus
ttgagactgttttgacgatgggaatcatggaagatgtaagcatttttccccagcctgctggagatacaggtaaagttgatttggtaatgaatgtggttgagcgtgtgagcggaggtttctcggctggtggtggtatttcgagcgggataacgagcggaccgctatcaggtttaattggaagctttgcatattctcacaggaatctgtttggaaaaaatcaaaaagtaaatgtctctcttgagagaggccaaatcgactctatcttccggataaattatacagtcccatggattgaaggtgatgataagcgtactcaaaggtcaatcattattcagaattcaaggactccgggtactttggtccatggtaatcaacctgaaaatagtaacttaactattggccgtgtaacagctggcatcgaattcagccggcccctaagacccaagtggagcggaacagctggacttacgtttcagcatgctggtgtccgtgatgaaaaagggaatcccgtcataaaagatttctacaacagcgctcttacggcaagtgggaatactcatgataatatgctgcttgccaaaggcgagtgtgcctacacgggtgattttaggatcctcaatgttagttttaagcatggaacaaggtcttcctatctatcctgagtggctgtgttttaatcgggtcaacgctcgtgccaggtcaggggtggacattggtccagccaatctttttctcagtttgtctggtggtcatgt

SEQ ID NO: 377 - DNA, 462 bp, Amaranthus spinosus
cttcaatcaaaaatccccaaattcccttctttcaccttccattttcttctcaatcaaaattctcaaccacccacttcataaattccatttttctccccaaaaatctcaacaagtttcaatttatatcaccgccattgctatcatgctcttcaatgttatccctgagtcgacccactaactcaactcagtccaaaacccttcaatttccttctgtcaatccctaaattctactctcttacaagccaaattctcaattacccagttcattaatggcatcaaactccacggaaaccccgttatgtttcaatcttctccatcaccattgctatgctcttcaacattgtctttgaacgagtcaactcagcctccagccggaagtggtagtgtggttgaggttagtcaatcgaaatcggcttcagtgagtcgtactcgaagggaggatgaagagagagtgttgattag

SEQ ID NO: 378 - DNA, 523 bp, Amaranthus thunbergii
agatcttgatggttttcctgtgacttgcagcggagggaacgatgatagtatggtggttttaaagcaagaaactcgctatgccagggctaatgataattgctttagtcgttttagcttgcacatagagcaaggaatcccggttttctctaagtggcttgtatttaaccgattcaagtttgtagggaccaagggtatcaagcttgggcctgcttttttattgacaagtgtgaccggaggttcaattgtgggggatatggctccgtaccaagcatttgctattggtggtcttggtagtgttagaggttatggtgaaggtgctgttggcactggaagatcatgtatcattgcaaatactgaattgacattcccgttgagcaaaatgttagaaggtgcaatcttcgtagattatggatccgatcttggtacaggtcgtcttgttccaggaaacccggctttaagacgaggcaaaccaggaagaggagctggaatcgggtatggcttacgcttcaaatcacaaatcggt

SEQ ID NO: 379 - DNA, 482 bp, Amaranthus viridis
tgagaggatatggaagaaggtgccgttggcactaggcctttcatacgttgtgggctgtggagaagtttccttccctctgtatggtccagtagatggcgctctttttgctgattatggaacggatctcggatcaggttcattggttcctggtgatcctgctggtgcgagattaaaacccgggagtggatacggctatggatttggtatccgtgtcgagtctccattaggtcctctacggttagagtatgcatttaacgacagacaagcgaggcggtttcattttggcgtaggtcatcggaactagcagagttctttcctgttcatttggtagcttacatactacttatcaaggttttgtcctaaagaaatagaaatagtaagtgcagtcctgttcctcccctttttgttttgcttggtgtacaattgatgagatgatgatgattgatttgattcagatttacctgtaaaaaggtcaacacatt

SEQ ID NO: 380 - DNA, 1451 bp, Amaranthus viridis
agtgtggttgaggttagtcaatcgaaatcggcttcagtgagtcgtactcgaagggaggatgaagagagagtgttgattagtgaggtgttagtgaggagtaaagatggagaagaattagagaggaaagatttggaattggaggcattaatggcattgaaagcttgccgggcgaattcagctttgactgtgcgagaggttcaggaggatgttcatagaattattgatagtgggtatttttcttcatgtatgccagttgcagtggatactagggatggtattagattggtctttcaggtagaaccaaaccaggagttttagaggactggtgtgcgaaggagctaatgttctcccatccaagtttgtagaggattcttttcgtgatggatatgggaaagtggtcaatatcaggcgtttggatgaagtaattgattctataaatggatggtacatggagcgtggtctttttggcatggtttctggtgttgagatactttcagggggtatactaaggttacaaatttctgaagctgaggtcaatgatgtttcaatccgcttccttgatcgtaagacacgtgagccaactgttgggaagacaaagccagaaacaatacttcgacaacttacaacaaaaaaaggacaggtatacagtttgaatcaagggaaaagggatgttgagactgttttgacgatgggaatcatggaagatgtaagcattttccccagcctgctggagatacaggtaaagttgatttggtaatgaatgtggttgagcgtgtgagtggaggtttctcggctggtggtggtatttcgagcgggataacgagcggaccgctatcaggtttaattggaagctttgcatattctcacaggaatctgtttggaaaaaatcaaaaagtaaatgtctctcttgagagaggccaaatcgactctatcttccggataaattatacagtcccatggattgaaggtgatgataagcgtactcaaaggtcaatcattattcagaattcaaggactccgggtactttggtccatggtaatcaacctgaaaatagtaacttaactattggccgtgtaacagctggcatcgaattcagccggcccctaagacccaagtggagcggaacagctggacttacgtttcagcatgctggtgtccgtgatgaaaaagggaatcccgtcataaaagatttctacaacagcgctcttacggcaagtgggaatactcatgataatatgctgcttgccaaaggcgagtgtgcctacacgggtgacttaggatcctcaatgttagtcttaagcatggaacaaggtcttcctatatatcctgagtggctgtgttttaatcgagtcaatgctcgtgccaggtcaggggtggacattggtcccgctaatctttttctcagtttgtctggtggtcatgtggtcggtaaatttcctcctcatgaagc

SEQ ID NO: 381 - DNA, 3085 bp, Ambrosia artemisiifolia
ataattactttcagacatctttttatcatctatttttatttattttatctttactgggggtacacacaaattcttttagttatcatcttataaaaatcacgttttcttgtctagcattcagtctcacctgaggttgggatacatggtgtgcctgttgacaacttctcaagaacacaaagtggaggtgtaaatttatgtagattctccgctggtctagatcttgatgaacctggaagttctaattggagcagcaaaacgagtataaaatttgaggtaacgagagcatgctatgcacatgcaatttcaaccagtttacttataaacgtgtcgatttgggttgtgttttttcttaagcggtcaaattattattataaagtttagctaaaagaggtacgggtcaaacaatacaactttctaaatagtttattcaatcgtttagagtatttatataataatattgtttttgcaattctgattaattcactaatcatatttacataagaaattaagaacctgaacccattttgacacgttacttaattcgtccctcttgccaccaccaatatcaagttgtactttgaaatgcaaaccgattaataatctgagtcttcggattaatagctaaaactaatagcatttacaacaaataaaattgttacatttcttacaaatagatctcagtattgttattatgaagtaatttatttgaccttggtcatgttggcatgtagcatgtccgtccggtcaatgatgatggccactcaataagtagggatcttcatggatttccagtgacttgcaggtatatataagttacaccttttgtgaatgtaatttttaaaacatattgcattctaaaagatatctcataatattttataatgcagtggtactcgtgatgataatatggtagtattgaaacaggagtcccggttcgccaaggcagacgaccatagttttacacgggtgaattttataatttgagtttttgcttaatttttatcaaaaatatatattgtctttggtaactgtttctttttaaatgtgtgatattcagtttagtctacaaatagaacaagggattcctctaatgtcaaaatggttaatctttaaccgattcaagtttgctgcttcaaagggggttaaagttggccctggatttctcttggcaaggtaaatatgccgaactcaccacaatgcaaacatgctactttaactaggttgtgtttggattcgggttttgttaaaagtatatgactttacaatattatatatttttttctattaccatttacctaaagtagtttttttttaaataattatttattcacacagtttctacgtgacagccttacaggtggttccattgtgggtgatatagctccttaccaagcatttgcaatcgggggacttggtagtgtacgaggttatggtgagggtgctgtcggatccggcagatcgtgtctagttgctaacgccgagctcacattccctatggtatttgcttacttgttaagtgtttgatcaataataaaacattttcccttcatctatatgtttaggagggattatttatccgtttttttttgtttaccagaatcatatgcttgatggtgctctcttctgtgattgtggaactgatttgggttctggtcgctatgttcctggttagttttccatctcctcgtgggcaatctgcatattcgtacatactttttcttgcttgttgtaaattactcataaaagggtattttagacatttttaccaatatgtagatgttttacttaatctacttgacaagtcaatctttacatttcattttgggtaaaggatggttaaaattgattccaaatatcatttcaagttttaaataagtcgtttgaaccccgaattcaatattgtaaaaactcgcgtgctcatgactcttcttttgtaggaaatccggggttgagacatggtaaacctgggaatggagttggtgttggatatggagttcgggtcaagttcccgatgggtcactttcaggttgactatgctctcaatgactatcaacaaaagaccatctattttgggtttagcaatgttgcttcttgaccttcttaagcctttgattcggaggagatcattataatccaattttttatattcttaaaattggtcaaagtcaacaaattttgtttttgtttggggcctgacatgaatgtaagtattatcttattaattattgtaaattgtaaatacaacatttatttgctagctcatctataaatggtttagaacaatttcgtataaattgttttgttatgattttgtacgacaattttttatgttgttgtatggtagttcaaagtctaaggtcaagggtataacagtcacgttataagtgttatttgataaagcgagtagatgattctgtaagaagtcatattatatacatactaaaaagcaaaagaggattgtgagagcacttgaactgtatcagttcgtgcaagtttttgaagcttagttttgtccggtgtacaacccgcctcggatgaactgttcccggtattgggttgcttacctttaccaatcaccacatatctccctttgtctccctctctctctatttcgaatcaaccgagaacaaggcggatagtggttgtggatctgtccgtcaccccgcgtacttcctttgcctccaccgttgtcatcattggctgtaaccttctttttgcggtggcggtcgctgtttgttgatctatgttcccctaattttggggtttcgttgttggcctcggttgttgatggcaactttagacctaaatttatacggtggttttgatggtttgattgttgtctccatgtcatctgacgataaaatggtttttataaatcgaatatctggagttgtgttttcatatgttggttacgctgttttgattcttggcctgtgggttttttttcgcttgcagtttgtcatagtttgttaaggttgtgatgagttaaatcgtctgaatgtaataacggatgatgatgtcgacttggtgtggcaaggtagaagaatggcgggtgtttacctgcaactcccttgcagtcatgttg

SEQ ID NO: 382 - DNA, 1350 bp, Ambrosia artemisiifolia
tggtgaacctccgactagcaattagtcggcaactaatcggagcctcggaggctagtcgcgatttttacatcattattcatgaattttaactttcttgttatacagttatacttacactagtatattttggcataaggtagaaccaaaccaagattttcaaggtctgatctgtgaaggagccaatgttctaccaacaaaatttgttgaggataagtttcgtgatggatatggtatgtttatggtttaccatagtcattattgtgtaatttgaagttttgtacttttcttttagtaactgagcttttgctaagttatgcagggaaaattgtaaatataaggcgtttggatgaagttataaactccatcaatggatggtatatggagcgtgggctttttggcttggttagcatttgatttcattgccatttgttctttctttagttgcagtgtttgtttgactagaacaccattagtcaagtaactgtattttgagatcattaggtttcaggagttgagattctatctgggggaattttgaggttacaagtgtcagaagcagaggttaacaatatatctatacgctttcttaataaaacgtaagattctaacccttatttctgctgtttatgtagacatactgttctgatggtatgctaacattacaagttgtaccaaatatatgttggttttgtgattccagtggtgaaccgactacaggtaaaacgaggcccgagacaatacttcgccaacttaatacgaaaaaggggcaggtactagactgagggctgtctgcttggatttgtttgtttttttaacacaattattaattatatgttatactatgtaaattttaatgttaatgttgttattaggtgtatagtatgcttcaagcaaaaagagatgtagatacattgctagcaatgggtattatggaggatgttagcattgtcccccagcctgctggaggtaatgtgttatctgatggttttgggcaggaaatgtttttgaacattgaacaaaaacaggatatttatttaaattagttattggactgtcaaccgtgtgttacctgttatttgaaggttcgtttttgtcgagtattgaatgatcttacattattatttacagactctgggaaagtggacttgacaattaatgcagttgaacgtgtaagtggaggcatatcggctggtggtggaatttcaagtgggtatgtgatctcattgtgggtccatgtagtgtaactagatgtggcaaaatgcacgggttggtaaccggccaagatgggcttggattgaaatgggaattttttttttcatttagtacatgctgacacgggcgggttcatgt

SEQ ID NO: 383 - DNA, 250 bp, Ambrosia artemisiifolia
aacagtgatgatgagcgagtgctgataagtgaggtgttggtgaggaataaggacggagatgagctggaacggaaggatctggaagaagaggcgattgctgcgttgaaacggtgtcgtcctaactctgcgttgactttacgcgaggtgcaggaagatgttcatcggataattgggagtggttacttcagttcgtgtatgcctgttgctgttgatactcgtgatggcattcgtttggtgtttcaggtattag

SEQ ID NO: 384 - DNA, 527 bp, Ambrosia artemisiifolia
gaccagttcagggcctgtactcaaattgtccctttaaacctaactcttacccacctgattttgttgttttgtgtaatgaaggtgatccggctggtccaaggtcaaagcccagaaatggatacagttatggagttgttgtgcgtgttgcctcacctttagggcctcttggactcaagtgtgcttttagtgacaagggtaaaggaaagttccacttaggagtttgccaacgaaactgagttcttttgaatctaaataaagattttccccttcaaattttgatcacattattccctttttgaatcatgaaatatgttagaaaatgtaacaagatattactatttatttttgaattccaaacaggttctctaattagaacaatgatttatattaacggttaaggtcaatagttactttagatcaaggattatagctaatgccttgcaactctgtatattgatcagtaaaataaggccttgattggaacttggaaggagaaaataatggactgcatatggaacttgctattt

SEQ ID NO: 385 - DNA, 454 bp, Ambrosia artemisiifolia
ttactcaacccacacatattgcagtttgtagttacaatggagcagggacttcctgtatggtcagagtggttagttttcaatagagttactgttcgtgcacggaaaggacttgtgtttggccctgctcgccttaatttaaggtaatttatcctatttatgatctcaatgttacaatattatcacttataattttttaagtaaatatgtgtaattttgtaaaattatagtttatcaggtggtcatgttgtgggtaactttcctcctcatgaagcattccccattggtggaacaaacagcgttagaggttatgaagaaggggatattgggtcaggaagatcttatggtgttggttgtggagaaatatctttccctctggtgggtgattgaacatttatagtttatatttttttttctattttactgtcagcttacacaatctagcatgaccttatac

SEQ ID NO: 386 - DNA, 842 bp, Ambrosia artemisiifolia
gaatcataattaagctattaagtatttaattatttttttaatgtacaaaaaatgtttatgcgtcaaccttacctgcccagaccatttcaactcatactaaaatgacctattccatcttgacacttcctaaattttttaaaaagaatgcaagatagtaatttagagaccctttgtgattcagaattattcttttatatttaagtatatatttagatgaagagtatgaaattattgtcttcggaatcatagttaacaagtatatatatttagtgctcaacccaacccgatccagaccatttcaacccatactaaaatgatccatgttaatcttgacttgtcacccaagccgtccatgttgccactcatatacttatataaaatgctagataataaactagtgattctttgtgatttagaactccaggacacctgggactcttgttcatgggcctcatggaaatcaacccaacaacagtagcccgacaatcacgcggattacttctgccattgagtacagccggccgtttagaccaaagtggagtgggaccgcagggcttacttttcaggtatttctacaattctacaatctttcctggatattgaataattctaataaaacatgtttattgtatgaaaaataaataaaaaatacagactgattcctgcctgtttaataatcattccatcaacagcgtgctggtgctcgtgatgataaagggaaccctatgataagagacttccataactgcccactaaccgcaaggtattcataaattcatatagagttttttttctttttattcttataaagccatgaagcttggtagtcaaatgtgataagt

SEQ ID NO: 387 - DNA, 461 bp, Ambrosia trifida
ggagttgtgtcactttatcatcgaaacctctttgggtaggaccaaaaagattaatctttcattagagagggggcaaattgactcaatcttccgtatcaactatactgatccatggattgaaggagatgataaacggacatcaagaacaataatgatacagaactccaggacacctgggactcttgttcacgggcctcatggaaatcaacccaacgacagtagcccgacaatcacacgtattacttctgccatcgagtacagccggccatttagaccaaagtggagtgggaccgcagggcttacttttcagcgttctggtgctcgtgatgataaagggaaccctatgataagagacttccataattgcccactaactgcaagtggcaataatcatgatgatatggtacttgctaaagttgaaagcgtttatacggttctagtgaccctagttcttcaatgtt

SEQ ID NO: 388 - DNA, 505 bp, Ambrosia trifida
agccaacgttctaccaacaaaatttgtagaggataagtttcgtgatggatatgggaaaattgtgaatataaggcgtttggatgaagttataaactccatcaatggatggtatatggagcgtgggctttttggcctggtttcaggagttgagattctttctgggggaattttgaggttacaagtgtcagaagcagaggttaacaatatatctatacgctttcttaataaaaccggtgagccgactacaggtaaaacgaggcctgagacaatacttcgccaacttaatacgaaaaaggggcaggtgtatagtatgcttcaagcaaaaagagatgtagatacattgctagcaatgggtatcatggaggatgttagcattgtcccccagcctgctggagactctgggaaagtggacttgacaattaatgcggttgaacgtgtaagtggaggcatatcggcgggtggtggaatttcaagtgggatcacaagcggccctttaggcaggact

SEQ ID NO: 389 - DNA, 452 bp, Ambrosia trifida
gtgtccgtgtgtatgtgcctattatttgaaagttagtttttattgagtattgaatgatcttacattgttaattacagactctgggaaagtggacttgacaattaatgcggttgaacgtgtaagtggaggcatatcggccggtggtggaatttcaagtgggtatgtgatttcattgttggttcatgtagtgtgactagatgtggtaatgcacgggttggtaactggccaagatgggtttggtgggaaattttgtacttttagtacatgttgacacaagcgggttcacattgggttgaccaagaaacactttcttgtgtattgttaatttttcaataaatggcgttaattatgattacaaaagcaacgttgtactaataatgatctgactttttgaatggccactttagattgtatacgatatgtacttattgctcccttttatttgtaggatc

SEQ ID NO: 390 - DNA, 287 bp, Ambrosia trifida
gtattagactgggggctttctgcttatgtttgtttttttccacataaatatatgtttctgtgtaaactttaatgttaatgttcttattaggtgtatagtatgcttcaagcaaaaagagatgtagatacattgctagcaatgggtatcatggaggatgttagcattgtcccccagcctgctggaggtaatatgatattctgaacagcaaatgttttgggcaggaaatgtttgaaatatcattatttaaattagttattgaactgtcaaccgtgtgtatgtgcctatta

SEQ ID NO: 391 - DNA, 691 bp, Ambrosia trifida
ttcctaaaatttatataaaaaaatgcaagctagtaatttagaaaccctttgtgattcagaacttctggataaattcttttactatttatgtatttagacgaagagtatgaagttattgtcttcgtaatcatagttaacaccttaagtatatatatttagtgctcaacccaacccgatccagaccatttcaacccatagtaaaatgatacatgttaatcttgacttgtcacccatgccgtccatgttgccacttcatatatttataaaaatgcgagataataaattagtgattctttgtgatttagaactccaggacacctgggactcttgttcacgggcctcatggaaatcaacccaacgacagtagcccgacaatcacacgtattacttctgccatcgagtacagccggccatttagaccaaagtggagtgggaccgcagggcttacttttcaggtatttctacaatctttcctggatattgaataattttaagaaagcatgtttattgtaagaaaaataaatgaaaaatacagactaattcctgcctgtttaattatctttgaatcaacagcgttctggtgctcgtgatgataaagggaaccctatgataagagacttccataattgcccactaactgcaaggtattcatatagagttttttttttttatttttataaaaccgtgaagc

SEQ ID NO: 392 - DNA, 1010 bp, Ambrosia trifida
gcagtcccatgcatgacatatgtcgtatggtatgctctaaatttacataaaaatatgaacaaaaggtttgaagacaccaaattgtcggtagctattaaactaattatacaatcattaaatagaaggtattcaagtgtaacaatattctctatacagggcccttgtataaccctatcatactcgcatcaatatacaatacaattactggttattcagtagttttgactatgttggaaataagagatcagagaacaagttatgcaaaacacaattatacatgaattttaactttcttggtatacagttatacttacactagtatattttggcataaggtagaaccaaaccaagatttccaaggtctgatctgtgaaggagccaacgttctaccaacaaaatttgtagaggataagttccgtgatggatatggtatgtttatggtttagcatagtcattattgtgtaatttgaagttttgtgcttttcttttaccaactgagcttttggtaagttatgcagggaaaattgtaaatataaggcgtttggatgaagttataaactccatcaatggatggtatatggagcgtgggctttttggcctggttagcatttgatttcattgccatttgttctttctgcagttgcagtgtttgtttgactataccaccaattgtcaagtaactgtattttgagatcactaggtttcaggagttgagattctttctgggggaattttgaggttacaagtgtcagaagcagaggttaacaatatatctatacgctttcttaataaaacgtaagattacaatcctcatttctgctgtttatgtagacattctgttctgatgataggctaacattacaatttgtaccaaatatatgttggttttgtgattccagcggtgagccgactacaggtaaaacgaggcccgagacaatacttcgccaacttaatacgaaaaaggggcaggtattaattagactgggggctttctgaacagcaaatgggta

SEQ ID NO: 393 - DNA, 657 bp, Ambrosia trifida
tttatttttataaaaccgtgaagcttagtagtcaaacttgataagttcatttaaatttgttgtagtggcaataatcatgatgatatggtacttgctaaagttgaaagcgtttatactggttctagtgaccctagttcttcaatggtaagacatgaatattttctccctgctttcattgttatttgcaggaccaaaatgtggcaaattttaacccacttacctagaattgggttgatttaggttgtattgtattatctctttattcagaaaattagaaatacatttttctaatctaatttaacccactatactagtatctataaataagttctagaagggacaaaagtgcctgctggtcaactggactcaaccctattaaaaattacctagtttgacccattactcaaaccacacatattgcagtttgtagttacaatggagcagggacttcctgtatggtcagagtggctagttttcaatagagttactgttcgtgcacgaaaaggacttgtgtttggccccgctcgccttaatttaaggtaatttatcctacttacgatctcaatgttactattatcacttctaatttattaagtaaatatgtgtaattttgttaaattatagtttatcaggcggtcatgttgtgggtaactttcc

SEQ ID NO: 394 - DNA, 491 bp, Ambrosia trifida
atttacatgatgctgatcctccataacttaagtagatgcttcatttctttctttttaactttttttttccattgcagttgtgcactttatcatcgaaacctctttgggaggaaccaaaagattaatctttcattagagagggggcaaattgactcaatcttccgtatcaactatactgatccatggattgaaggagatgataaacggacatcaagaacaataatgatacaggcacctatccaattttgaatattattttggctgtgattcatgataatttttattaaaggtgacagtttcaacccatttgtttcttaatgggttgattcgggttgtgttctattccaccacccgtgtcaaattggtcaaatataaaaatttagtaaaaaagggtacatgtcaaatgtgtctgaattggttgaaagttacccaaattctatttttgaggcatagaacctgctaaacttatatttaagtatttagaccatgga

SEQ ID NO: 395 - DNA, 1426 bp, Chenopodium album
caattttaattttaccctagttagcctaaattccactcccatttctccaactatgcttaacaatggcgatattgaattcaaatcatccgccattaaaatccctctttctacacctcaaaatcccatctctcacctcccattttgttctcaatccctaacttccaccctctcacaagccaaattctcaataacccagttcatagattccctcaaatttcacaaaaaccccatcaaattgcgttctttcccatcaccattgctgtgctcttcgacattggcactgaacgagtcgactcagccacaacccggtgctactggtggtggtggtgcgattgaggtggctcagacaaaggcgccggtgagtcggactcggagggaggatgaggagagagtgctgattagtgaggtgttagtgaggaacaaagatggtgaagaattggagatgaaggacttggaatcagaggcattaatggcgttgaaagcgtgccgggcgaattcggcattgacggttagagaagttcaggaggatgttcatcgaattattgatagtggctatttttcttcatgtatgcctgttgctgtagatactcgggatggtatcagattggtctttcaggtagaaccaaaccaggagtttcggggattggtgtgcgaaggagctaatgttcttccgtccaaatttgtagaggataaatttcgcgatggatatggaaaagtggtcaatatcaggcatttggatgaagtgattgaatccatcaatggatggtatatggagcgtggcctttttggcatggtttcaggtgttgagattctttcagggggtatactaaggctacaaattgctgaagctgaggtcaatgatgtctcaatccgttttcttgatcgaaagacccgtgagccaactgtggggaagacaaagcctgaaacaatactccgccagcttacaactaaaaaagggcaggtttacagtttaaatcaaggaaaaagggatgttgagacagttctaactatgggaattatggaagatgttagcatttttccccagcccgccggagacactggtaaggttgatttggtaatgaatgtggttgagcgtgtgagtggaggtttctctgctggtggtggaatttcgagtgggataaccagtggtccattgtcaggtttgatcggaagctttgcatattctcacagaaatctttttggtaaaaatcaaaaagtcaatgtctcccttgagagggggcaaatcgactctatatttcggataaattacacagtcccgtggattgaaggtgatgataagcgtacgcaacagtcaattatgattcagaattcaagaactcccggtactttggtccatggtaaccagcccgacaatagtaacataaccattggccgtgtaacagccggcatggaattcagtcgtcct

SEQ ID NO: 396 - DNA, 715 bp, Conyza canadensis
ttcactgttggtagttacaatggagcagggacttcctgtgtggtcagagtggctagttttcaatagagttactgcccgtgccaggaaagggctcgtgattggccctgctcgttttaatttaagtctatcaggtggtcatgttgtgggtaactttcctccccatgaagcattcccaattggtggaacaaatagtgtccgagggtatgaagagggtgatattggttctgggagatcttatggtgttggttgtggagaactatctttccctttggtggggccagttgaaggagctatgtttgctgactatggaaccgatcttggttcaggttcaaccgttcctggtgatcctgcgggggcaagatcaaaagttggaagtggatatggttatggcgttggtatacgtgtagcctctccactagggcctcttagactcgaatatgctttcaatgataaaggaacaggaaggtttcactttggtgtcggccaacggaattgaggttttatctgaaaatcagttatattttagtttcttttgcctcaaatttttcttatcattttgtgttctcaattgcaaaaattacatgtccagaaatgagcaagaaaatgtaacaaaatatactaatttttatgctttaaatgcgggtatgatgaaatccatcttaaatccaaaaaaaaaagaaaaaaaaacaaaacatgtcggccgcctcggtctcta

SEQ ID NO: 397 - DNA, 451 bp, Conyza canadensis
ggccattacggtcgggagttgtgcactttatcatcgaaatctgtttgggaggaaccaaaagattaatctttcactagagagggggcaaatcgactcaatatttcggatcaactacactgacccatggattgatggggatgataaaagaacatcgagaacaatcatgattcagaactcaaggactcctggtacacttgtccatggcgatcaaagcaacactagtaacccgaccattggacggatcactgccggaattgaatatagccgtccattcagacccaagtggagtggtactacaggtcttattttccagcgtgctggtgcccgtgatgaaaaaggggatcctatgataagggacatccatagctgccctttaactgcaagtggcaataatcatgatgatttggtgcttgccaaacttgaaagtgtttatactggttctagtgacccc

SEQ ID NO: 398 - DNA, 5222 bp, Conyza canadensis
  unsure (1)..(5222): unsure at all n locations
  unsure (1)..(5222): unsure at all n locations
atgaattaatttacactctaaacttttattttactaattaacactttaaactcttgtcttctaaaaattttcactctcacaattacatcaacctgcaccacttgacaccgccaccaccancaatagtaccatcaccgacatcactagaccaccatgcttaccatcgtggccgcattgtgcgggtaccatgctcgtacctttttataaaaattatcacaccccccaaattttagaaagttatataatagttacatacagaattactaaattacctataataaagacctactatgaaaagagtttttataaaataccaaatttgtccttgatgaattaatttacactctaaacatttattttagtaattaacactttaaggcttaagcccgtatcttctaaaaaattccaactatcacaattacattaatctccaccacttgacacccctaccactatcaatagaccatcattgacatcattagaccgtcttccccaccaccggcgccgcattgcacgggtaacatgctcgtatatatatatatatataggggctgagtataataaaacaaatattaaagtaaataaataagataagatcttgacccttagatcatggtcaaattgatgtacgataattttcatgatccacgatgatatttatgatgtattgaagaaaaatttattattttatttgttttataaaaaatatatataaatagcaaatgctatcagatagtattagggaaaaaaaacactaaccaaacacgccattgttttattttcttttaaaagagcaacccaaacacccgatagttaccctctttaaacccggcaaaaaccctttttctttccaaagaaaattccgttattaacaaaaaccctaccgaatgtcactacttaacttgttgtctccagattagggtttttattttccaaagatattgaaaataatcacaatgcctgaaagcaaatccttcaaattccggtcatcctccgtcaaaatccctaccttttaccccatagcaaaccaccgtcacaaccaccggccactcttcgccgacctccatctctcaatctcttcacttatcaacaattccaaacactctctcactaatttcatttcatctcaaatttcctacaaattccccaatctctcaaacaatttccacagtaaaaacgtgaagaaacagccgttactatgttccgcatcgttagcgttgaccaaaccaggcgaagaagagaacgttaacgagctgactcagttgagtaagactcactcgacgagtcgaaacgacgatgagcgagtgttgattagtgaagtgttggtgagaaataaagacggtgaagaactggaaaggaaggatctagaagaagaagcggttgcggctttgaaaacgtgtagaccgaattccgcattgaccgtacgtgaagttcaggaagatgtgcataggattatcggaagcggttatttctcttcttgtatgcctgttgctgtcgatactcgcgacggcatccgtttagtctttcaggtatatacattattattatatatatacactcaatattatatatatttactctgtatattctgtacacacacaatgttttagggttttagtggcataaattgttatgacttttgttagtacattttacactaacatcatcaattatgcacaactaaaacctaacagaatattttttttaggcgtaaatatatatggttgtttgttagtttttaggcatggcagggtgttactgcacacgaaatgttactgcatctattctactttgaaatttgctgctgtatgtatcaaacaatcaattttttctagtgtatgtatgaccgggttttaatagcatgggagatggcatgtaacgtcgatgaattgaaagttttgatacgtataaaaaaaagtttcaaagtaggatacatacggtagcatttcgtgtaaatttgagtacatttaaaaacaaaatgaacaaaaacccatagcactttaagcatagaaactcgtaagctaggtttagttgtatgcaatcactgtctttagagtatgtacaaatgccatttaaaattgtacttgtaaagaatgaacaataggattaaggacgtgaaatttttttaggtcgctcttagcaggttatgcaaatgaatttaagcggtgtagaaatttgcctacattcaggtggtccagcattgaaactcataagttagggttaatttgtatgtaattaacaaatatacagtatttacagatagtctgtaaaacttaacagaaaaaaggtgaacatcgggcatgagaacataagagtgtttggtagctcttaattagatttggattgcataaagatcagaaaacaagttacgcagatgttttgatttacatctttaagtagtttgcctgcatccactgggttgaaagggttttattatatacgtattatattttagtacatgtattaattgcatgagacaatagacaccaaaattataggaaagacaaactgttatcctaactaggctttgagttgtacaatatggtttatgtacaagttagtatgtaaaagtttacaacagaaagtgagcattaagcttataggatacattattgtgtggcttctctaaaccatatttgaattgcataatcatatagctgagagaagagtagaaagctagttatacaaatggttccatttatgtggctgaatgaattgcttacattcatcgggatttaagatttggactacacattattgtcgagtttattgcatttgcatacatgaaagcagagccggcagtataagaaagttgtgtaaaaggctatgatccatgtatatctattttcgtattgtcatactctttgttaagatggagtcatttatactagtatattttggcataaggtagaaccaaatcaagatttccaagggctagtatgcgaaggagccaatgttctgccaacaaaatttgtagaggataaatttcgtagctcatatggtacgtttctttatagactatcacgtattttgaagcttcatgtgtttcttttattaaactttaacgaaatttatgacaagttgtgcaggaaaaattgtgaatatcaggcgtttggatgaagttataagctctatcaatgggtggtatatggagcgtggtctttttggcctggttagcattgattctatttgtcatatattttctttgtatttctgctgtagaaagctatattggctattccggatggtagatggcagtgtttatttgactataaatgatagagtcaggtgggtaggtcagtgttaaaacaggcagatcgcgtgcattaaaaacaccttgggagagtttcgactcattttctttttaacaaactttcacttgacccatttgacaaatcagagccgaatcttattcagaattgaacttttagcatatgggttgaaattgcgacctgtaaatattctattaatcagctgattgtattttgatgaaatgatcaggtttcaggaattgagattctttctgggggaataatcaggttgcaagtgtcagaagcagaggtcaacaatatatccgtacgttttcttagtaaaacgtaagagttgaatctttgctctctgattatgtattattcccttctgatgtttgacattatatctaaatcattgtgttgcttgtgtgattcagtggtgagcccaccacaggtaaaacgagacctgagacaatacttcgccaacttaatacgaaaaagggacaggtagtagacttgatggcttggtgcataaatttggtattcgccctactatatgtaagtctgtgttaatgtatgttcttctcaggtttatagtatgcttcaagcaaaaagagatgtagatacattgttagcaatgggtatcatggaggatgttagcattgttccgcagcctgctggaggtaacatgaaaacaaatttaagtgatttggatcatggtgataattggcgtggattttttccgcattttgtcataaaacaatgctgttcacttgtgtctgtgtgtttctattcgaagtttatttctatggagcaattaataaacttttaatattttcttacagactctgggaaggtggacctaacagttaatgcagttgagcgtgttagtggaggtatatcagctggtggtggaatatcaagtgggtatgtaatttcgttgtgcgtcttgtagtgtaacaagaggtggcaagataggcaggtcaggtaacgtgtcatatcttgtgtaaggtccaacacaggattaatgcactaataaacggtaggaggctgtatatttgtatgtatagtaatgtagctagattattggcatcttctaacccctttgactccttgtagcctttttattttttttatttggccatttgaacccaaatggacctaaagaaatattattgttttcttatttccgagctgtacaattttgaagggtcactttacattgtttatggtttgtgtatcgatatttgctaattggttctttccacttgtaggatcacaagtggccctctagctggacttatcgggaggtaataaaccctttgaggccttgcgggaagactaagagagtgacatatatcactttacaactattgctgtttacttgggttgagttttcttcaatttatctttgcctttttattttccatttgcagttgtgcactttatcatcgaaatctgtttgggaggaaccaaaagattaatctttcactagagagggggcaaatcgactcaatatttcggatcaactacactgacccatggattgatggggatgataaaagaacatcgagaacaatcatgattcaggtactcatcaaatttggaatttgatatagctatgaaatctgatattaacagggtatttacgtttcatattgcgacttaaagttaacactctggattacgacttgaagctgcagtaactggtaatcatttttggataaacggttgcaacaaaatcgtgtatttaagaataaatgaagttacttattcacccttgttgatatagtttgtcttttactcttatcaaatactatcttataaagcattttgcctttttttcaaatctcaattaagtaattgaactacctaaattacccccattctttattcactaatataaacatctctacctaatataccnnnnnnnnnnttaaatctcaaccattcattttcctctctctcttc

SEQ ID NO: 399 - DNA, 13073 bp, Conyza canadensis
  unsure (1)..(13073): unsure at all n locations
  unsure (1)..(13073): unsure at all n locations
ttcgacgaatttttatatccgagggcggagcccgtacggctaacgcatttggctatcatactctatgnnnnnnnnnatcacccccaccatctcaccgcgggtgggcactatctctcgtatttaataaactgtctttgtttttagtaaaaatgcactcatatttttttggatcatttaaggtattagttccgtaatttgaagattatttacagctaattttattacaactaattatctattctgagtattctatatcaagtcattaattttaaaacgcacatcaaaaccctccttagaaaatgccagatttgaattgaatcattaactgatcctttgtgtttcagaactcaaggactcctggtacacttgtccatggcgatcaaagcaacactagtaacccgaccattggacggatcactgccggaattgaatatagccgtccattcagacccaagtggagtggtactacaggtcttattttccaggttcgtctgcaggctttcatggaaattgaatattgcatatgagtgtttggatgtatgctgcttaattgtttatatacccgttgcctgcttgaagccgacaagccgtaaaaaccagtcatggtatttggactctgaataaaatgattattattatcaaattattaaatggtcaaatgatatgtttggaatacccagtctttatcaaaactgacttttttttaagaaacattaagatcatttaacaggtatttctacgggctttcatggatagtggatatcgtatatgagtgtttggatgggtgttactgattatttagtcattccggactgaaaactcatagtaattaacttttattgctcaaatgattatcatcatctgattatttaagggtcaaacattaattatatataccttcatattacccacactattaacaaaatttaattggaattgtaaaagactaattgtctatgaagtttgctcataataattaagttctgtcttttatttgttagctgcttacatgatcagacctttttaaacactcagtaagtgattttctaatttttacaagctcatacttgatacattggaaaagtgtcctatcaccatctcttttaagatgttttttgtacagctgataatctgattgcgattatttaccatcacataaacagtttcgaaacttacatttaaacatcctctcagttgctaggcttgttttttttttctattcattatgatcatcataaaacagcgtgctggtgcccgtgatgaaaaaggggatcctatgataagggacatccatagctgccctttaactgcaaggtaatcttgagaattccatatttagagccgtgatgtttaatggtcaaacttgactcttttatttttattttttttttcatttttgttgtagtggcaataatcatgatgatttggtgcttgccaaacttgaaagtgtttatactggttctagtgaccccagctcttcactggtaagagatcagatcttttaagtttcaatttgattgtggcactcatggctgattatattgcagttggtagttacaatggagcagggacttcctgtgtggtcagagtggctagttttcaatagagttactgcccgtgccaggaaagggctcgtgattggccctgctcgttttaatttaaggtaaggtgttttattcttgatctcctttgcataattacgttacaaactagaaagttaccgtatcactagtagttcgtcaaagtaaactgttttttggtttctttagtccttttataatcttgcaagatttgatagtctatcaggtggtcatgttgtgggtaactttcctccccatgaagcattcccaattggtggaacaaatagtgtccgagggtatgaagagggtgatattggttctgggagatcttatggtgttggttgtggagaactatctttccctttggtgagtaattcgatcattttttaattttgttgcgacatttctttcacatgttggtttttgttattttctatctttgagatacataaccttgtttagcttgaaataccttttccctactgtaatagtataattttaactttattcgattcacctcgcaggtggggccagttgaaggagctatgtttgctgactatggaaccgatcttggttcaggttcaaccgttcctggtaatctctgccgtcataatagttagtgtataggttgcaggtttgacccattcacctacgaatgaccaaaaccgaaggggtaactgggtcaataggatagggtaaactgatcaaacctggtctaaaccgagatacacctttttttgcagtaagaaaacactccattttctggggctaaactaggcttgagcacgggtcaaaacccagaccgacccgtgcaaacccaaaacctggcagtgcaacaaaattgaacctgtgacccagctcgataccctatcaggcgggtccgttcagttcaggtttggacgggtttggttcggttctcgggtttaagagttcatcacgtgtcaaaacctggcccgacccaacccgaaacctggcagtgcaacaaaattatataagaaatattaattaatgatggttgaaataatattatcatcatctcaatcatatttgacccattgattattcgaaagaatataaaaagcaggataaagaagtgtttttggtgaagtgaatgaccatgtacaaaattcaactttaaatttacaatattattttgtatgtgaaggtgatcctgcgggggcaagatcaaaagttggaagtggatatggttatggcgttggtatacgtgtagcctctccactagggcctcttagactcgaatatgctttcaatgataaaggaacaggaaggtttcactttggtgtcggccaacggaattgaggttttatctgaaaatcagttatattttagtttcttttgcctcaaatttttcttatcattttgtgttctcaattgcaaaaattacatgtccagaaatgagcaagaaaatgtaacaaaatatactaatttttatgctttaaatgcgggtatgatgaaatccatcttaaatccaaacctttctagcatgatatgataagccactttttgttggctgtgcattgtgcaacgtactatgcaagtcactagagcatcattgccttgggataatagataaaagggaagaacgtgtgcttatgatgaattcttgattggttcaacattacacacagactaatgcacttaatgtcgctccaagttcattgaaattataaaattatgttctgttagtgttttccaaatgatctgtgtttcataaaatgtggttgtaattcccgtacactatttgatagttgaaatgtgccaacgagagagcaatatatagatttgttgtcccattcttggggaggcgatatgattttcaccatgtgatagtatccccttcagattgtctagaaaatagaatttaagacttatttgttctcttttcaagtctctaaacttaatattcttgtttgaggatcaatttgttaaattatatgattgattgttccttgctaatacgttttacatacatagagtttgaactaatttgagcaagccgatagtatgattttatacaacgcggcggagtaggaaggattgtatgttagacatgtataataaaaaaagacgatcgttttcttatgttaataatgagagtcaaatgatgcggacctatattatatgtaggtggatcaggctggacagctcacaatctcacacctttttgtttcttttaaatctctgtcggaatttacaagaattcttgtattcatattaatattccttaaagttgtgttcttagaaaattccagtacgacacgattttgtctaaaattgatttgaagtataatataatgaaaaataaaagaatacgaaaaggtttatatatgtaaatatccaactgtaagttccaagtttatttataataaatatatactaatagtaatatgcagttgaatttaatgtaataaaggcaaatggtacaatcaactggagcctactgctatattactatttcaactccaggcctggacatatatggtcgctttccacaaccatacaaacaacattgcgtgagtccagtgtatagttttacagtcaacaattattgtgggtccctctgactttctcataggtgtgtgtcgtaaatttttattttgaactcctaccatttcataccagtattatcctaaaaaggttgaaaaactttttatcctgggtatcctttggagatctatcatcggtgtcattttaaggacaatgtgcaatgtctcaacatttgaattcatgatctttaattttaattggtccacccaaatgatttcacaatgggaaaatgatgttaattaatagattcaaagactacttgcttctatgcaagtattattattattttgtgtcatgacttaacattgtgatatcctaactttaagggtaaagttagaagcatcttaacctttggattgaaatcaaagatcaagatttaaagatgatgtttgagtcttaacccttaattttaattcaaggattaagattaacaactttacccctaaagttataattaattttagggaatccccatcctatatatatatatatatacatatcttacaatgttatactatttgaatagtagaaatagcggacgaagttttcttatttaggttacacatgggagccaagtttattttactccaaatgtatgatcgaaactttccttggccgttgcgttaatattgttactcgtataattttaattcattcctagagggttggcctagcaatctatctcttgatagatttaacaaataaaagtctatgagttaaaatcttatttaaatttagaatagatataaacgataattgtgtgggaagtatttgtttttctaagaaatatatattaatttttctcttatatagattaaaagataaaagaaaaaagctagctagagtaattaattacaaggaatacattgttgttaatttctttgtttcttaaatatatactcggtctatatacgatacaattgtttaactaattaaagtaattcataacttgaatgtagaaaaaacattgaacctatccagacacaataataaagagatcgactatatatgaggattaaaacaaattaacagaatggacgaagttaatagtagttagggatgtggcacgtggatgagtccgacagagtttttcatttgtgatgggtaaagtcacggtttgccgctcgcgtctttttccatcaattattagctctcatcaaattaaaccacatacatccaaggagtcggccatgaatccattgattacatatggtttttctttttacgtacaacaggtattgaaaaatgttgggtttagtttggttcggataactcaatgcattgaagagcaattaatgggagtgaaataaaatgaggaattctagtgtatccgctgaaaaatgtttggtttagtttggttcggatgactatactcactatttatttttttaaacgatattttattctactttctagtcctaaattacaaatatgtctgaaaattaggactctaaaaaaactcctacccttacaaatgtaaaaagtgacacttgaacccagatggattattccaaagtcaaaaaccttacaattggtcaccaaccaattactatatattttttttatcatataaacgtgcataaattatattatcacaccgttcggttattgtaacccattatttgttgtacagaaatacttttctatactaatggtcggagttttacatttgtggtttctttcaggatttgtggatattcgaatcatgccaaatgtaaatatgattttagggtcttagctacgttatactcactaagattagagaacaaaccctttggaagtttagagagtagctaggatttgattttaaggtgggcgtaccaaagttgaggatgtcagctagttaatcatgaagatcgaggtgattaatttggccgggtaaccctaatcatttatttaatgtttgttaattgtaaaattaaattataaagagaaacatttagatcacgacatccaatacatgatgcttcgttttgctgggagcaaaatatggatatcccagttaccttctttatcgagtttttgctagctatataactaataagcgttatttttattgtgttcgtatatagaacgcttataagattatatttcaggccttaatttcaaaaagatcaatctttacacgtgacataaaaaagagagagttgatattggatcacaagaatcaataaatctaccaaatatatggattgtattacggttacaatattctataaaccttgtatattgtgatacagtatatttgtgatacacattgattattttatgtggcaataataatccatttacgtgaatgaatacaaaattgtaaaccaaaaataagtagatccaaacacccttgcagcaaaattgttaaaaaaaaaaaagagttgtccaattcaaattcaataaaaacagaaaagaaaaccctagtcaaaaaagtggaaaattcaattaaagacaagaccaattgtattgtactattacaatgaacatacacaacatatattcacatacaggcagcagctaccttctgtaacactgtgactgtgagattgtgacgaatgaaacagtagtggtttactggttttcatgtgcatgtaatatatttatattataatatgatgatgatgaagttaaaatggaagaggtgtgtgtgtgtgtgttttggaagggaggggaggcatgatcgatcgatgtaagataggcgaccatagctcgctcttcaaagcgcactgccgggccgggtttaaagaaagtacttgggaaagtatttggttcccgaggaacagtatgtaggaaaggacacagggatacacgcacacactgtctcttattttggtgtgtttttttggaggattgcattttttttttttatatatataatgggagacaactatttaccctaatttcatgaacttgtctttttggtcacttcatttcatttcatacacccacaatctacccaccggccaattgttttccattcacaatttcacatgttgctttttatatatatatgtatgactactaattgagtaattgtatatgcttaattttcatcgatcaacttttctagtacacttggttcatcttcaattcaaagtatgataaaatctagatgatgtacctatctatatatttactatacgtatgcacccccggggaagggggtgcggtctgatgatgaacgtttctcaaatatgtgacgactatgtgttaaattacttaaaaagttgtaagctattcatttaactgaaggcgctttatgtaattagtcgttagtatcatcaaaaacgtcatatcataacaatttgaaataattatatatacataaagaaacttataaaacggagtaagctatttgggatatagagttgagcctttggctttgatgtatgcggtttaattaaccgatagtcgagctatatataaggaaatgattattcctcttaacaaactagcttaaaaatccttctaactattagatgacgacatgtgaaaaacttagggggcaagattagaaaagagaattagtgaataacacatgtcacctttttaaggttttaagaggatttttaggttattttttaggaagattaatcattttccatatatattattctctagtcatcttaaggccatggtgttttacctatatattgagaggttcgaacccaagtctcttttgatgtttgtcgaccactttaattaccactagctagtacgtacattggatatgatgcctaggtagctacttttttcactggggtattaggattaaaataaaacgtaacaatatcaagtgtaatcaactgtttattagtatatatggatatgatgcctacttttttcggactagagaaaaatatagagggacaagatattactagccctccctgtggtgtgactaaacatgagagaaacatggtagctagagagagaaccaataatatataataattactattattattaacacacatcagggatatctaagtgagagataaatgttggggcctatagaacaagcttcattggtgttgttgttcagtcttttacctttttcacctttttggtccatatcttctctctctttgtgtgtgtatgtgttatcactttctctgcataagtttgatctttgtagtgtaatttcttagctagcttcttcatcagtagttctactacaataatcaataatgagtaattatccatattcctcatactacaatggatcatggttcaatcttaataaaaactctctttcttcttcttcacaatcatcaacttatgatcaacaattactttcatcacctccttctccacctcttagagaagctcttcctcttttaagttttagcccaacaagaaagcttaaccatgatcatcagttcatggaaattgatgatcactacaataatagcaattgcaataagctactaatttctgatgatgatgatgatcataatgaaagtagtgtgactgtggccttacatcttggcctcccaaaccacaatctttctgaagaagctgatctgatttcaagactctcaaccaatactactagtgatgaaatggataataaacaagtggagatggaagatggtacaacaaataaggacaataataatggctatttcctaacaagcacactcaacaagggccagtattggatcccaactccatctcaaattctcatcggcccaactcagttttcttgccctctttgtttcaaaactttcaacagatacaataacatgcaggtattactactacaattactatcattttcaaagtttttttctttaaattgtgctctttccttttcttttcttttttttttctttttttgtgaaggaaaaattaaaaaaaatactgaattttgaacgacagtgtgaacaattaattagataaataactgttctagctagcaaggtgctggcggcggagcaaagacttactaccataggtgtcaaagggtatttaggcgtataaactatatattacgagtattaaagatatatattacaagatttcttcttattcagatctaattaaagatataaccttatcaaattaatgaagtatcaccaccatcatatactataatgaaaaatcacgttttctttcatccacaagcgtatatatatcaaggtgcgtgtcctagatagtcgtagttacgtgatatactcacaggaggctttaggttcactagataaacgttttaatggctggtggccaagaaaaagtttcacaaatgatgcgtacatacgagacaaagatcgactcatcacagtctatatataaattaaggctagctagctagggttaagttttccgttatttgttcacctttcatatatatgttgattgattatatatacagttatgcatcaggttaagtggttaacaacacataataaagagagatcttgaacaaatcaagtattttggtccaactgtcataatgatccaagattagtcagcagtagtagtactggctactgtgcttccaaagaaagagagaaataagtctcgatctactttatatttgattgaacaagacaagtatatatatattatgctttttgttccttgaagtctggtttctttttctttttctctgatttcattggtagttgtatgtattcatcatctctgattcattccagatatatatatatttattactccgtattatatatatcttcattcataaccaaacaagaacagtattaataaaagaaaaaagaaaagccttcttctgatcatgatctatcttagttctctgaccactcacccaggtttaatctacatacaagtccccacctttttttatttagacttattttatatatagtaattatgattttcttttctttcctaattaagttgaagagatatcaaatttaaatacacacagagttttaagtcctttctgtactgtttttcaagtaagtatatgtttgtcttcttatgtttgattttatatttagtactataccatggagggtgtatttttgttgttttatgaacagtagctctcaatttggagaacctaacggatccaagaagactctacagataataattacataaaatgtcaaaaagggggtgtagctagctatgacattgtggttgttcattccttaattcacttctcaactgttcaaatcctcaacagtacgtgttgaattttaattaagaggccggccagcatgcaaattaagcagtagagattaaattaattaacctagtttaattgctaaaaaaggttttcagttttatcaatgaacattcaagcatcatttttgaatatatataaaatggttccagaattttacaattacatttccttgaagtcattatatatatgtttatgtttgcttcattgctagctagctagggagtcgcctaatatttttgattaattgcatataattattggtctaatacgtacgtacagatgcatatgtgggggcatggatctcaatacaggagaggcccggaatccctgaggggaatacaaccaacagccatgctaaggctaccatgctactgctgtgcaccgaggtgccataacaacattgaccacccgcgtgctaaacctctcaaagatttcaggaccctccagacacattacaagagaaaacacgggatcaaaccctttatgtgcaggaaatgcggcaaggcttttgcagttagaggtgattggcgaacccacgagaagaattgcgggaagctttggtattgtagttgtggatcggattttaagcacaagaggtccttgaaagatcacattaaggcatttggaaatgggcattcagcttatgggatcgatgacgagtcctgctttgagttggaagaagaagaagaagaagctgcgaattctgagattgatcatcaagaaaatgaatcgtgtattaattagctagtggcgatgcatgcttaataaaaaatatctatatatatatagattatatatatcaagatcatatattggaaagacgtacccttttattattattatatatatatttgctagctagctactatgaattaatgttgtttatgatttcatgaagagcttcaattctagataatcaagatttgtaaattcctgttttaatatttggagtacaagttatgaattaaatgtattggtgtttgtagtactatatactagagtttaatgttggtagatataaggatggggaaagaggtcaatgtgcattggtgtttcatgtttcaaggtttcattgagaagttgatactaaattcatctggcaaatgcatgtgcactttttctctcaatccttttattggagtcatatgaatttaagaggacacctaaaatattaagtgatatatatatatatatatgatacatatgcaatagattaatacttgattcctaaatctagtaaatactataaaagaaacttaaccttgaatgacaaccggctgcaggtgatttttgtttttacttgatctatgttatgagatttctattatatatgtttttctaaggtgatatatacatttagtgtttgaataacaacgagttgggttattagtagggaagtacttggtgatttaagatctcaagtttgatcttcgtttggtatataaaaaaagttcttttgaagtctagactcacacgtgaagttgtaaagacacgggttcgatcgatctttcggggtgttcaaatcatgtggagaaatagatggaggaattgtatcggcataatatgactcatacgtggtgagttgatgagtatctaattgtggtaccaaggtgagtgttccctccattatttttattttttttacatttggtgttcgagaagtgatgggttgacaaactaataacaaacaaattttctagcaatcaaaatcaactcatttttttttctcttttttctttctccctctttgttggttgttctacatcacacataaaacttaatttgtttgtatatttaacattataacttaaaatcactcatatatagaatatgtaatcaatattgcgtcatacatttatcagataactaggaagtgattgatatacttaattatgatattgactcaacaatgtacctaagagtgatatttaattagacgtgtgtataatggttgatcatgtttaatatttcgtggtttagagtaagtgtaacaaaattagtatatatgtatgtatataagttctgcttcaactgaaaaaaatattgaaaaataaactaaataaaatgataattttaacttaattaaaagccgatgtatatcatgaaaatttatatatatcagttttatcataatccaataatcaaaatcttaagtatgtattaattactttacccacttattcataatatagtcgactctcaaataagttgagtaaaacaatatatttttgaaaaataactaatttgtgagatttagttacattttaccgacagaacaactgggcttttgcaggtctctagaaaaagctagcgtaattaaaacttgacaggataatgttacgacatctattgcgaaaacgatgaatcaatgacgaccatcatcatatatatatatatatatgtttattgtaatttagttaattggaccacaaagtgtgtgcagtttgtactggattttaagatagttgcatgagtacgtgacaatcattgattggtctttatagtcgtataatgtacgagaaagtataatggaaaggttcagtttgtctagcatagtttctaattaatatattcgtttggaccagcctaccgtagctacaacatagaataaaatggtggttatgtcattttcaaaacaaaacaatatgtttcttcgattgataccaattatttatgtataataatcaaccacgatgtacttaatattcagatgataaatatgagatatggtagagatggaacgatccatattctat

SEQ ID NO: 400 - DNA, 3354 bp, Cyperus esculentus
ttatgtttaatttttttaaaataaatatttttattttataaactttattatttttttgttatcatatttcggggcggagcccgagttacaactctagtattaataatgtcaagaatgccctaggtggttgttctttattaagagccaaaacttatcctgacctaatatatacctactaattttatctgttcttctgaagtgcatcgggtggccatgtggagggtaactttccgccccatgaagcatttgcaattggtggcactaacagcgtacgtggatacgaggaaggagccgtaggttctggccggtcatatgctgtaggcagtggagaagtatctttccgtatggtaagaattactcctttaccattttatttttgaatggttaggcacagtttaccccaaaacttttcatgtcaatgcctttcttaaaaaaatgttactgaaggattcgattttgattgtatggtgctatcaagcaagtattacctaacctgtgtatatctgcttgtttatcccaaatttgtaatacactaatcttccgaaccagatactatgcagtatgtagtttctgtaatgtaataaagtcagatggctatcttataaatgatttgaaatgtatgcgagagatgttataaataaatagtttctagttgaaatgtaatcctcatttttatttatttatttattttttggtagtatgggccactagaaggtgtggtgtttggtgactacggaagtgaccttggctctggtccgaaagtacctggtatttctctctcctcttaaaataatatctcccagtaaactgttggcagcaacgtctaaatgaaataacacagaattgtgaaataagaaaataataaagacatagaggcatagatccacttttaactctccctcgctctctttttgaaaatttggctggagctgtcaaggtctctctctgcgaacataaccaaagttccaaactagtgaaatgcgtatggactgtactcatgcataagaatggtatacaatctaaaagggatagtatgaagttgagctcattctgctaaataaagccggctgagtgcattctatatttccctgtggtctttttcacaggtgaccctgcaggagcaaggggaaaaccaggcagtggttatgggtatggagttggcattcgtgtagactcaccactggggccattaaggctggagtatgcatttaatgataggcaagctagaaggttccattttggtgtgggatacaggaattaacatttttgttttaggtttatagataagcaagctagaaaggtgtttgcggcttattcattaatttttcctgtgaattttggttttccttctttttttttttactcattcttgtgtttccttctccctgtttctttttctttgttgttttgttttttggttatcgcagaggatgcgagtcttgatataatgtggctatttatctcagctctaaaaccatagtaccgtaccaggatatatgtttatatggtccaaaagccaaagcttttgatgtcatgctatacacagtggtatagtgggtatgattttcttttttcttttctttgaaataagatgaggtttaaaccactcaaatttaaatgtctgtcacctggttttgaacccgccaccccatctgatttgttcttttagctcacttttgcctagcaaaagtacagagttacaacagtctgtacctgatactattcttacaagaaaatatctagttttgcaatgaggcatccattagaaaatgtatgcatatgaatgtattgagcagctatatagtacgttcttttatatttatttgtcggcacgcgttttcaatttttaactgaagcttaataactgaaatttatggaagcgttcggctggttaagagaatgtatttttggtcacttagtaacaatctttgttaatccttttcattttacatttgatgccaaagtgacgttcgtaattcaacagcagtacaggcgtacagcaccaagtgaaaacgtaaaattctaacatatgttggattatttcatggaaagatgaccgacttgtggctatcaaatgatcaacaaaattatgctccctgtcatgtactcatgttggtaacgtgtctacgcatatgcatgtatgcgaggaaataaggttggtattggaagttaagcatgtactggtgggttttgattctcattcttttcttatcattcatgcattacctttttttagggttcattttggaaaaagaaaaacgagcttcactgttcatgagttttaattggatattcaaatattcaagttttgatatctaattatatataagcaacatttaggttatatataaacaacatttaagcgacaagatgcgcaatctggccatatctcattctctgcagttaaacttaaacacaatggtcgtcattgttggatttttgctgcattaaacgtggaccatagacaggtctatttcttaatttaaccccccagaccccaacacacacacaatttataatgttgttctgtcacaattttatttagttatttttttatcgacattgcacgcttttctaaactaaaagaaaaatctgccccttttgcgggactcatttataagaaaaacaaaattattacttttttaagtcattttgttagatacttgtaaatgctaaatccaaattgttcttaatcacatagtaaaacttaaaagaccaaaaattataagatacctctttagaccacaaatctaatagcccaaaatcttatacatgcaatttggacataataatagtccgaacgtcttgtacagatagacatcttaaatataaatatttctaataagtacattatcaaaaaaaaaaaaaaaggaaaatgaatccaacaaagaaaataatagagaagaaagaaagagagacacacatggaacctccatcattagtcgtttcaaactattaaaaaaatgtatgattaaaaaataattctgtcaatgccaattctattagacataaatttaatggaagactctttttatagtaacaaacgacgttctccatcgctgttgattgttttttcatgtgacgggtttttatttaattgatttcaactgcaaaaatgtaatgatatctttaatttaataaaccttaaaatttggaaatgatatatctcttatatagggaggcatttcagcattattgggtgttagacaaattaatgaaatgtttaaatattgcaaattacacaatccaagactccaagtaatgcttgaacttaaacaactaactagaaaggttgcgcgctccgcgcgactgagatattatggtaaaaaaaaatacctgtacaatacgattaaa

SEQ ID NO: 401 - DNA, 3234 bp, Cyperus esculentus
ccatcagaggatgagatcggagagaaggagatcggagatgagaagttcgtgatttgatttggttgattttaaatttcattgaaccgacgttagaccgaaaaaaaatcgcatccagttttatggtatcaactatggtatctaacatggtatccacctagaatttttcaggggaatattctcagggatgtcattgttggcaactggtaccatgattagccttatgttatttcatgtataatctctcccatatcacctgtaaattctttttctgcattcacagatgaactgaaataactcacagctttaaattgatgacatgacatgatttctctattaactctctatgtgtttgaataattaatcagcactcagttactccagaggtagcagtgcatgggtcaccagtcgatagtttcacccgatcagggagtagagggatcaacctatgtcggttttctttaggttttgatataggggaatctatcacacctaactggagcaacacgactactattaaatttgaggtcggtaacaacaccatctcacactattttcacaaggtctaatatggcttcttttaactgcaaaccattcttttcatgtgcagcatataaagccaattaataatgaaggacggtcaataagaagtgatgttgatggttttcctattactcataggtaattttgtgcagataacttttgtttgactaaatcacatttttcaatatttagtaatttgaaatggtgtattattttttataaagtgggaatctccatgacaatatggttgtgttgaagcaagaatctgaatatgctgttacagaaggcaacaccttctcaagagtaattaccttttctcttttattgtttccattgtttctgtatgtttacttttttaagctgcactttaccgaaagatcttttatctcagctgcaatttcaaatggagcaaggcttgcctcttttgccaaagtttctcattttcaaccggttcaaatttactgcatctaagggaatgaaattgggccgtactttcttcattggcaggtgggttcattctttgccttctaatatttattgtggctgaaactcatgttcaaacataacctgtgtgggtttttggatctgacagcctaacaggtggctccatggtaggtgatatggcaccataccaggcattcacaattggaggtcctggtagtgtaagaggctacggggaaggtgcagtaggctctggcagatcttgtttggtggcaaatggtgaactagttattcccgtggtatgttaactcttgtattatatatagatctttcgtttgcacaataaacacttcttttaggttcccgaaaaccatatgagactttatataatggatacatatgatggaaacgtataaattgactttggcttgcctaaaagacctggaatcaaggtcatagttgtcaaaactaataaatttactgtggtttgccatcacttgtaaccagtgaacaaacttgttgaagaatgcatggaaacactagttatataattctagtgatatttgttgatctcttgcatggacccaaaccttattattaatcagaaaataggttgacaccacggttcatgatcgcatgttatcatatcattgatgcatctttattctttaatcaatcgcaggccaagaattttgaggggtctctctttgtggattgtggaaccgaccttggctcagctcgatttgtgcctggtaaccatgattgttatatcttttctaaactaaaactttttgtttctggtatttctatgacaaattttccataattacttctgatacttgtttgacaggtaacccggcactcaggaacgggaaacctggatttggagttggcttaggctacggtgtccggttcaactctaatgtggggcaattgagattagattatgccataaacgcatttcaaaggaagactttatatttcggcattaattgtggcggtgcctgaggtcactcacatgatgagaaggattaattgcacactggcactgcctagcatcttcatataatagtcagatgaagaggattctttcttcgcccactatacctcggtatctctacaaggtcacatgacatgactggcattctttgcacagtattgcgtatgttctgatcacaggctagattggtcaaaaattggtagcaattttaaaaaaagagtttgttttgttgcctagggtgatctaattgttctttttctttgctaaccatacatacttccataccaaaaaagaaaaaaaaaaatactgtacatataatcaactcactgttatctgttcttgagtgaatgaaaatatcttttcctagcctgggcagcagctgccagatctctctcatgatgctagtagaggtccaataatgttgggaataattcattccttgacgtacattttggatctatttgttgacgtgactatttttttttttaatagatacatggtacttgtatataataattaaataaattatgtataatctaagattctaagttataatttttagaaaactgttatagagtattaaaagtgatattaaaattgatactgattgtgttaatattcatatataaaataggtatgttttcaaattattagtttcatctttctatcaaaaagaataattattggttttgctgcaactttgtacagtgtgctgagatatattatataaataagttaaatactttaataagttaatttgaacatcgatacatttaaaatgaatatcgattttggtatcttcccggtatctctgtatcaattccataatttttaatacatgttcatcagggtacatgtgaccgtgtttctcaacatttaaaacatatatttagctataagatatcatgtgcattaaaagatgatgctgtttgatacaggttttatatgtactttccaaccgtccgtatatgatggtcctcaaaaactcaaaaagaatatcatatcatatcatatggcatttaaaatattacaacagtaaacgagtacaatattttttcttacaaaataagttcatttaaatgcacaattactagtcaatttttgtgatgtatctcgaaaacaaatgttgaaagtatagtattattgtcaaaaacaaactcattaatgttgaaaagacgtacacggtcaatttttgtggagtaataactagtgtacgtagaaaaactgttcataccatctatagattacatatt

SEQ ID NO: 402 - DNA, 4423 bp, Cyperus esculentus
tccttccttccttccttccaatggcgtaacccttaaaccctcccccgactcaaaaccctaaccctcaactaaccaaccaactccacccccatcccccattcccatggctccttcgggtagaaacaaggacgtgcgcttcgtctcttcctcctccatcaagctcccctcgctacccccctccccctcttcactgcctcccattctctccgcgctgcccttcgcgcgcctccgccttgactgcttcatggattctgtccactccgccgtggcctcctatgccaggaccgtcgggcagagactccgacgaactaagctcgctctcgccatatccgatcccaattccgaccccaaaggtagtactctgaaggaagagaggattctcatcagcgaggtcttggtacgcactaaggtcagtgattcagttcagttccattcactcctgggaactggttcagatatcaaaaatggatgatcacatcatgcaatccgtaattcaataatgctaaaattatgtacacaggatggggagccgctggagaggggtgacctggaagaggtggcgaaaggggcgctcagagcttgccgagcaaacaccgcgctgacatcgcgtgatgtagaggaggatgttgcccgcattgttgagactgggctcttccgctcctgtgtgcccgtcgccttcgacacccgtgatggcatccgtctcgtcttccaggtagttctttatcagggtttaggaatcaaatgcaatcatctgatgatctgaaaactaacagcaaactttagaggactgaaaacaactaaactaaaatccgatattaataattattgtctagtgtgataacattagctgacagtaattttctttttgtcatgtcatcaccttgctctgaaagaggggatattgagatgaatttgatcatttcttgtattgacatgatagaacaaaaaaaagaaagaaaggagataaaactatgattttatctgtgtatagtaggtatttgggtttctcttctaagagcaccccaagtgggaatcaagatagctgcacactttctcactaagaaattgcttaccgtcaattacttaatcattttgggtgagacaaaattgcctagtgaattgccaaacatggcagtaagatgacccataaagagtgatggaattaagagaaccgtagcataatctgtgtattggactcctttattctgaacagcaatagttttgttgtaacctgaatttgcattttgttcatcggttatttttgtttttgagacttgcctgtcttgattgaaaaaattttaattgcttttacaggtagagccaaatcaggattttagagggttgatttgtgagggtgcaaatcatcttccaacaaagttcctacaagatgctttccgtgatcaatatggtaggtgtcattctttccctcccaatcttgtttctcatcttgtatttgttgataaattagatacacaaataatccttcagcttgtgaaatgggcctccttattaaaagtttcttgtgtcaagtcatgcagggaagatagtaaacattaggcatcttgaaagagttgtaaaatccattaatgattggtatgatgatcgtggtctacttggtgcggtatgtgcccaaccttaacttttatgtttatacttgtgtttacctgtaaattaaattcactttcacctttttttttttttttcatatagttttcaggtgttgaaattctgtcagggggcatgcttaggatgcaggtgtcagagtgtgaggttaataatataattattcgtttcctcgataaaaaaacgtaagcttgttttctattccattataaataatttttttgaaggttatattttctgtaatattttgtgtttgacattaaaatgctctcttcaggggagaacccactattggaaagacaaaaccagagaccatactccagcaattaactacaaagaagggccaggtgtgcaatctgaatgttatccgctcactgtttttgtgcctgtttatatggaacaaaggaactttaattgcgtttgttccaggtatgggtttgccaatattgaaattaccttccttttcttatatgttaaattaataggtatttagtcgcgaacaaattcagagagacgttgagacgatacttacaatgggaattatggaaactgtcagcattattccacaacaaattggaggtcagaatgtatatatgttataatattcaaatttctatggttaaacattagttttgtgacgtgtagcttgtaaaatgttatatctattgttgtgtagattcaagcaaagtcgaccttgtaatgaaccttgtagaaaggccttcaggtggtttctcagctggtggcggaatctccagtgggtatgccacacacattaattagtttttgtctctatctattctagactgtgcaagtttaaatatgtaacaccgacatttgacattttaaatggatctgcagtcctctcatttaacaaagtgttctctctcttttgaattagagcaatatacatagaaaggatagtctttatgagaacaatattgtattttgtagcagtcacaggatattcttgtcatttactgactcaagtaaatatttataggattggttgaaaaaattattatttaaacctttttggttgtttctagtatggcttattgtgattttcgaaacattctcctctcaattatatgatttatatttcagcatatattgtcttttaattaagcttcagtatcctacaatcttttatgcaggattacgaatgggccactttcaggacttattggcaggtaatttctgtttccttctttgcccctaaatggtgttcattttgttcagctaactccagaaaccgtgaatcttgatcctctcatttggctttaatgcagctttgcgtactcacatcgaaatgtgtttgggaggaacaagaaattgaatctctctttagaaagaggtcagatagactctatttttcgcattaattacactgacccatggattgacggtgacaacaaaagaacttctcgaactattatggttcaggttaggaaattattttgttgtagtttgccatttaaatttatgaagtacttgtttttggtaccatcttttccgatttgatacaatttgtgggagaagaggaaagggggtgttgtgcaactttaatttatccaaaattagatcactctctcctttttataatataaaatgaccaaaaacattatacatgaggtggatgtcgtgtttgtagtttcatagtaattttttaaattcttctcgaagtttccttacgttttatgttgttggtaccagaactcgaggactccaggcacactggtacatggtgctgaacagccaggttatggaggcctgacaattggtcgagtcactgctgggatagagtatagccggcctttcagacctaagtggagtggcacccttggactaatattccaggtattactatttatagttttatactgattaaatttatgtgcactgtgctataggctaaatgtgaaacatttcttttgctagaggtaatttcttggataaatcataaaaacgagcagctaaatagtatttgaaatagtaaagtatattgtatacatgctctgcaagggcgggctatccaacttttgttatttgcttgactactgaacctaaaaataagatcatgacatatttgttctacttcattagcacgcaggtgctcgtgatgacacgggtgatccaataataagagatttctacaactgccaacttactgcaaggtgagccattcatccctttccctgtccctctctcactcactcacctccccctatctctgcctttcattcgtccaaataactagcttacaattatgtatgtgctcagtggaaatgcatatgatgatacccttctagcaaaatttgagagcatctatactgactctggtgaccatagctccactatggttagtaatatctgattccctgcttatcatgttttttcttaaatcttttctcatgtctatttcttttttaatgtgttgcagttagtgctgaatgtcgagcaagggctgccagttttacctgagtggttatgtttcaaccgagtaactgcccgtattcgccaaggttttgaggtcggcccagctcggttactttttaggtaacattttttgttgaccaaatctgttttgagaaagttttacctttctgaagatcacttttaccctttaacttattttgttgaatatagttgaacaaaacttcagggttttatgaactattacgagtcagcagttttattgaggaacttcatttgaatctttagaattactcatcctaattctcttgactagaaattagaatctataaacaagaaagaggggtaactctccaagcatctcaac

SEQ ID NO: 403 - DNA, 647 bp, Echinochloa colona
atggtgacaacaagagaacctctagaactgttatggttcagaactctaggactcctggaacacttgttcatggtggtgatcatcctgaccatgggcctataacgattggacgtgttactgccggcttggagtatagccgaccattcaggccaaaatggagtgggacactcggcttaatttttcagcatgctggtgctcgggatgacaaaggcaaccctatcatcagggatttctataacagccaattaacggccagtggaaatgcttatgatgatacgttgcttgctaagtttgaaagtatctacacagattctggagaccatagctctacaatgttcgttttcaatgttgagcaaggtctccctgttgttcctgagtggctaagcttcaacagagtgacagcacgtttgaggcaaggctatgaaatcggtcctgctcggcttcttctaagtgcctctggaggtcatgtggagggaaattttccacctcatgaagcatttgcaattggtgggacaaatagtgtaagaggatacgaagaaggtgctgttggttctgggcgttcttatgctgtaggtagtggagaagtgtcatgccgcttgtttgggcctctggaaggtgtggtctttggtgactatggtagtgatctc

SEQ ID NO: 404 - DNA, 621 bp, Echinochloa crus-galli
cagctttgcatattcacaccggacgtctttgggaggaacaaaaaattgaatctttcactggaaagggggcagattgattctatttttagattgaattttactgacccatggattgatggtgacaacaagagaacctctagaactgttatggttcagaactctaggactcctggaacacttgttcatggtggtgatcatcctgaccatgggcctataacgattggacgtgttactgctggcttggagtatagccgaccattcaggccaaaatggagtgggacactcggcttaatttttcagcatgctggtgctcgggatgacaaaggcaatcctatcatcagggatttctataacagccaattaacggccagtggaaatgcttatgatgatacgctgcttgctaagtttgaaagtgtctacacagattctggagaccatagctctacaatgttcgttttcaatgttgagcaaggtctccctgttgttcctgagtggctaagcttcaacagagtgacagcacgtttgaggcaaggctatgaaatcggtcctgctcggcttcttctaagtgcttctggaggtcacgtggagggaaattttccacctcatgaagcatttgcaatt

SEQ ID NO: 405 - DNA, 508 bp, Echinochloa crus-galli
acttccatgggttggtctgcgagggcgccaacatactgccttccaagttcctggaagatgcattccgtgatcgccatggaaaaatcattaacattagacatcttgatcaagtgataaagtctgttaatggatggtatcaggaacggggtctaactggactggtttcatatgctgagatactttctggcggaattttgaggctgcaagtttcagaagctgaggttaataacatcaacattcgctttcttgatagaaaactggggaaccaactgttggaaagacacagccagagaccatccttcgacagcttaccaccaagaaagggcaggcttacaatagggcacaagtcaaaagggatgttgaaacaatacttactatgggaatcatggaggatgttacaataattccacagccagttggagattcaaataaagttgaccttgtcatgaatcttgttgaacgcccttcgggtggtttctctgctggtggtggcatttcaagtgggata

SEQ ID NO: 406 - DNA, 535 bp, Euphorbia heterophylla
agttactagtagtggcaatccccacgactctatggtagtcttgaagcaagaatctcgatatgctacggcaaacgaccacagtttctctcgtttgagcatgcaaatagagcaagggatccctgttttatcaaagtggcttatctttaaccgtttcaaattttctgcaactaggggaattaaactcgggccagcatttttcttggcaagcttgagtggtggttcaatagtgggggacatggctccttatcaagcatttgctattggtggtgttggaagcgtgagaggatacggtgaaggtgcagttggatcagggcgatcgtgtctagttgcaaacagcgaactaacaattcctttgaacaagatgctggaaggggttgctttcttagactgtgggacggatttggggtctggccggcttgtacctggaaacccggcgctaagacaggggaagccagggtcgggaatggggttcggttatgggtttcgggtgaaatctccaattggtcatttacaggtcgattatgcaatcaatgcg

SEQ ID NO: 407 - DNA, 469 bp, Euphorbia heterophylla
tggtgtagaattcagtcgacctctgaggccaaagtggagtgggacggcgtggcttatattccagcatactggtgctcgtgatgaaaaaggaaatccaatcatcaaagaccactacagcagccctcttactgcaagtggcaagactcatgatgatatgctacttgcaaagttcgaaagcgtctatactggctctggcgaccatggttcttcaatgtttgtgttgaatgtggaacaaggacttcccctttggcccgagtggctgtttttcaacagagtaaatgctcgtgctagaaagggtgtagaaattggtcctgctctctttcttctaagtttgtctggtggccatgtggtcggtaatttttcccctcatgaagcatttgccatcggtgggaccaacagtgtgagaggatatgaagagggtgcagtaggatctggccgatcttatgttgttggctctggtgaaatttct

SEQ ID NO: 408 - DNA, 1078 bp, Euphorbia heterophylla
ccagggtcggatgcgttggtaactcagcccaaggctagtggcggcggtcactcagtgagtcgacacgacgaggagcgagttttgattagtgaagtactggtgagaaacaaggacggcgaggagctcgagaggaaggatcttgaggctgaggctttggctgcattgaaagcgagccgtgctaactcggctctcactgtgcgtgaggttcaggaagatgtgcataggattattgatagtggatacttttgctcttgtatgcctgtcgctgtggacactcgtgatggtatacgattagtgtttcaggtagaaccaaaccaagagttccatggactggtttgtgaaggagctagtgttcttccaacaaagtttctagaggattcttttcgaggcggatatggaaaggtggttaatatcaggcatttggacgatgttataacttccatcaatggctggtatatggagcgtggtctttttggattggtttcaggcgttgagatcctttctggaggtatcataaggttacaagttgctgaagcggaagttaacaacatatctattcgtttccttgaccggaaaactggagagccaactaaagggaagaccaaacctgaaacaattctgcggcaacttacaacaaaaaaggggcaggtgtacagcatgcttcaaggaaaaagagatgtagatactgtgttaactatgggaatcatggaagatgttagcattattcctcaacctgctggagataccggtaaagttgatttggtgatgaatgttgttgaacgcccaagtgggggtttctctgctggtggtgggatatctagtgggattacaagcggacctctgtcaggacttattggaagctttacatattcccacaggaatgtttttggaagaaatcagaaacttaatatctctttagagagaggtcaaattgattcaatatttcgaataaactacacagacccatggattcaaggcgatgataaacggacatctagaactataatggttcagaattctagaacacctgggaatcttgttcatggtaaccaacctggcaatagcagtctcaccattg

SEQ ID NO: 409 - DNA, 1477 bp, Euphorbia heterophylla
ggataaagggctgtacgattcaaatgtgttaatagcttataggagaccgagacccgaatggcttcctcaacaatgtcttaaacttcagcattctctttgtcctgaaattggagttcatggtatacctgtagaaaacttctctcgatcgggtagtggaggtgtgaatttgtctcgattgtcagctgggttggatcgcactgagcctgcgagctctcaatggagtaccacaaccagcgttaaatttgaggttggatgagttcaataggatttgttttcttcttttgtgatgcttttctttgtgttatttctatctatctaccactatttgtaggatttgatagaagaagtgatggttatgctctaaaatgcagcatgttcgcctactgaatgacgatggccgctcgatatcttgtgatcttgatggatttccagttactagtaggtatgaaaccttgcatcaattatttaacagtctataatatacgctattgagtaacatttgttgtgaaatatttgtttttcagtggcaatccccacgactctatggtagtcttgaagcaagaatctcgatatgctacggcaaacgaccacagtttctctcgtgtatattatcttcccccttttgtattgtcttgatgaagtaatgatcatctcgatctcgtattttctgctaacatatggttttgtgatgttcagttgagcatgcaaatagagcaagggatccctgttttatcaaagtggcttatctttaaccgtttcaaattttctgcaactaggggaattaaactcgggccagcatttttcttggcgaggtatatttatctttattataataataattatttattattttaatcaataagttagtaatgatttattcttttgccaatttgtgtccccctttttgtcatgttggacagcttgagtggtggttcaatagtgggggacatggctccttatcaagcatttgctattggtggtgttggaagcgtgagaggatacggtgaaggtgcagttggatcagggcgatcgtgtctagttgcaaacagcgaactaacaattcctttggtacgtatgctttcattattattactatctatttgttttttagtctatgaaaagaacacgaattgttataaatatctaatttttttaatccgattattgaaaactatttacgagtttgtgctaaagctacttgattagctaactaatgcgccgggtgcttttgacgtatataatttgaatgtttgtctccttttggctttttattagcattaggtactgtgatccaaaaccatatagctcttcaataatactctttcctctgctttaatttgtattctgtcgtttatcgagaactttcgtcatcgctattgtttcgtgatattaatttcataagaattgcggcaatccaaatccattgccattcagaggctttgcgaatattttagcttggcatttgaaataaaaatta

SEQ ID NO: 410 - DNA, 4334 bp, Euphorbia heterophylla
ggtctaaatatattaggcctaaacaaattatatgtgtttgctgccactcgattttgatacaatgtcaaccttaacttgaacttgacaaaagtacactagttgctctatcagcttctaattgtagaaagaaaaaccagaaaaaaatgatatatttaaaaaattaaaatcaatcaaaaatcgatacgtaatattgaagagtaaattgatgacttttacaaaatttaaaggattaactaaaatttttaaaaattcataataacatccagttatttttgttaaatttcagggcttctcgatatatttcgtcaacaaattataaagaatgaattatataaacaaactgagtaagctcataatgtacttcaaatgtcattgtcatcatctacatttaattccattctgatacaaagttattgaacattatatcttttggaatctgattcttatatatcagaacttttatttaactaagatattctcttttataagttaatactttggttgtaattcaatgtataatatacaatacccctttgaccaacaagtcattgacatattgaactgatattgggaatttaagtaatgtgaattctataattatttcttattgactcattctatggacacatttaaatgaatgacgacaactgaaatgattgttaattcaaagatccattttaatttaattatagatatagtgcccctttttttgtggtgcttaaaataaaagagtttgaaagtcaatttaataaattatatttcttctatattttcatcaatataaatcattagcatttagaattcaaagtcttgtgaacataaattaaaatatcaaagcttacttcacttatataccacttaatgcatcgtaataattgagtaactagtcgaactaatcaaatcagcatgatgaaaatcgaaagaattagaaatgaattcatacctttttcaggtgcctgagatcgtaaactgatgaaacaaatgcgaagtcgttgactaactcacgttacgtcagaattaagttgttgttcacaacttctatataaaattagcgaagaacgatcgacaaatcgagtttcggaatttcattcggagagagaatttaagcaaaatgttaaatggaaatgaaaacttattttcatcactttctgctcgtatgcacgtaggtgcctttatacgggaattgaatttcctttaactgcagtcaaacccttcaactcttgatcatttgtaattaaatttttaaagtttcataacttttcaatcaagtttttcgacttatttaattctccaatttaattcaatgcccatattggatcagatcatttaatctaactgactcgctcacagacgattgagtattttcaacacaatgagtaacgagttaaatagtatttgtgttttgaaagccgcttgacacacaatagttatttagactcagttttaagataggtctataaaccccaattttatcattaaattatcatagttttggctatatcaatatatatttttttatgtgtcgcgtatgtcttaatctaatgatcaaatggaaattataaactcttaaaatctcaaattcaaataacatacgtgaattaagttatttaataagcgcgattgtgcgccattttcaacgtagcatcgacttatcgtctcaggtaaatcataattgatctttagaatataaaataaatgtttcaacactgaatttggaaagaagcttcttgattttgtgataggataaatgaaatctcacaaacgtgaacaaataaaacatgggcacaatgaaaatagaaataaaagaaatttatattgaaacaggaaatgaaaaatatttgtattttacttggtaagtacatctttaatagttagtcaattatataaattatcggagcacgtaaacaaaaatatgcaatcaattaaaattaattctacaccatattttaagttttttactttcaaatataacatgacactgtaaatattaaacattatttatttaagtttttacatgtgaacattcaaataaattcttaaataattaatttaatatctttttattgatgagagagcaatttaacaaattatttaattttttaatttaattttattttgaaaaattatattagaatttcaaatacacaatatattatagctactttttagaatgtcttatatattttacatctccaaaattattttctattttacgtttcgcataatcttggaactcattatcgattgaagatgctctaatacttagagctcgtttagttcgcgaaaatcttgttacgtgaaatacaaatagaaatgtatcatccaacgatatcaaatatgatacattttcatcatttattaaaaaaaaccgtcgacgtatgaaaaaacttttcttagtttatatacatctcatataaaagctatttcgtttttgaaataaatgaatagttttttccgtgagatgcatataaactagaataaacacttcaatgcgttgacgaattctaaatatataatctaatatattttacacattaccatttatttctatttctatttaacaaatagtaatgccgcaaaccaaacgccaccttaattaaaaaaaattggatattcctttttaaggataataagcataaagttgataatatttgggcttattgatgagcataagcccagcccatatttccagcccatactctataactgctcgatgtccatcatcatccccgccaaccagaaatttctttgtaccgtcaagccatagtcgacagcttctttgccgctaatcggcggcgtaccttttccggttagggtttaccttcatcttcatcaagccattacttccactttctccgcaatgcacaaaaacgacggcgttcgcttcacttcgtcttccctcaaaatccctccattttccacgttcccgcacaagcaagaagaacaaccgccattttctcaaattctagcttctcaattagctaaaaccaatctctgcttcactaatttcatcgactcggtcctaactcgctctatcaactccaatcggaggcccaatttgttccctcacatacctctcctatgttcactatccctccctcggttgacggattcatcctcgtcggagaagcctttcaaatcgccgatactcagctttgcttcgttgtctttgagtcaacctggagatccggcgctgccagggtcggatgcgttggtaactcagcccaaggctagtggcggcggtcactcagtgagtcgacacgacgaggagcgagttttgattagtgaagtactggtgagaaacaaggacggcgaggagctcgagaggaaggatcttgaggctgaggctttggctgcattgaaagcgagccgtgctaactcggctctcactgtgcgtgaggttcaggaagatgtgcataggattattgatagtggatacttttgctcttgtatgcctgtcgctgtggacactcgtgatggtatacgattagtgtttcaggtatgccaatttcatcagaaactgaatttgaattgtcaaatgagcaatatgaacaaatatgaattgattttgaaaatgtggtttcattgttgttttagtgattccgatcctttaggtagcttgctggatatttagaaatgcaaaactctgcttgaataaaatcaaaatgtatattttcaatatgatagcagagggttaaggttagggctatcaggcatttcttatttaatgatacttaattttgcatctcatttggccatgttgctgttttctgctgatactgacatttcatttgccgagtttgaacttaagttacctggttattgttaagcttattcccaaaccagattctgcggtttaagtgctaacagtgtaatatatatctgcattttttagtaaaaagcaaatatatgaacataaacttgttttttgtggctaaggtagaaccaaaccaagagttccatggactggtttgtgaaggagctagtgttcttccaacaaagtttctagaggattcttttcgaggcggatatggtaagtcacacactctcgtttttaatttaatgtttttgtgctcattaattcttcaagtatttttgtcatacacataagtatgccctgcgcctcaattagtatatagtcaaattgtagatgcatgcttgtagcttgtcatgctgtatattagtttgtttaacaagagacttcaatgatttgatttcaatgtcaagctgtgcaggaaaggtggttaatatcaggcatttggacgatgttataacttccatcaatggctggtatatggagcgtggtctttttggattggttagtgtgtcatctt

SEQ ID NO: 411 - DNA, 558 bp, Euphorbia heterophylla
cataccccattttgcaaataagtgaaatcacaaggtacttttttttttaattttaccctttttttttaaaaaaaaaaactgtgctaaaactatgtttctgatgcatcgtactttaaatggcttgaatcggcgtttcaggaaacccggcgctaagacaggggaagccagggtcgggaatggggttcggttatgggtttcgggtgaaatctccaattggtcatttacaggtcgattatgcaatcaatgcgtttcaccagaaaacgctctactttggcatcaccaaccttatttcttgacctttatttaacaaaccatttctgctacttttgatgtgaggttcttttttagctattcttgcattgcatacaacagtttcacagtggagacacaatattgagataaatttgttggcttctgtcttctcttgttagttattgaatctcatttattttgttgtttcttcccaatactattacatcattggaataaaatgatagtttatacattgccattttgtttgttcttaatatgaaattaacaatatttgcattagcccgc

SEQ ID NO: 412 - DNA, 4031 bp, Euphorbia heterophylla
catcttagttttcgttggagccatgcttttaagttgattattgttgtaatcaggatatttcctccaacaattatatacttccagcattggaatatctttttattaacccgtttctctaataggtttcaggcgttgagatcctttctggaggtatcataaggttacaagttgctgaagcggaagttaacaacatatctattcgtttccttgaccggaaaacgtaagaaacttccttcagtttgattgccatgtatttgtttttattgcttgcatgtgcacattatcttcaaagctaaagcagagttaaatctaggatgcataactgactcgtgttacattactttcttaagtggagagccaactaaagggaagaccaaacctgaaacaattctgcggcaacttacaacaaaaaaggggcaggtaatttctgtgctagccttttgtaccttcgaggcttcgcttatttatagtatgcacttacaaagtgtgcactacagagctctaaaacctttttgttctcatagctctcatcttttttcctttctaacttcttcattacttctttagtattcaacataatttgcttttttattccagtagtttgttcataatttgcttctgtgaataacccccataattcaatgttctcatattttacatgcttttgatcagataagaaactcatcttacttcgttttgccgttttggcattttaaacggccattttgcaggtgtacagcatgcttcaaggaaaaagagatgtagatactgtgttaactatgggaatcatggaagatgttagcattattcctcaacctgctggaggtaatacaaggtcttggttactaatgatcatgtgatgtatattattctgtgtcaagcactttgagaacaatgatactgatcaaatacttctatacaaattcctgaaaatactaatgattgtaaggatgtgctatgtatgtcgcatatggtaattgggcgcagccacatataggtttaagcagatgattttaagcaatgtgggcacaaaggtctttttttcaggactaaggcattgagagttggcagatgagagcttcacaaggatttttctgatctgtttcgtgtcctagtgattggattttaaatgctgttgggtttcttctgggttataaatgctgtcaggacaatgttaacttattgaagtgatttcatcttttaattccctaacacctatctctatgcgatagctgtcacttccacttgttaatatattgtcacttgttagcagttgcttttctgaatatatacttctagttcttatttctgaaatcttgattttggaaactaatttcccgctaccaatctctttctagataccggtaaagttgatttggtgatgaatgttgttgaacgcccaagtgggggtttctctgctggtggtgggatatctagtgggtgagtgatgtgaactcatggtggattaatccttcatttaactgatgtattgatttttggtatacatcgaaaatatcttgtgctgattatgtcgtgatttctaggattacaagcggacctctgtcaggacttattggaaggtaattatacattgattttattttattattttccttgtgcatctgggcttatcaaattttaggttgaatagtttttgattgctcattctgtgagacctattcaaatcgacattctatgtataaatcaaagtgaagtttgcgattattattttcatattacttgtacggaaaaagaatggctcttttcctctccatctctctcttctttctcggtcttctactaacattaaccttctattgggtgctgaaatgaagtagtaaagtaggaggagagagatatttggaatttcggtctacaaattgtaaagacaatgttgaatctcatagttgcacatctcttgcagctttacatattcccacaggaatgtttttggaagaaatcagaaacttaatatctctttagagagaggtcaaattgattcaatatttcgaataaactacacagacccatggattcaaggcgatgataaacggacatctagaactataatggttcaggtgggttattttttggattcttttatgctatgtttgatactaaaaatcaattacccttttccattagagtgcttaatctagtatgaactgatgctgcctgctatagaattctagaacacctgggaatcttgttcatggtaaccaacctggcaatagcagtctcaccattgctcgtgtgactgctggtgtagaattcagtcgacctctaaggccaaagtggagtgggacggctgggcttatattccaggtactttcattagcattagttatgctaggctgcatcaattatatataaactgctctctatctttcttctatgtagctatttatgacaataaaaaattttacttaaaataagaaaacaatttaaggaaaagtacattccctgtagtttctcaggttttacaatattaagcagttctaaagggtacaaatataaccttgtggtttgaaaatggtacaaaaataatcatgtgattttgcaatttaaccttatcttcatgcaaaagttaacattttattctataaagcattcaaataattagtgcacaagttttatatgtttcgatatatatttagaaattttcatgacatttttacttcgattactttacaagtttgtgtattaatgattattaaaaaaatatacgcacttaacaaaaaatttaaatttcgacactaaggtccaatgtcttaatatgaatcaacgtgcaaaatttatgttaaaaaactacaaggagtaatgggttcttaagataaaatatgggacgacatacgtcttttgtgtaaaactagaaaatcaatgggtttttttttgtacttttacaaatttttttaatgccttgtatatctctgataaacacagcatactggtgctcgtgatgaaaaaggaaatccaatcatcaaagaccactacagcagccctcttactgcaaggtatctctgacagttgattgacctggctctggcatgttaatttcagtcgcattaacagtagcgtcatctattggtcttcacagttgttgttctttgcttaactactttgtggtgcagtggcaagactcatgatgatatgctacttgcaaagttcgaaagcgtctatactggctctggcgaccatggttcttcaatggttagtttccttcacttttgtcctctatgtttggtaatattcaccatctttatgtgtgcaattgtgcattcatgtgtatgtaagtttgaagttttaggtattaatgcattcgctgaatcacccgttgtgtctttgcagtttgtgttgaatgtggaacaaggacttcccctttggcccgagtggctgtttttcaacagagtaaatgctcgtgctagaaagggtgtagaaattggtcctgctctctttcttctaaggtacggcttccatgtttgtcttttagctgtctcgtggcaaacatctcatgttatccaatagtatcgtagtctagactgaaattaagatgtgtttctctgggttctgctaatcacttgttacccgaaaatgtctgaaatgaaaattaataaaaggagcttttaaaagttaaccggtactcttagtaagaacatgaacttgaaacaatggcaagaatataacatgagaagggtatcacagcatcattatatagggatagttcatgaaatctggttgggcactctaagcttcagtatcatataaaacccggatttatttccattttctcaaccgcttgttttaatctttttcatgggaaggttttttaatgaatataatctgatgcaagttacatacctacagtttgtctggtggccatgtggtcggtaatttttcccctcatgaagcatttgccatcggtgggaccaacagtgtgagaggatatgaagagggtgcagtaggatctggccgatcttatgttgttggctctggtgaaatttcttttcctctggtaagtgattccatttact

SEQ ID NO: 413 - DNA, 356 bp, Euphorbia heterophylla
tattttttccatgttcagaacaagatgctggaaggggttgctttcttagactgtgggacggatttggggtctggccggcttgtacctggtgagttttcttttctattgaatatcaacataacataactcattggcataatcaatctcgagaggagaaaaaaactcaagggaaagcaaagtaatagtttagttacatccatttcacaagattgatgtgcgcatttatacggcggccgatcgttttttcattatagtattttgtttgaagaaggatttgaggtgcatgtgcatatattcggacactttttttagggtaaactttaaaaaagtaccttgtggtttactcatttgcaaaa

SEQ ID NO: 414 - DNA, 460 bp, Festuca arundinacea
ggatgtgcaccgcgtcgtggagagcagtctctttcgttcctcatgcccgtcgctgtggacacccgtgatggcattcgccttgtcttcgaggtccggtttttgcttgttccccaattccctttccatggcttatttttagagctcaagtttgcaaaaaaaatcttttctctgtggtttaggtgaagccgaaccaggaattccacgggctggtctgtgagggtgccaagatgctgccttcaaagttcctaactaactcatttcgtgaccgccatggtagtgttttttgttgttctcatgtttaagattccgttatgttagatgaggtttgccgacattataaatttgcttaactgagagtatgttgcatttggttgattcgctatgcacaatgctacatggattgttacaacatgttagcctagctttgggccatttaagattttttttttgaaacgggggc

SEQ ID NO: 415 - DNA, 427 bp, Festuca arundinacea
tggtggttttgcatagcagtggtacttacatttcatgcatcacttaaactgtgatctagtgcttccggaggtcatgtggaaggaaacttttcgcctcatgaagcatttgcaattggtgggacaaatagtgtaagaggatatgaagaaggtgctgttggttctggccgttcatatgccgttggtagtggagaagtctcttgccgcatggtaggctttttctcgattttctgcaacatttagctatttgtcttcaagaaaaccttgacatgaactacatgtagataaaatacatatacagacctatgccatggtctcatatatatctggtcgattacatatacatatatcaaaaaataatcttttgcaatttgaagatgaagttttcttttagatggattgcatatattaaaaaatatagttgaacagg

SEQ ID NO: 416 - DNA, 339 bp, Festuca arundinacea
ctctacaatggttagtattgatcctgctcgtttatactgcttcctaattatattgtgatgtcttatacccaccattgttacttcttccagtttgttttcaacgttgagcaaggtctgcccattcttccagagtggcttagcttcaacagagtgacagcgcgtctgaggcagggctatgaaattggtcctgctcgacttcttctaaggtatgttcatggtcatataatgaatatatgtgtagctggaggctttgcatagccgtgacacttacattttgtatatcacttaaactgtgatctagtgcttctggaggccatgtggaaggaaacttttcgcctc

SEQ ID NO: 417 - DNA, 688 bp, Festuca arundinacea
gaggttaataatatcaatatttttctggatagaaaaacgtgagaatcatagcttggcttagagtttatcttcactagttaatgttaatgttttatagccatgaaatattgtgatcgttcttatcttctttctctttccatttctttctatcactagtggtgaaccaactattggaaagacacaaccagataccatacttcggcaacttaccaccaagaagggtcaggtcagagcaattttaaaagttcccttcatatttcttttttatcccctttggctgcattagtgatgatttagtcgaacaattttgcatgacatgattcacttcacacttggtgatactatgttgtgcattgaagcatcgatttagagtggttttgaagtttctatgcaaacactataaccaaaaccacaagaactattgttacagcaaatgtcaacaattgtggttggatcattcttgtattgttttttgtatgtcaactttgtttgatgtcaatttgacactcttgtcctgtagccttgatgctgtgatggacttatctgcattaacttttaatgatgaagtaggcttacaacagagcacaagtgaaaagagatgttgaaacaatactcactatgggaattatggaggatgtaacaataattccgcagccagtcggaggtgaagctaatttgtttagttccc

SEQ ID NO: 418 - DNA, 475 bp, Festuca arundinacea
taaagagaattgtttccataaccccaacagttttagtggttgactattttaagcaattttatatgtgcgttaatgatttgaatgattttgttactagtcatacatgttttcatgattgataaatcatgcactatcagtgtttgctacctcttatgacattgaatgtagtttactagttcctttgctactctaatgcgcatcatacttgctgtatacattgtaagttaaaatcagctttctgagccgtcatttgatttttcacagtttggtccgttggaaggcgttttgtttggtgattatggtagtgatcttggctctggtccaaaggttcctggtaagtcatgttgtattcacatttttgctaagccatggtctcatttttacaatctctggtggttttggtctttaggtgacccagcgggagctcgtggaaagccaggaagtggctatggatacggtgttggcatccgtgtgg

SEQ ID NO: 419 - DNA, 279 bp, Festuca arundinacea
ttaatcatgacaaaactagaaacattacgtggaaaatgtgaatatgtggtagttgctctagttgagtttaccgaaagttttggtgcctaccattatagaccaaaagatattctattgctaatgataaatcaataaatgttcttgatttggcgtcaggtttcttatgccgagattctttctggaggaattctgaggttacaagtttctgaagccgaggttaataatatcaatattcgctttctggatagaaaaacgtgagaatcatagcttggcttagag

SEQ ID NO: 420 - DNA, 266 bp, Festuca arundinacea
gatggcttctggagcgggggcgaggagcgggtgctgattagcgaggtgtctgtgcgcggaaaggacggggttcccctggaacggcccgagctggaggaggctgccgcggcggcgctgcgcgcgtgccgccccagcgcggagctcacggcgcgggaggtgcaggaggatgtgcgccgcatcgtggacagcggtctcttccgctcctgcatgcccgtcgctgtcgacacccgtgacggcattcgccttgtcttggaggtcaggttttt

SEQ ID NO: 421 - DNA, 921 bp, Festuca arundinacea
agtcattttagctgttctcatgctatagagtccgttatgtttacaagagagttgtttggttgacttactttgattgatgttacatgaactgttaatacatgtttgatttaagcaatttaagtgtataaatttgtttgggcaaagagctactggagtgcattgcattgatcaatatctagaatatttgacccaatgcaacgtcgatctagatcattgagaattgttactttcttcgagcttttggtctatcatcatttcactatattagaatctgcagcatagttatgataaaattacaatgcaaaggtgatacagcaactgaagcacaccttttatgtagtctcacaatgttattgattggtttaattttaatccaaaaaccagttatatttctccaagccgaagagatctatggcaacatagacacatctactgcgccatagtctctcggtagtctcacagtgttttttgtttctctaaagggatagaaatgatgttcaactcatttccaagtctagtgtacttttcttaccttctgagatttgtccttcagatctaatttactgctttttattacattatgcaggtaaaataatcaacataagacatctagatcaagtgatcaagtccgttaacgggtggtatcaggagcgtggtcttactggcatggtatgttgcgaaaatattaataccgctcatgttctatcagtgtgcattattttagactttctgttattgttgcaacttaattgagaacatcactgaacaagaggcacctgctacccatgtcttaaggaccaattgaacacaatttgtaacttcttgggatcttgaccttctagaggcccgctaccacaggacttgagttgttaatcttctatttcttcaatgcacttgccaaactgccattgttcacacctc

SEQ ID NO: 422 - DNA, 2814 bp, Festuca arundinacea
agttggcagtggagaagtttcttgcttcttggtaggtcttgcctctttttccgtattattaagttgtgtgtcttcattaaaagaacataagataaaatacagacacaaccatattctattttctcataaatgtgtaactggcaacatcaatatacacataagaaactaaaattgtagtatttgctattagtttgacatttttaagatgaagttttcttttggatcggttgcttgtatataagaatatagttagacaggtgcaggaaacaagccaatgcataggttatgaattttttatgatattattgttgtatgcagtgccaatgaatgtgtcagagtttttttttgttaaaacaacccaacacatggttgagttcgtccctgtcagatcagtataacatctccaacacatgctggacacagataactgcatcatgtacgtgtgcaagcttgtatctgtgcatgcatggcctttcttagccatgtgtcgaagggtacttaaaagttagctaatgggaaattattccataacccccaatacgatgcctggtttccggttctcatttcttagtattgtttacttttccatccctatgttaacactgtcatgattttcatcatcttctgatgtttattcaatgattaaattttttgagtgatttatgtacttgtgttaacgatggagtgattttgttacttgtcaaatgacatcaaacgcatttaactagttcctgtgctactctcatacacatcgtgcttgcagtaacatgaaaattcagcattctaagccgtcgtactaattactcacagctgttattctctgtgtagtttggtccgttcgaaggtatggtctttggtgactatggtagtgatcttggctctggtctgtcatgctgtactcggcattttgctgtcatagatttgtttctacgatctttcatggtttcttctttattaaggtgacccagcgggagcccttgcgaagccaggaagtggttacgggtatggtgtcggcatctgtgtgaactcaccgctgggacctttcagactcgaatacgctttcaacgataaacaaacaggacgatttcacttcgggattggccacagaaattaacctgtccaagcggctgttgtttaatcttcgtcctccatctaatttgctgaccacttgcgctggtgggaacagtgccatttcttcccatgtctttgtactgacgattcagtttttggagagaaagttttgtctagcctgtatcgccttagttctttttctgctataaacatttcctgaagttcgaaccaaagaaaaagaatctccaggttgtagatcaaatctggttttgtgaatgtgaaatttgagctgagaaatcaaaattgaggatttgtggcagcgatatggtatcacctggcttaaatccaagaacccatgcaatccatcgcctgcaggtatccttccttttgagttgtttgaacaagttagcccaagctaatcaagacccaggagtccagtatttccctcggtaatccatgaaatttgctgcagctagcgctgagtgacaagctagatacagccatagactaactgtttgtttatcatctcatgatcggatggtgaagtcggctccggggaaagtaggatcgatccgagcctgttcggtttgggaggacttgaagggggattaaatcccttgcaaatcaaaatcccccaaatccactctaatccacctggtcaagggattaaccgaacaagcccttcatgatttttcatgtttacaatcacattgtcaaaagcagcatccacgcaaacatgtcaggactgcagaaccctacccgagtatgttgagataaccaaataacaacaaaatagctggttacttgataccaatctagtgttgaagaatggcatggccctgatcattactgtacactcctaattgcataacatattcttggatgcaattttaaacttttagtttaggcacagttagtttaaaagttctaaattatcgctccatccatggcaaacgcaacatgattgcgagtttgccacgagataataaaaggcaagaaaaacctttaaagtactacaggacaaaaggacactttttttttatgcctgtatgatatttcaacaaaagcagtggctaacaagatcactgcagacataattgtgaagtttataacaacagtgtcgatcagttggtgggaaccagttaaacggtgcaaatttacctcgaccagttctagcgcatcctatgctgagaaggagcccctgctgccattttgatcccagcgctagccaaccactgaaacccaccttcaacaagctaaggcgaaagccccctgcttagctccagttaactttggcctgcggctcaagaaccttctactccactatattctgtgaatacatctcgagtacccttcgtatatatgaagctcatgtaaaatgtagagacatggagatacaacaaagtactaaaatcaacaatcaaatactacatcaataggccacttctacggagtacagataatatcgacgttggtcgctacattcagccatactgagatccaaaatagagatcagctggggtacaaatggctagcaaggatgatgtcaagaacttctaaggatagaacaaactttaggccttcgaaaccgtactacattacctataagtacttgcgcgtaaggaagtcatcacacttacagttacaggaggctcttgggtcactccacagtttcaatgaatgtgctacctaccgactggcaaacaacagcggttctcgacttctgatggtggatggtttcag

SEQ ID NO: 423 - DNA, 1364 bp, Festuca arundinacea
ttaaatttgactatcaatttgaccaacaaaacatgggttatatgctacaaaaattatacaactcaattcgtatttaaaataacttttcagtggtataatttttatgccacatttctctttttttactcttcaaataaatgttcaaagttagatcgcacaaagtggggaccccatgtaaatagtgatggagggggtagccttttttactgtgtaatattgtcatgatgatattttagagctcgcgtttgttaacctccagttgggtttggccttttctgacataataattcaagaagcaacctgatgtataaactgcggataattaaacatgggcttaaaatttattgtcatgaaggtgctcatgctagtataggagctacctcaaaccccaccatcataccatgtttcaactttagagtacgtaggttaagatgacagtcaaatgcccaagcaggcttctaggatctgtcactgtcgcacttaattttgtattttatcaaaatactatcaattatgcctggataaacagaaattctatatctatttttttctcaactggagttttttaaacagctttgcatattctcatcgaaatgtttttgggaggaacaagaagttgaatctctcactagagaggggccaaatagattctatatttcgtttaaactacactgacccttggatcgatggtgataacaagaggacctccagaactgtcatggttcaggtacttaacctttaatactcttatcatctctatcatctccactgtaccatgcaccaagtcatgtatatttattaattattttatttgccagaactctaggactcctggaacacttatccatggtggggaccatcctgaccatgggcctattacaattggacgagtaactgctggcattgaatatagtcgaccgttcaggcctaaatggagtggcacacttggattgatatttcaggtgaacatgggattcttattttgtatttagtgattatgctttttctctgcctgatggaagtccaaaatatacatgagcgtagttgtgtactggtttaagaaacaagtgaaacgaataattgatttgaattgttccattttcttacctctccttcatagcctaattgcatcctattgacactttctatgcagcatactggtgctcgtgatgacaaaggcaaccctgtaatcagagatttctataacagccaactaactgctaggtctcaaactttgatttctcactcacctttacattgaaccataagtagatacatgattgggtacacaacgaatataatttctgtattaagttactttgaaacctgatagtcctgttcatgacaatgcagtggaaatcctt

SEQ ID NO: 424 - DNA, 490 bp, Festuca arundinacea
agccagtcggaggtgaagctaatttatttagttcccgttttattaataatttaacattgatctttacctgctttctaacatatgttcttgtgcagattctaataaagttgatctggtcatgaatcttgttgaacgcccttctggtggcttctctgctggtggtggcatttcgagtgggttagtacaagtagacaagtagtactgcttgatgactgaacccaattgaattgtgtactttcataagtttgtttcttagcctgtaaggtgctgaggtggtttattatgtactggatttgaataccatgtgtagcatataggcaaattacaattgaattttagtccaaacagatatttatgccatagtgacatggtgtttttctgcaggataacaaatgggcctctctctggactaattggcaggtcagtaggttctctggagtgtactccctacttccctatttacatggcacacacgtatttcaaggtttaa

SEQ ID NO: 425 - DNA, 378 bp, Ipomoea hederacea
caaatttcaacccgcaaagtgtgctcaccgaattcctgaaattcccatttcacaaaaccctcaaaaggttcaattccaacccccaattccctctcctgtgctgctcctcactgtcgctggcccagactcgggaaactgatgctgactttccggcgactcagccggtgccgcccaagagtgcgagggaggagagggtgctgataagtgaggtgttggtgaggagcaaggacggtgaggagcttgagaggaaggatttggaggctgaagctctcaatgctcttaaggcttgccgaccaaactcggccctaactgtccaggaggtccaggaagatgtgcataggatcgttgccagtgggtacttctgctcttgcatgcccg

SEQ ID NO: 426 - DNA, 681 bp, Ipomoea hederacea
tgtgccatttaccataagaatctttttgggagaaaccagaaactcaatttgtcactagagagggggcagattgactcaatatataggataaaatacatagacccatggattgaaggagatgataagagaacgtcaagatcaatcatggttcagaattcgagaacacctggcacacttgttcatggaaaccaaccagacaatagtagtctgactataggacgtgtaacagctgggatagaatacagccgcccatttaggccgaagtggaatgcaactgctggcattaattttcagcgtgctggtgctcgtgatgataaggggaatcctattataagggacttctatagcagcccccttactgcaagtggcaacacccacgatgatatgttacttgctaaacttgaaaccatgtatactggttctggtgacaaaggttcttcaatgttggttttcaacattgaccaggggattcctgtattgccagagtggctagttttcagtagggtaaatgctcgtgccttgaaggacttggctgttggtcctgtgaggttctttttaagttgtctggtggtcatgttgtgggtaatttccctccgcatgaagcttttgttattggtggtaccaacagtgttagaggatatgaagaaggtgcaggttggctcgggtcgatcgtatgtggtt

SEQ ID NO: 427 - DNA, 17129 bp, Kochia scoparia
  unsure (1)..(17129): unsure at all n locations
  unsure (1)..(17129): unsure at all n locations
gtgtcttattctatcgagggaagagtacctgttatcgccactctttatcgtacgagtgacatggtgttgaatgtcggaagcatacttgtcagataatagagtttcccttgctgccaaaaaatattgagccatttgctgcaactcatacagtgtaggttcactcgtcgcctcctctactaataagtcattcctcactcgttctttccttctcttgcacaatttcttcgctttcctttccttaccatttttcatttcctgaaaataaataaacttatttagtatataatcatttatgcatacgttaatcatctactccatgttttatttaatcgaggtttacaaccttttatataaagcactataaattaaaatatatatattatggcataaagtggtggctttggtattgttatatattagagtcaaactctaaaattaaaccaaaagtccaaaattatgcaagcgtttcaaattaaatgcaacgtaacaatttcaaattaaatgcaataatgttttgaaaatttacctgatcgggtttgccttgttgatcatcacaagcgtcctcggaatccatcgcatcatcttcgtaacactcgtgctctttgattagtgtagcggggaaaattgttagcattagaagccaaaacccacactttaaactaaacaaagcaccaaaatcttgcagatttctatcaatgtcaatggttcgcatgattgagtttatacaccgattgttcctcgtcttgttcatcagttttgggcacgtctttcgagttagatcgacaactacgtctggtgtcgatgacaacgtgtctgattttgatttcgacgcctctccttcgtaaacaagaccgaaaatgtcatgcttgtgacgacctattactccaaggaagtagagatgttttgatacgtgtgagagtttatggtctagcctcttgtaaatcgtacgattttcgaggattaaacggagacaagttttaaccaaccaaagagcagagaaaataaaaaggaaaaaacaagccaaatttccgattttggacaaatgtttgtccttctctgttccttgtttaagaattgacccaaaatagagtatccaaacacatgacaacattgtcgtgctaagcataaaaattacgctcgttttcaagccatcagcccaatacactagggacttcctatccaataccttcttggttacttcgtaccgcctcgtttgcaatttctcgagcccctggtgatccatagccaacaaatgtaacccccacacaaccaagtaaatcgacaaccgaatcacgtcgtagatcacgagaacaaggatcactagatggatcgaatcgtgagtgtcgaagactccaaacaatttgtagtgtttaaaacaagcgattcgttccatgactaaatgttcggcaaacaagaagatgaaacaattgacaatctcatgcactgtttgaggaacaacaaggctcccacttttgaacgtatgatgtttcaatgggatatgaaacatggcccacctaatgataactattgtaaacaaatagctaagaagatatatgccataaataatgaaatatgtcttgatcacattagctaatggcaaccctagtatcacggcatcgtgtacatagtatcgaatactagggattcgagcaattccgtagtatgatatggcaagcagacacgacaagataaataagtctatgttcatccaagtgaggatgacaagattaagtttagtcgcgacatcaaatgcataaccacacccgaacatgaagaggagaaatcggattactaggaaagatgccattagaattggcaacgctacaatggctgccacaatgcaacatccagcagctatgagtaggattaaccatttcaaaggctccttcactaataaatataagagacttacaatgattgccaagaatttgagggaatgattgaagatcttcaagtatgttttttttgtgggaacacatttagaaattgaaacaacatcatcaatttggagggttaaatgttggtcacttggaatggttgtgggtgaactcgtcatttttttttaaataataataataacgggaatgaaattaagaagaatgagtacttgtgcatatttttagtttaatttgggcaatatttatagtaaaaataaatgacaaactaaaaggagaaaaaaaaattaaaaattcttgcttgcttgtttaaaaagaggaataaaaaaaagtaaattaaagaaagaatatatatttattaggttgaactacacatttaagtaaggaataaaataacatttctcgtgattaacatgttacatgtttttgcttttaactcaattgcttcatgttggttgacatggtatgatttatttaattgattacttaaagataaacaagagtgaaaaaagcttgaaaaaagaagaatattaaaaagaatgtacgaagtaaattttaaggaaggagtgatattaaattttaagtagtacaatctactagtctttgaagtatcaaaaagacgaatgtcatatcattctttccttaagttacaaacttacaatagtgaattgaataagcaatataatgcattttatcattaagagaacttggatatcctccccccaaaaaataaaataaaattcggatatatgtacaagtgtacaagactgcaatagttattcaatatcagattatttgctacacttttcatttaaaatatgtttcaaagtacttgttgctacacaagatcaaaggtggggatgaagtcggtgtttcaaatccaaaaaaaaggtcatgtgagaagaaaaatatggaagaaaaatttatcaataaccaaatgttacaagggtgtttcatcacaaaccacctattctaagactaatagtccaaaatcaccttttatgattcctttatacgtgaccaccaccactcgttggtttttcggtgttgtcttgaactaaaacctctttttttttttgttgcttgaattccccttttaaccccttctacacatgaatcactatcatcaatcgaacttgcacgaatcactaaccaccaacacttatcgaacttgtgccaaccaagaaccacttgcaccacgcaccaatccaaatgaacctgagccgtgtatttgaaccacaaccacgagttcaaattgaacaatgaaccaccactaataaaacaattttgaatagcgtattatttttaaaattttaatcaatgattgtgttattttcttaacaattcatatgtcttgaatcttgataataattttctttttctaaaaaaacaaaaaattcaaaatccgagcatttgcttaattaccttgttcccatcttacattatcacaaattcacaatccccattccacccccacttaagttgtcatacgaaaatccaaaaacctcatcgaaaaccctaacaatggcgaaataacaaaatacaaataaaattcacaaactttcctccaaaatcttcgatttcgcaacccctcttcgattctcaaaaatgcccaaaaatggcgacattcagtttaaatcctcctccatcaaaatccctaatttcgcacctcaaacccccttttctcacctcccattttgctcacaatccctaacttcaaccctcaatcaagccaaattctcaataacccacttcatcaattccctcaaattccccaaaaaacccttcaatttcccccttttcccgccaccaccgctgctgtgctcctcaacactgtcactgacgaggcaggatgactcggcaccgccgcaaggaggtggttctgcggtggcagatgtgagccagctgaaggcgccggtgagtcgagccaggagagaggatgaggagagagtgctgattagtgaggtgttggtgaggaacaaagacggggaagaattggagaggaaagacctggaatcggaggcattgacggcgttgaaagcgtgccgggccaattcggcgttgacggttcgagaggttcaggaggatgttcatcggattattgacagtgggtatttttcttcttgtatgcctgttgctgttgatacaagggatggtatcagattggtctttcaggtatatataatcaaatgtcctgtttttttaaataattatattcttatactatagttctgataagaatgctgttgttctttgttaatagatattagtttgattgaatgtgaattggggtttgtactttgtagtttgatggcattggggtatttaaaatgtgggatagaatatgaagtttagatgaaggatattttcaaaaatgtacattgaggtttaaccaaatggaagagttagattggagaaagatgacttggaaatatagaagtaggatctctgagtcgaaaacaagtccccttaatttgcactagtgagaatttaggtttacatgtctcggatacaaagtggtggaatgatcaatgctgcacggttcgcatgcgatgttaaattgctaatggttgggctgctttgttatagagggtgattaggggactcatgcaatcatgctcataagacaatacagtttgttatcaacaattatctacagaaattagggtgtacaggtagactaataattagtacaataatgatatcactatcaaattactcaaaattttgtatgaatactagataaaatgctaggaaagtaattggttttttgtctagttatagttctcatagataatttttacgttcaaatagaacataacattaaaggttctattaatattatttaatttttacttgttaattaaaatagaagggtgaaaagaagtccctaatcctttgaaataccaattgcccactttattggttgttaaaaaaacaacaaaccttgacagtgatatcaagttttgaacatctaagatggagagcctaggtgcacccatagcatcggtatggagtgtaagattgaaaatgatttggttagaagatatgaagtagacggatttgcaggagaatggatttgaaggagagtgggggccttgattgtagggggtggaggaggaaaatatttgtggatgactacccggaatgatcacttttggttcatgttgccgacccacttacgggactaaggctttgattggttgattgacttgtcgtgcactgtttattttttttataaaaaattcttttcttttattacatgttttaaaaattattctacaaatcctttggtgaattacataagaatttatgctattatcttggtgtatctcttatgtaaataattttccatgttatagctatgttttttgatcagctttctctatgtcgcacaaggtagaaccaaaccaagagttccgaggattggtgtgtgaaggagctaatgttctcccttccaagtttgtagaggattcacttcgtgatggatatggtaggattctctctctctttgatttttatattggaatacctgagctttctctccattaaatcaaattttgtcatcaagctgtgcaggaaaagttgtcaatattaggcatttggataaagtaattgactccatcaatggttggtacatggagcgaggcctctttggcatggttaatatctcatttctctctgttgtttaagacttctggatcatcctctttcattgcctatccccattttgttaaggcttgtgcatggcaatgttttggagcaggggactcaatgttttattcctacaggtttcaggtgttgagatcctttcaggaggtatactaaggttacaaattgctgaagctgaggtcaatgatgtttcaattcgtttccttgatcggaagacgtaagtgataattttcatatttggtactaaaacgagtgaaaaaggatcagtggagtctcgatcatcttatagcgtttgtttaatcaaaagtacactacttcgggcctgttcttatcagcttactaaacttgaacttatttgaatggaatttggttgaatgtattatatcgatcctatatttgagtgcttcatgagaccttattggtcttaaactcaacgctcgaactgaacttattggacctaatttttgaatgtaaagagcacactcttagtgttagactgcattttttaatttggaaatgaagagtgtttgtccgtatgtggttcattaatattgatactatgtgtacttattattgttctctttagacgtgagccaactgcggggaagactaagccggaaacaatacttcgacaacttacaaccaaaaaaggacaggtaaaatgcaatttgtatgtctgttactgtggtagtagactagtagtaaatgatgttccactttttctgatgtattgatgtaagattagggtatctactgagaggataattttcctattttcctagagctttctatgaagtgttaatttttattgatttttagtctttttgtctgctgaaaactactgaatttcattacataattcttagatttatatcaaacaaatgagcaaccagtgatttgtgatattttagtatgaaatcttccacgtttggaagatcagttttcagcttacttgttttaaaatccataggtttttattctgcaatgggtccagtgatttagagcagaaaaaagaacataactgaaagaataaaaggggaattaattaataatttgaagaaatagaaggggagttgccttgagatcaacgtgatctatactattactcactgctcactttttagaggtggagctctctaatagtataagctaagagtaattaatttattgatgcattctctctcctgatcctcttttcatttccttatcagattgatttgtctctgatctatccttagtgttttttattttcattcccggccattgtggcctttcgtaacgtaaatgattaatggtggtattgtgtcgataatttgcatttcattggtttattggccgatttatttatgatttggtaatgagaaatcatacaattttaaatttgccagtgtgttgaggtctcacgtatcctttatgcttcttccgtaggtttacagcttaaatcagggaaaaagggatgtagaaactgttttaacaatgggaattatggaagatgttagcatttttccccagcctgccggaggtaactgtgtcctgtattcttattagctttatcaactgaaaaaaatgctggtctttatttttttattttttttggtagattgtattgtttacgcttttaaggtttaaccatttaatatataaatctatttgtaagccctttgtgtttaaaatcccttctctaagcttttgttggccgctgaggcactaaagatgctctttctttctgtgtatttctctttaagaggtttaccatgtattggtgagtctgtataggctttggttaaattcatacactatcaaattaggaaaagaaaaagaaatacttatgttatagagtttataactaaagagtttgcgaaatgcacactcgtattctcccaaccaaccttgaatataaatttgaagaagatgcaaaactaagtgatagaggctcatataatcatatagaccactttgccttgttgtaagcccatgttatattttccatatcccagtttggatgattccatcaattacagttttcgagatgaattgtcattttgcaatttcacacctgcaataatcattatgtgggcctgtggctgtgggcaatggactcacaagtcactttgtactggctttccttctgaaagcatagaggacaattgatttcgcgttctaatattatgctttaacagagtcaacagagatgatgagactgttttattgtgcaacatctcttctagcctgagattctttatgtcatcaaattgctctattggtctttactttattagattctttaaagtgaaagatacccttttctaccttaatttttgtttgaatggagtcaagctacctaggcaatttgatatatgattttactgtcaacaaaattgtttggcttctgtagtgtttgtttttgtggatggaataggcctctcttatctgtatccacttcattgctaaaaaagattgtttatgtcggatgagaagttcgagttttgcatttgttctttcttaataaaaaaaaatattggctgttgccttaaacctctggatgaataaaaattttagtctaacatatatctttttcttctaaaattccagacactggtaaggttgatttggtaatgaatgtggttgagcgtgtgagtggaggtttttcggcgggtggtggaatttcaagcgggtaagagaacatgtgactctgctctgtgcaatttcttatatgatggtcaatgttgctatgcgtatgtttattctgatccaacaaatgcatttacaggataacaagtggcccattgtcaggtctgattggaaggtatatatctgctcttcctatttctgtcggataatctattcaacttctcatataaaggccatacaagaaaaagcatttcctcttggtcaatttctatgtgataattgggttgaaggaatttttatactcgcgtgcacacacacactgacacacatacatcaaagcaacatcttttttgattaatgatttcttaacatgctgtgaactaatactttctgtttatgttagtttatgcgtgcaaattttattattaataatagcttttgctttaatttggttgcagctttgcatattctcacagaaatctttttggtaaaaatcaaaaagtgaatgtttcacttgagaggggacaaattgactctatatttcggataaattatacaattccatggattgaaggtgatgataagcgtacacaacagtcaatagtgattcaggtgattggcatcaagtcttggctgtctgtatatctttttagaagaagcgggtattgcttatctttctttgtgattttgattctgtaacttaactttattggtcatccagaattcaagaactcctggtactttggtccatggaaaccaacctggaaatactaacataaccattggccgtgtaactgctggcatggaatttagccggcctctaagaccaaagtggagtggaacagctggacttacgtttcaggtatctttgcataatctgttttgtatttctttcttgatttctcattgctaaattcgatcgatcaacttgtgggtgacatacgtgagttatataattaccattaatgttattgcagcgtgctggtgctcatgatgagaaaggggatcctataataaaagatttttacagcagccctcttactgcgaggtatatgaaattgctggcagcaacctattagctaaaactttgagactgctgcttctgtaaattttcaagtccatagctatttattcctgcatctagtttcttgctttgtttaatcaataacttgttttcagtgggaattctcatgataatatgttgcttgccaaatgtgagtgtggctacactggtgatttaggttcttcaatggttagtcctctgatctctagaaacagatgttcattatactctttttgctcacatattttcattatgtactttttgctcatatattttcattatgcagttggtcttcagtatggaacaaggtcttcccatattgccagagtggctttgctttaatagagtgaatgcccgtgctaggacagggatggatgttgggccagctaatctccttttaaggttggagttggttgtttaaagtttcctattatggttatgtagagcctagttcagagtgtatgtggaaatttagtgtatccttattctcaacttgtttttggtggttcttgacattattacattgttacctttgattcagtttgtctggtgggaatgtggtgggtaaattctctcctcatgaagcatttgccattggcggcacaaatagtgtgagaggatatgaagagggcgccgttggctctggttgctcctatgtggttggctgtggggaaatatccttccctctggtactcatgatttaaaagctcattgcaattttttctaacttatttcacttctttagttctctttagtatatatatatatgctacaaattttctgctgctatatctttgaatataaattgttttgcttttgcttgggatatgtggcaaggactgacaatattgtctttcagaagggatttgatcttgggaacatttttcattttatattttaatttatcttgaaaaacatacaaatggctcatctaatgtagaacctagcaagctccactgcttatgctactgtggctaaggctgtcagttaaagcttcagaatgcttggaaaattattaccgtaaaaataataataaaaaaggttctggaaatgtgtgtatgaagtattaagagaagcaactctaaaaagtctatactgtagtaaagtgaatcaatgtaagagaaagtacaagtgtgtgtaataatcaaataacattgtgataatgttaaattgattaagcaaattgatatgttgtgatttgttgtagtagtgtgcaaatatcgtttgatttaagctgattgttggacatatatactttttttttttttttctgttttttgtttcaaaaggctctccccattgatttaagcttacaatttttattttttttttccagtttggtccagttgatggtgctctttttgctgattatggaactgacctcggatcaggctcttctgttcctggtatgtgtaacccaccaacccaacccaaaataaaaataaaaatagaattcaaatatagtaaaacgtacatgcaaaatgagtcgagctttgttattatcattagtagccctggatatttttggcattgttaatcatgctagtatccaagtttgagtttgtttaaagtgtagcacatcagctttcgataaatggattgattggattctgacaagaatgaagctcgttattctgtagtttaaattgtaattctttaaaacattgtgttaaaaatggaaattaagagattatgaggatgattatacattgatatatttcagatgttgtgtgaaatgatttagttgaatgacgaagataatgattatgaattgattacatcaaaattacacggggatagtaacatttttttttttggtgctaaaaaaacaaccattatttaacttatttctttctctattatctccactaactttccagattcttctcaagtgttcaataacaatttttttttgcatattctaaactacctattccataatatcatttcttagctgacaattaggtattgtggaagtatgaagtctctgcctcttttttccgtatctgaatagactgaatttttgacacaaatctgtccggttcataaaaagaaaaaatcatggatttatcacttagttgtgtgcaagttttcagtacaaattttttttacagtaccattttagagataataagcttttgtgatctctattatacaagtggaggggggaggaagatggtgtccctcttcaaaataactcaaaatacccttaatgaattaaatgcatattaaaaaagttaattttgtttaatttttacatgccaattaaaagtagtgatcttattataagaataactttaggtaagtgtaattatattccaaatttgtattgatccatgttatttaccatttatattgaacaagttaaatatggaattttattttaaaattttcaattaaatattaaagtgaaaagaatgattttctttttcatatttgacatatgaaacatgctattaatgacttgtgcaatgtgcatatgaaactcgatctaataacaaattatatgaaaattatattctaaaacttaaatgttaattttttattattcagtattctctatcatatagataaaactttttcactttattatagtcaacgattgaacctaatacacaaattccttttcactttatttgaacacatgactttttgttactttaaagaaaaaaacattgttttaagaaaactagcaataaattacaaataaatgaatatgtatgttcaaaccaaattttctatagcgaacttgtttttaaaaataacattaatatgatacatcgcgtgcaaaaatagctagtacccttaattgaatgtgacctttcatgtatcgatgaaataagaaatatttcatacgatatagacatatagttaattaatgcagagcttatgtgagagatgtgtatgattattaattatttttcttttaaattatttgataggcgatccagctggtgcaagattaaaacccggtagtggatacgggtatggatttggtatccgtgtggagtcacctttaggtccattgcggcttgaatatgcatttaatgacaagcaagcaaggaggtttcattttggtgttggtcatcggaactaacagagcttcaattgtttgggtagctgcttgcatatctatctgcgattttgttagagtaggataggaaaaaggcagcctgtatttttgcagttattggtctggaatagatgagaatggagggctacacaaacttgcaaatatttattctttgtttcacaggctcaagtacatcgcctcatctcttttttcccagctgtggatgtataataagtttaacctgcgaaaattgccattaaatcactttctcaattattaatcttgattctgctacatgactttcggcgaatcttgccatctacaaactgtacgttgaatctttaatagaaataatcgcggccaaatcttgcccatctattatgagtaagttctactatggtcccgggatcatggtcttctttatggtcccggataaatgttcattttaacatgtgaaatgttcattttcaaatgtcaatgtttatatttgaaactgaacatttgtattttcggaaatgaatatttctattttaagaaatgaacatttctaatttcggaaatgaacatttgtccgggaccataataaacctattggagtaactggattgatcgatccggcgagtcttagaagtttggtccatgacccagtattgcaaagtgagctgttcaagtgtccgaaatgttctcatcaattgctttccgaagtataatgaccataatattttttctttgttttgtaaggcctatatccaaaatgcaaagtgaggtgggggacactcaactcatgttcgacttgaactcgattagatcacgagctaggggtgtttgactcatgcttgttagagtctgagttgagacaagttgatcaagtaaatgtgttagcccttttgaaatttacattttttgaaaacgaaaattcttgttatttacattttttgaaaacgaaaattcttgttcatttttttatgtatttttttatagtgcattagatacagtatagaatattaaattagtgatttttctctaaatttaagtttcgagttgtaaccgtgattcgaattatgatcgagtagagctcaaactgctcgcgagttgctctactcgattaacgtaatagtttaaacctaaaagtttatatttattattataaatgccaaataaaaatttgaacgacaacaattatttttcttttcaatttaattgatattataaattttattatttttcacttgagctctacacaattactgtatagagtatatactaacctttgcaattttttttggagcaatggatcaataaaacaagccgaatacaagtagtttttataccaacgacatttgcaagttcaaattacacggataataaaaaatattttattacgccttattattattttgataaattgatccacactttttatttttccaaaattgttcttacgaacagatccaatgttaatttaactattatcagattttttccaatttaattataatgaatagtaatttgtcaacttaaatcccataaataatcctccgttaaaaattgccaaagaagtaacctttcatactaaacctacatatgaataattaacctcctttcatactaaacctacataagaataattaaccttctatgctataattgctattatattaaaaacacatgcataaaaaatcaagtgtgagattttaggttaattaaggattaatccaatagtatgagaatgactaatagtcattgtggagagagtctcaaatctgaataatagtcaatgggtaaatgcaaaaaacctctagggaatttataggcaaatgcctaccatttgatggcttgcattgtgacaagtgtcataaatccaatgtctcgccctctttcgatctccatcacatgtattttctataaggtgtatctttgattaattagttgccctactttatattgtactccgtactagataaactccgagcaaatgctcgatttgtaaatgaattataaattatttttatgtaaatcgaaactttgatctatttaaaatgtaaatatgtaaagaataggtttaatttttttaatagttataggttttgattgtgattaatatttttaataattatgtatcaattactaaatgttnnnnnnnnnnnttattttcaaagctcatttattaacgtatattcattaattattttttacattttttatacaatcattaattaaagggtaatggaagggtgagacttgctttagtaatattattatatagatttttgtatgatagaagtgtttttgacaattcaaaaaattattttttgcacttcaatttctttgatacttctacttataagatctttatatacaagtaaatcacttccttcttacaattgtcctttataccttctttattgaatattgattagttaaaaaacactattcatgtgtaaatgtgtattcttattagtttcatctcaattttaattttaaaatattaccaaaatctacagaaaattttcaatgaacaaaggaagtaatccttgactattttcacgacatgttaatcctttaatgtgcctatttagagtacttcgtacctaaattataacttttgcaactagaatacataaaatgcgagagtgagggataactcaagtnnttaaagcttccctcccgattccaggagattctgaaatcgattctcatcccagcccgtagagtgtttagttacttgaataagaactttataacatattttgaaattattttgcatataatgaagaaaattgccccaaaacttttgataatccatctgtttgtaacggatgacattcaattcaaatccttcaataataactctcctttgcattgataattgttcgatacgaatcactcacacgtattgtttggggaaaatcatatcaattttcaacaaaaacgcttagttaattttttaaaaattcctctctattattaaaaaattcgaaatcgaaaccctaaattgaatggttgctcttaccttgcattgtgggttgtgatctctagggacgaaggtagagtgaatgaaaactttataatataatgcgactgaaatgagtggtcgacatgcaaatcagaaattgatacataatcaaggcaaattagacaagaaaaaggacaagaaagttatataaaaatatagcattcgtgttgccttgataattgagagatgcaacacatgcaacatcaattggattaactagtaaactaattaattaattaataattagtactcctaatttaacaagaattgctcctatattatcatggtctacttttgcggccttcatttcactcatatatattactcatttgatgtacaatgggaactcaacataatccttatttcaattcaaccctagattaattacattcatcaaaccttattaattaagtaaattagtttatgaaaggttgctgtctttgttggaccatcttgttagtagtgtatgtacaatgactaccattgaaactaagcagacaaggtatacgtttgcgcagaatttaatactcgtatttgaattgaagccatttggtttaattttgaggtcgaaatggtttaggtttattaacaacaaatattttatgacaagaaatgaaagagatttgatgcacttacattaattgaaaataaggtgaagtaaatagacccttaaccacgctaaatctctgttacgtacttagctagatttatcaaccacgctaaaactccattattttggattgttctaggttttaatttatagttcgggcacttcaattttagagtacatttaagttattcaattagtttcaatcaagaaaaatagtgcctaattaacaagttgacatagttgattcctcgactagaaatatacttgcattggttggtaataacataatttagggagcacgagtacacaatacaagataggagagagagagagagaactctatgtaaccagtttagtactaaggttgaacccctcaaggactgtttgtctcaaataacgacaggaattccttaacaaattgaagaaataaacaaaggaaaaaaacaaattaaagaaaccatatgtattttatatatttggttaatcagttctacttcgatgagttcccaccgctttagacgaatgaattaatttgaactgatctcctatggatgtttgtgtgaatacctcaatggggataacatccctctcatctgcgattcgttctattctgaaaatcttggataaaacccgtaatcactcaagccaaacccgattggtgaatcggacaaaagtgtatatgaatatatgatgtattaggaaatggaaaaatcaatatcaactaaacgagtatgataattgacagcatctctcacaatagtgattttttccattattactttaaaataaattcagatgctgagaatctggttaaagaacttgatacctttaaccgctcaagtcaaccccggttggtgaatcgaacgaaagtgtgtatctatacacatatgatgcatggttgaatgtgtctaaaaatattggttagaccaccatgcaagaatagaggtatttaatgtcccccgccttcattccccctaattttctgtttattgaaaatgtcacatttgatttgagggaattttgcaaatccccaaaattaaaaaaaaaaactttggattaaaataataatcatatttaattttgtcaaacgggcctgggccgcgcccgtcacggggagtgcaagtccacatcacaagaccaaggaggttccacctcaaaaccatatggca

SEQ ID NO: 428 - DNA, 548 bp, Lolium arundinaceum
gtgccgccccaacgcggcgctcacggtgcgggaggtgcaggaggatgtgcaccgcgtcgtggagagcggtctcttccgttcctgcatgcctgtggcggtcgacacccgtgatggtattcgccttgtcttcgaggtcaggttttttgcttgttccccaatcccctttccatggcctatttctggaactgaaggttgcaacatttgggatttgtgatttaggtggagccgaaccaggacttccaagggctggtctgtgagggtgccaacatgctgccttccaagttcctagatgactcattccgtgaccgccatggtagtcattttagctgttctcatgctaaagagtcccgttatgttgcatgtggtggaacgatgctatgtttacatgagagtttgttacgtgtggttgacttactttgagtgatgttacatgaactgttaatacatgtttgatttaagcaatttaagtgtataaatttgtttgggcaaagagctactggagtgcattgcattgatcaatatctagaatatttgacccaatgcaacgt

SEQ ID NO: 429 - DNA, 245 bp, Lolium arundinaceum
tgtaggtcgccaccgaggtgcgcctcccggtccccatggtgaagaacacacaggtgtacgcttttgccgagcatggcaccgaccttgggagctccaaggatgtcaaggggaatcctacagagttcttccgacgtgccggccatggatcatcgtacggtgtcggcatcaagcttggcccactcagggcagagtacgctgtcgaccacaatgctggcacaggcgcccttttcttcagatatggcgag

SEQ ID NO: 430 - DNA, 896 bp, Lolium arundinaceum
gattaatattaactaaagggatttttttccataactcccaactagtcgcctgtattttcagttctcatctcttactattgttcatggacccccacccaccaacacacacacacccgcacctgatgcatgtgagaactacttattatggtgtttgggatgttctgatgtttgtttcagtgattgactattttaagaaatttctatacttgtgttaatgattcgagtgattttattgctggccatacatgttttcatggttgataaatcacgcactattgatgtttgctgcctgtaatgacaccgaatggagttcactagttcctgttctactctaatgcacatcatacttgctgtatgaatcacacataagaagttaaatcagccttctgagccgttattttgattactcgcagtttggtccgttggaaggcgttttgtttggtgattatggtagtgatcttggctctggtccaaaggttcctggtaagccatgctgtacctacaacttttcctaaggcctggtttcattttttacagtctctggtggttttgttctttaggtgacccagcgggagcccgtggaaagccaggaagtggttacggatacggtgttggcatccgtgtggactccccactgggacctttgagacttgaatatgctttcaacgataaacaagcaagacgctttcactttggggttggtcacagaaattaacctacccaagcggctgtttataatgtgtgtgatccaccacttgatcttctgagcatatgtgttggtagggatagtgccagttctttgcaatgtcggtgcaaattattgcaaagcaaaattttgtctaccccagattgccttgcttgtaacatatagtttttttgctcattttctgttgtaa

SEQ ID NO: 431 - DNA, 318 bp, Lolium arundinaceum
tggtggttttgcatagcagtggtacttacatttcatgcatcacttaaactgtgatctagtgcttccggaggtcatgtggaaggaaacttttcgcctcatgaagcatttgcaattggtgggacaaatagtgtaagaggatatgaagaaggtgctgttggttctggccgttcatatgccgttggtagtggagaagtctcttgccgcatggtaggctttttctcgattttctgcaacatttagctatttgtcttcaagaaaaccttgacatgaactacatgtagataaaatacatatacagacctatgccatggtctcata

SEQ ID NO: 432 - DNA, 350 bp, Lolium arundinaceum
cacccgtgatggcattcgccttgtcttcgaggtccggtttttgcttgttccccaattccctttccatggcttatttttagagctcaagtttgcaaaaaaaatcttttctctgtggtttaggtgaagccgaaccaggaattccacgggctggtctgtgagggtgccaagatgctgccttctaagttcctaactgactcatttcgtgaccgccatggtagtgttttttgttgttctcatgtttaagattccgttatgttagatgaggtttgccgacattataaatttgcttaactgagagtatgttgcatttggttgattcgctatgcacaatgctacatggattgttacaa

SEQ ID NO: 433 - DNA, 209 bp, Lolium arundinaceum
acagccagccacagacagcccaaacaaacaggccctaattttgatacctaatttacttatttactgcctggtattgcattatgcagggaaaataatcaacataagacatctggatcaagtgatcaagtctgttaatgggtggtatcaggagcgcggtcttactggcatggtaggtggggaaataattaataccactcatgttctagcaa

SEQ ID NO: 434 - DNA, 691 bp, Lolium arundinaceum
ggattaagcggttagtgctttttctctgtgtgacaaaactcgaaaatatacatgtgcatagttacgtactggtttaggaaacaagtgaaatgaataactgatttggctttattgttttattttcttacctctccattcatatcttagttgcgttgtattgacactttctatgcagcatgctggtgctcgtgatgaccaaggcaaccctgtgatcagagattcgtataacagccaattaacagctaggtctcaaattttgatacctcattcacctttttgtaccatcagtatatacataatcgggtacacgacaaaaataggactgttgaattaagttactttgaaagctgataatcctgtcatgacaatgcagtggaaatccttatgatgacacagtacttgctaagcttgaaagtgtttatacagattctggagatcgtagctctacaatggttagtattgatcctactgcgttctaccgctttctaattttgttgtgatgctttatacccaaccgttgttacttcttccagttcgttttcaacgttgagcaaggtctgcccattcttccagagtggcttagcttcaacagagtgacagcacgtttgaggcaggggtatgaaattgggcctgctcgacttcttctaaggtatgttttagtgcatattgtgcaattgatggacctagaatg

SEQ ID NO: 435 - DNA, 250 bp, Lolium arundinaceum
cgtcgtttcctcgcctcccggtcgcgcgggccgagacggcggccgcgcccttgccgcggaggctcgggaaggacgggggcgaggagcgggtgctgatcagcgaggtggcggtgcgcggaaaggacggggagcccctggagcgtcccgagctagaggaggccgccgcggcggcgctgcgtgcgtgccgccccaacgcggcgctcacggtgcgggaggtgcaggaggatgtgcaccgcgtcgtggagagcgg

SEQ ID NO: 436 - DNA, 584 bp, Lolium arundinaceum
caagtttctgaagccgaggttaataatatcaatattcgctttctggatagaaaaacgtgagaatcatagcttggcttagagtttatcttcactagttaatgttaatgttttatagccatgaaatattgtgatcgttcttatcttctttctctttccatttctttctatcactagtggtgaaccaactattggaaagacacaaccagataccatacttcggcaacttaccaccaagaagggtcaggtcagtgcatttttagaagcttccttgatatttcttttttatcccctttggttgcattagtgatgatttagtcgaacaattttgcatgacatgattcacttcacacttggtgatactatgtcgtgcattgaagcatcgatttaaagtggttttgaagttcctatacaaacactataactaaaaccacaagaactattgttacagtaaatgtcaacaattgtggttggatcattcttgtattgtttttgtatgtcagctttgtcctgtagccttgatgctgtgatggacttatctgcattaacttttaatgatgaagtaggcttacaacagagcacaagtg

SEQ ID NO: 437 - DNA, 446 bp, Lolium arundinaceum
  unsure (1)..(446): unsure at all n locations
ggaggaacaagaagttgaatctctcactagagaggggccaaatagattctatatttcgtttaaactacactgacccttggatcgacggagacaacaagaggacctccagaactgtcatggttcaggtacttataacctttaatatcanatcatcttcgctctaccatgcgccatcagttgagaatcatgtatattctttttcttattttcttttccagaactctaggactcctggaacacttatccatagtggggaccgtcctgaccatggggctattacaattggacgagtaactgctggcattgaatatagtcgaccgttccggcctaaatggagcggtacacttggactgacatttcagctaaacatatcattcatattttggattaagcggttagtgctttttctctgggtgacaaaagtcgaaaatatacatgtgcatagt

SEQ ID NO: 438 - DNA, 494 bp, Lolium arundinaceum
gtaaagacttctgtgtacgcgacaacaaaaagtgactcgaggttcccctttttgtatgtgaatctctgcttgtataccttgagctcacgcccataagtagtgataagaaaatatgaatttgccgtaattgctaacctgttagttgagtatgccaaagtattaggcgtctaccgttttaggtcgtcaaacgcaacaatgtttatagctttaactagtcaaagatattttagcgcttgatttggtctcaggtttcgtctgctgagatcctttctggaggaattctgaggttacaagtttctgaagccgaggttaatgatataaattttcgctttctggatagaagaacgtgagaatcctagcttgacttagtgagattctcttcactgaatattgtttttatagccatgtaatattctgatcatttgtatcttctttgtctttccatttctctgttaactagtggtgaaccaactattggaaagacacaactagat

SEQ ID NO: 439 - DNA, 527 bp, Lolium arundinaceum
aaccacaagaactattgttacagcaaatgttaacaattgtggttggatcattcttgtattgttttttgtatgtcaactttgtttgatgtcaatttgacactcttgtcctgtagccttgatgctgtgatggacttatctgcattaacttttaatgatgaagtaggcttacaacagagcacaagtgaaaagagatgttgaaacaatactcactatgggaattatggaggatgtaacaataattccgcagccagtcggaggtgaagctaatttgtttagttcccattatattaatgttggtctttcttttctcaagtacctgcgttcttacctatggtcctgtgcagattctaataaagttgatctggtcatgaatcttgttgaacgcccttctggtggcttctctgctggtggtggcatttcaagtgggttagtacaagtcgacaagtagtactgcttgcttagtgaaccgaattgagcgaattgcgtgctttcataaaatttgtttcttagcctgtaaggagctgagg

SEQ ID NO: 440 - DNA, 467 bp, Lolium multiflorum
caggacttccaagggctggtctgtgagggtgccaacatgctgccttccaagttcctagatgactcattccgtgaccgccatgggaaaataatcaacataagacatctagatcaagtgatcaagtccgttaacgggtggtatcaggagcgtggtcttactggcatggtttcttatgccgagatcctttctggaggaattctgaggttacaagtttctgaagccgaggttaataatatcaatattcgctttctggatagaaaaactggtgaaccaactattggaaagacacaaccagataccatacttcggcaacttaccaccaagaagggtcaggcttacaacagagcacaagtgaaaagagatgttgaaacaatactcactatgggaattatggaggatgtaacaataattccgcagccagtcggagattctaataaagttgatctggtcatgaatcttgttgaacg

SEQ ID NO: 441 - DNA, 1019 bp, Lolium multiflorum
tgaagctaatttgtttagttcccattatgttaatgttggtcttgtctcaaatacctgcattcttacttatggtcctgtgcagattctaataaagttgatctggtcatgaatcttgttgaacgcccttctggcggcttctctgcgggtggtggcatttcgagtgggttagtacaagtagacaagtagtactgcttgcttagtgaaccgaattcagcgaattgtgtgctttaataaaatttgtttcttagcctgtaaggtgctgaggttgtttattgcgtgctggatttgaataccatatgtgcatatgcaaattgcagttgaatttttgttctaacatatattatgccataatgacatgctgtttttctgcaggataacaaatggtcctctttctggactaattggcaggtcagttggttatttgatctttcagtcattgtactcttatttcctctgtagtgtagtgttttgtgtaatattttaaagatcacggcacggttgttaagctccacctggggtttgggcctttctgaaaaaaaaatcaagaagcaacctaagctataagctgtcgagaattaaattttgtcttcaaattttatgtcacaaaggcgctcatgcttatgataggagttacctcaagccccatcatcatatcatgtttgatctttggagtgcgtaagttaagataacagtcccaaacccaagcaggcttctaggaactggcaattgtaaacactgtttttagttttctattttatcttaaacctattgacatacctgcctgggtaaacagaagctctgcgtctacttttttttcttaactggacagaagctctacatctacttttttctttttcttaactggagttttttaacagctttgcatattctcatcggaatgtttttgggaggaacaagaagttgaatctctcactagagaggggccaaatagattctatatttcgtttaaactacactgacccttggatcgacggcgacaacaagaggacctccagaac

SEQ ID NO: 442 - DNA, 353 bp, Lolium multiflorum
agctcacgcccataagtagtgataagaaaatatgaatttgccgtaattgctaacctgttagttgagtatgccaaagtattaggtgtctaccgttttaggtcgtcaaatgcaacagtgtttatagctttaactagtcaaatatattttagcgcttgatttggtctcaggtttcgtctgctgagatcctttctggaggaattctgaggttacaagtttctgaagccgaggttaatgatataaattttcgctttctggatagaagaacgtgagaatcctagcttgacttagtgagattctcttcactgaatattgtttttatagccatgtaatattctgatcatttgtatcttctt

SEQ ID NO: 443 - DNA, 1922 bp, Lolium multiflorum
gaatcctagcttgacttagtgagattttcttcactgaatactgtttttatagccatgtaatattctgatcatttgtatcttctttgtctttccatttatctgttaactagtggtgaacaaactattggaaagacacaactagataccatactacggcaacttaccaccaagaagggtcaggtcagtgcatttttagaagcttccttgccgtacttgtgtttaatctacttttggggattattaatggtatttataactgtgtgtatagattatcctgggtgcacgattttgcagtacatgattttatgaaccattcttatttcacacttcacactatcatgtgtggtaaagcattgatttgctgttgtatggaagttctgatgcaaatgctataaccaaaaccacaagtactattgtcaccgcggatgtctacaagtgtgtttggatcatgcttgtatagtttttttgtgtacgtaaacttggattgatgtcaatgtgaaactactgtcctgtagccttgttgctgtgatggacatcttatctgttttaacttttgatgatgaaaataggtttacaatagagcacaggtgaaaagggatgttgaaagaatactctctatgggaattatggaggatgttacaataactctgcagcctgtcggaggtgaagctaatttatctagctcccatttttttaaacaagctcttctttctcaagtgccaatgttacttatgatcttgtgcagattctaataaagttgatcttgtaatgaatcttgttgaatgcaccgctggtgagatccttcgtgacgttggcatttcgagtcggttagtacaaatagtcaagtagtactgcttggtcactgaaccaattaagtgaatttgtatgctttcataaatgtgttccttagcctgtaaggtgctaacgtgggttattacttattatgtactggatttggaatattgcatgtagcctatatgtgaattacatttgaattttgagtttaacatatattgttaccataatgacattctgtttttctgcaggacaacaaatgggtttctttctcgacttcttggcgggttagtaggttctttcagagtcattattatcttattttctctggaaaggaatctagtactccttcttatctccttcttatccataataagtgcagctacgacacttgttatggatcggagggagtaacttgttacggcatgtgatactgtcgtagtaatgtttttgagatcatgttttttacactccagttgggtttgagcctttctgaaataacaattccaagaagcaacctgagctataagctatggcaaattaggtatgggcttaatttatactacctccgttccgatgaataaggtttataaatttagtcaaaagtaaaaaattactaagtttgaccaaatataaagaagaaaatataaacatctacaacatgaaacaaatatattatgaaaacatattttacggtgaatctactaatattgatctggtatcctagatgttcatatttttatctagaacattggtcaaacttagagggtgttgacttttgactaaatttatatggcttatattttggaacaaagaaagtagcagagaagacatgaataaatgataggtatcagaagaagactaggcagcttaaaagtcaaaggacatgtgcaacaaagcaacacatttataatcgggaaacgaattcagaatcaagtaaagaagtccgagcaaagaaaatatctgactgcagcatagtaaatgaagtaaagaagtccaagcaaagaaaatatctgactgcagcatagtataatataagcaaataactgtaagacaagcagccaaagatttcagtaaatctgatgactaacatgatcagatgataaaaaggtgcttggtacaacata

SEQ ID NO: 444 - DNA, 314 bp, Lolium multiflorum
gaacaattttgcatgacatgattcacttcacacttggtgatactatgttgttcattgaagcatcgatttaaagtggttttgaagtttctatacaaacactataaccagaaccacaagaactattgttacagcaaatgtcaacaattgtggttggatcattcttgtattgttttttgcatgtcggctttgtttgatgtcaatttgacactcttgtcctgtagcattggtgctgtgatggacttatctgcattaacttttaatgatgaagtaggcttacaacagagcacaagtgaaaagagatgttgaaacaatac

SEQ ID NO: 445 - DNA, 704 bp, Lolium multiflorum
acccatctactgcgccatagtctctcggtagtctcacattgtttttcgtttctctgaaggaagagaaatgatgttcaactcatttccaagtctagtgtacttttcttaccttctgagattagtcctttagatctaatttactgctttttatcacattatgcagggaaaataatcaacataagacatctagatcaagtgatcaagtccgttaacgggtggtatcaggagcgtggtcttactggcatggtaggttgggaaaagaattaataccgctcatgttctatcagtgtgcattattttagactttctgttatcgttgcaacttaattgagaacatcactgaacaagaggcatctgccacccatgtcttaaggaacaattgaacacaatttgtaacttcttgggatcttgaccttctagaggcctgctaccacaggacttgagttgttaatcttctatttcttcagtgcactagccaaactgccattgttcacacctcaccagtatcacattggagagcatgcaacatattgtcttctactttgccgtttgttacttcttgctttgtatatagaacttcattatcaatctatgtttttcatcctacatgttcttaatcatgacaaaactagaaacatgacgtggaaaatgtgaatatgtggtagttgctctagttgagtttaccgaaagttttggtgcctacc

SEQ ID NO: 446 - DNA, 620 bp, Lolium rigidum
gtgttcttacttatggtcctgtgcagattctaataaagttgatctggtcatgaatcttgttgaacgcccttctggtggcttctctgcgggtggtggcatttcgagtgggttagtacaagtagacaagtagtactgcttgcttagtgaaccgaattcagcgaattgtgtgctttaataaaatttgtttcttagcctggtgctgaggttgtttattgtgtgctggatttgaataccatatgtatgtgcatatgcaaattgcagttgaatttttgttctaacatatatttattatgccataatgacatgctgtttttctgcaggataacaaatggtcctctttctggactaattggcaggtcagttggttatttgatctttcagtcattgtaatcttatttcctctgtagtgtagtgttttgtgtaatattttaaagatcacgtttgttaagctccacctggggtttgggcctttctgaaataaaaaaattcaagaagcaacctaagctataagctgtcgagaattaaattttgtcttcaaattttatgtcacatagtcgctcatgcttatgataggagttacctcaagccccatcatcatatcatgtttgatcttttgagtg

SEQ ID NO: 447 - DNA, 606 bp, Lolium rigidum
gcacaggtgaaaagggatgttgaaagaatactctctatgggaattatggaggatgttacaataactctgcagcctgtcggaggtgaagctaatttatctagctcccattttttttaaacaagcccttctttctcaagtaccagtgttacttatgatcttgtgcagattctaataaagttgatcttgtaatgaatcttgttgaatgcaccgctggtgagatccttcgtgacgttggcatttcgagtcggttagtacaaatagtcaagtagtactgcttggtcactgaaccaatttagtgaatttgtatgctttcataaaatgtgttccttagcctgtaaggtgctaacgtgggttattacttattatgtactggatttggaatattgcatgtagcctatatgtgaattacatttgaattttgagtttaacatatattgttaccataatgacattctgtttttctgcaggacaacaaatgggcttctttctcgacttcttggcgggttagtaggttctttcagagtcattattatcttattttctctggaaaggaatctagtacttctgatccataataagtgccacacgacacttattatggatcgg

SEQ ID NO: 448 - DNA, 1333 bp, Lolium rigidum
caggcttctaggaactggcaattgtaaacactgtttttagttttctattttatcttaaacctattgacatacctgcctgggtaaacaaaagctctgcatctacttttttttcttaactggacagaagctctacatctactttttttttcttaactggagtttttttaacagctttgcatattctcatcggaatgtttttgggaggaacaagaagttgaatctctcactagagaggggccaaatagattctatatttcgtttaaactacactgacccttggatcgacggcgacaacaagaggacctccagaactgtcatggttcaggtacttaacctttaatatcatatcatcttcgctctaccatgcgccatcagttgagaatcatgtatattcttactcttattttcttttccagaactctaggactcctggaacacttatccatagtggggaccgtcctgaccatggggctattacaattggacgagtaactgctggcattgaatatagtcgaccattccggcctaaatggagcggtacacttggattgatatttcaggtaaacatgggattcatattttggattaagcggttagtgctttttctctgcgtgacaaaagtcgaaaatatacatgtgcatagttatgtactggtttaggaaacaagtgaaatgaataattgatttggctttattgttttattttcttacctctccattcatatcttaattgcgttgtattgacactttctatgcagcatgctggtgctcgtgatgaccaaggcaaccctgtgatcagagattcgtataacagccaattaacagctaggtcttaaattttgatacctcattcacctttttgtaccatcaggatatacataatcgggtgcacgacaaataggactgttgaattaagttactttgaaagctgataatcctgtcatgacaatgcagtggaaatccttatgatgacacagtacttgctaagcttgaaagtgtttatacagattctggagatcgtagctctacaatggttagtattgatcctactgcgttctaccgctttctaattctgttgtgatgctttatacccaaccattgttacttcttccagttcgttttcaacgttgagcaaggtctgcccattcttccagagtggcttagcttcaacagagtgacagcacgtttgaggcaggggtatgaaattgggcctgctcgacttcttctaaggtatgatttagtgcatattgtgcaattgatggacctagaatgaaaaattgtgtgttacctggtggttttgcatacaatggtacttacatttcatgtatatcact

SEQ ID NO: 449 - DNA, 1628 bp, Lolium rigidum
ctcaattttattttgtttctctaaaagaaaaaaaggacataaaatagaactgatttcctcgtgtaatctatgtatactcttattagtatgccctagcaacttttatactggtgagactgagatgtaagcaatgacatttggatttgttcttgaaacataatttactgtttggttttacattatgcagggaaaataatcaacataagacatttatatcaagtggttaagtccattaacgaatggtatcaggagcgcagtcttactggcatggtaggtggaaaattaaataacgtaattcaagttctaactttgtccgttaatttcgtcgtctctgctatttggtgctgtattgcaaattgtttgagaacattgccagacaacaggcatcttctgcccttgtgctaaggaacaagtgaacatactatgcattttcttggccttcaagaggcctactaccgctggacttgagttgttaatcttctgcttttgtaatgcacttgtcattgcttacatgttacatctcagtctcaccagtatcaaattggtagggcatacaacatagtattctattttgctgtgttgttagttactgcctggttccagctatgcatatagaacttcattcccaagctttgctttgttgcttttgatgctacatgttctcaattgtaacagaactagaaacatgatatgtatcaagttatctattgctcttgtgtaaagagtaaagacttctgtgtacgcgaaaacaaaaagtgactagaggttcccctttttgtatgtgaatctctgcgtgtatacttgagctcacgcccataagtagtgataagaaaatatgaatttgccgtaattgctaacctgttagttgagtatgccaaagtattaggtgtctaccgttttaggtcgtcaaatgcaacagtgtttatagctttaactagtcaaatatattttagcgcttgatttggtctcaggtttcgtctgctgagatcctttctggaggaattctgaggttacaagtttctgaagccgaggttaatgatataaattttcgctttctggatagaagaacgtgagaatcctagcttgacttagtgacattctcttcactgaatattgtttttatagccatgtaatattctgatcatttgtatcttctttgtctttccatttctctattaactagtggtgaaccaactattggaaagacacaactagataccatactacggcaacttaccaccaagaagggtcaggtcagtgcatttttagaagcttccttgccgtatttgtgtttaatctacttttggggattattaatggtatttataactgtgtgtatagattatcctgggtgcacgattttgcagtacatgattttatgaaccattcttatttcacacttcacactatcatgtgtggtaaagcattgatttgctgttgtatggaagttctgatgcaaatgctataaccaaaaccacaagtactattgtcaccgcggatgtctacaagtgtgtttggatcatgcttgtatagtttttttgtgtacgtaaacttggattgatgtcaatgtgaaactactgtcctgtagccttgttgctgtgatggacatcttatctgttttaactttt

SEQ ID NO: 450 - DNA, 349 bp, Lolium rigidum
tagtgatcttggctctggtccaaaggttcctggtaagtcatgctgtacctacaacttttcctaagccctggtttcattttttacaatctctggtggttttgttctttaggtgacccagcgggagcccgtggaaagccaggaagtggttacggatacggtgttggcatccgtgtggactccccactgggacctttgagacttgaatatgctttcaacgataagcaagcaagacgctttcactttggggttggtcacagaaattaacctacccaagcggctgtttataatgtgtgtgatccaccacttgatcttctgagcatatgtgttggtagggatagtgccagttctt

SEQ ID NO: 451 - DNA, 312 bp, Lolium rigidum
  unsure (1)..(312): unsure at all n locations
gngtgttacctggtggttttgcatagcactggtacttacatttcatgtatcacttaaactgtgatctagtgcttccggaggtcatgtggaaggaaacttttcgcctcatgaagcatttgcaattggcgggacaaatagtgtaagaggatacgaagaaggtgctgttggttctggccgttcatatgccgttggtagtggagaagtctcttgccgcatggtaggctttttctcgattttctgcaacatttagctatttgtcttcaagaaaaccttgacatgaactacatgtagataaaatacatatacagacct

SEQ ID NO: 452 - DNA, 289 bp, Lolium rigidum
ccgcttcccaatggcttgggccgagaaggcggccgcgcccttgccgcggaggcacgagaaggatggcttctggagcgggggcgaggagcgggtgctgatcagcgaggtgtctgtgcgcggaaaggacggggttccgctggaacggcccgagctggaggaggctgccgcggcggcgctgcgcgcgtgccgccccagcgcggagctcacggcgcgggaggtgcaggaggatgtgcgccgcgtcgtggagagcggtctcttccgctcctgcatgcccgtcgctgtcgacacc

SEQ ID NO: 453 - DNA, 448 bp, Lolium rigidum
gtgctgatcagcgaggtggcggtgcgcgggaaggacggggagcccctggagcggcccgagctggaggaggccgccgcggcggcgctgcgcgcgtgccgccccaacgcggcgctcacggtgcgggaggtgcaggaggatgtgcaccgcgtcgtcgagagcggcctcttccgttcctgcatgcctgtggccgtcgacacccgtgatggcatccgccttgtcttcgaggtcaggttttttttttgcttgttccccaatcccctttccatggcatttctggaactgaaggttgcagcatttgggatattttgtggtttaggtcgagccgaaccaggacttccaagggctggtctgtgagggtgccaacatgctgccttccaagttcctagatgactcattccgtgaccgccatggtagtcattttagctcttctcatgccaaagagtccgtt

SEQ ID NO: 454 - DNA, 1318 bp, Lolium rigidum
atgttacatgaactgttaatacatgtttgatttaagcaatttaagtttataaatgtgtttgggcaaagagctactggagtacattgcattgatcaatatctgacatatttgacccaatgcaacatcgatctagataaggccagcattaagtctctcggtagtctcacgatgattttgatttctctgaaggaagagaaatgatgttcaactcatttccaagtctaattaacttgtaattaccttctgagatttgtcctttagatctaatttactgcttttttattacattatgcagggaaaataatcaacataagacatctagatcaagtgatcaagtccgttaacgggtggtatcaggagcgtggtcttactggcatggtaggttgggaaaataattaataccgctcatgttctatcagtgtgcattattttagactttctgttattgttgcaacttaattgagaaaatcactgaacaagaggcatctgctacccatgtcttaaggaacaattgaacacaatttgtaacttcttgggatcttgaccttctagaggcctgctgccctgctaccagagttgttaatcttctatttcttcaatgcactaaccaaactgccattgttcacacctcaccagtatcacattggagagcacgcaacatattgtcttctactttgccgtttgttacttcttgctttgtatatagaacttcattatcaatctatgtttttcatcctacatgttcttaatcatgacaaaactagaaacatgacgtggaaaatgtgaatatgtggtagttgctctagttgagtttaccgaaagttttggtgcctaccattatagaccaaaagatattctattgctaatgataagtcaacaaatgttctttatttggcgtcaggtttcttatgctgagatcctttctggaggaattctgaggttacaagtttctgaagccgaggttaataatatcaatattcgctttctggatagaaaaacgtgagtatcatagcttggcttagagtttatcttcactagttaatgttaatgttttatagccatgaaatattgtgatcgttcttatcttctttctctttccatttctttctatcactagtggtgaaccaactattggaaagacacaaccagataccatacttcggcaacttaccaccaagaagggtcaggtcagagcaattttaaaagttcccttcatatttcttttttatccccttggttgcattagtgatgatttagtcgaacaattttgcatgacatgattcacttcacacttggtgatactatgttgtgcattgaa

SEQ ID NO: 455 - DNA, 4450 bp, Portulaca oleracea
ttgttggtgcatatatcagtttgggccagtagatggggctctatttgctgattatggaactgacctcggatcaggtccaactgttcccggtatggctggctatagcttgcttatcctttaaataaaccgtttgctcgctctactagttgattgtttttagtgtgattatatcaaacgaatctaagtaacgtttatggatatgaaggtgatccagcgggagcaaggctgaagccgggaagtggttatggatatggatttggggtgcgggtcgagtctccattgggtcccattcgtctcgaatacgccttcaatgaccgccaagccaagaggtttcactttgctgttggccatcgcaactaatgtcttttttttaaactcgggtaaatgggattgggttagtctaccatttactgggtaaactgaagaggtggaccaacccatattttgcgtggtttgattgaaggagtagctagagctggttactagatagaataaggccatgttttggctctcttcaaagcaattttttttatttgtttctgggtcgtaggtttatgccaatttggaacactgcttatgcatgagattaacatttccttcatgctccatttgttgtatagtactactctctttgtggaattgattccatggtatttggatgtacaacttaaggtcaccaaacaatagtcaagttgctctggcagatgcgaagttcgggacaacggtgtaatttgagttcgaattattattatccgaatatattataatccaaattttgaaagatttgatcaaatatatttttccaaaataaaagttgtatgatgcaattagtgatttaatacagttctgggttgggagagggatgaaaaagcaaatagttcaacctaacaggaataatgactgattgacaccctatagatttcccaagcaaggggaatttgtgctctttaccactcgtgatcaatcatgtttgcaattagcaactgcttgataatattgtgaagataaggtgtcaattcaagcttaaacttgaagcttaatttgttggtacatatcatcaagagtgcgtttggctttggctggttaaaaactctgaaaaaatggttaatttttttaagttgacttaacattttcttattaagttgtattgggaaaaatttctaagggacccccagtttccaatatttccttgggaaaattttccgatggcccacgctcttaggaagaaagagagatgttcatgggggctgattgattcatacgaaacgaacgaaagcaagaaaatcccaaatttcttcactttctctctctaacccccccaatctctttctctctcctcttatcacctcaaatcttaatcatccctctctctcttcctcggcgatctctacgctcttctccaagttggttttcgtccacagaccaatttgtttccagaattacaaaaaacgattaaaggtccctttattttgctgtaattattttaagggtcctgtattttgacaaattattatggggtgacattatctttgtagcatttatttattggggacattccgaccgattttccggtctaaaaatgcgtataacagtgatttttgtatttaaggttgttttaattgaaatttactatcattttagaccttaatatttagggttggtcaatgatacataaccctaatcaacaataaatattacaattaatgttttgttcgccggaaaatagatcggaatgttccctgaaaataattacaacaaagataatatcacctaaattatttatcaaaatataaggctcttaaaataattacataaaaaatatgaggaccttttagccgttttttgaaagaattactccccataaaatccattttaaattatatatattacctatataatctctcactatatatatgtaagtaatagttataattttcccataactacaaagacattcaatacaactataaatgacatacaaatattttcaaccggcattatatgtgacctgcgtctcactttcatatttctgtactgaactgcaggtgttttagagccccgtactatctaaattcgtatctgaagtttcaatttccctccctcccagaaaacggtgagaaaagttttcatctgcaaactatataccctagattctgatgatcaagcaccttattcccaactccagatccttctcacacatccctcattctctttccttcatctttctcgcttccctccacactcattcgcttcttcatcagaatcccaaacccaaatccaaacccagcaactggaacaccaaccactccttcgtcaaatcaaaccctcttctatctctcctcgaaaaatgcacctccatgcatcaattgactcagattcaagctcagatgataacatctgggctcatcttagacgggcttgcttcaagtcgattggtggcgttttgtgctatgtccgaatcgggtgatcttagttattctgagaggattttgaagtttattcacaacccaaaagttttttcatggaatattacgattagagggtattcagagagtcagtttcctgttaaagctattgttttgtacaaagaactgttgaggagtgatgggtgtcgacccgataattacacgtatcctctgttgtttaaagcttgtggtaggttgtcgttgtattacatgggtcatgaggttcttgggcatgttttgaaactgggtttggattcggatgtctttgtacataacgggattatacatatgctggtgtcgtgtggcagagtggaatgtgcacaccaggtgtttgaggaaagttccgtgagagatttggtcacctggaactccttgatcaatgggtatgtgcattgtggtcggggttctgaggcgctgaagctttacgaggagatgaagttggaaggggttaggccggatgaggtgaccatgattgggctggtggcgtcgtgtgcacaattagaggatcccaataaaggaagggaattgcattgctacattgaagatcatggtttgaacttgactgtcccactttgtaatgccctgatggatatgtatattaaatgcggggaccttaaatcggcggaatcaatattttgtaatatcaaaacgaaaacaactgtttcttggacgacaatggttgcaggatatgccaagtttggtatgctagatgaggcaaaagagcattttgatgcgatgccaaataaagatgtggtgccgtggaatgccatgattggagcctatgtccaagcccaatgcagtaacgaggctttggatctctttcatggaatgcaggatacaaatgtgaggcctgatgaggtgaccatggtccattgcttgtccgcttgctcacagctaggtgcacttgatattggggtatggattcatcactacatcaacaaacataacctttctctaaatcctgcattgggcactgctctggttgatatgtatgcaaaatgcggcaacatcgggaagtctcttgaagttttccaggaaatgccagttaagaactctatgacttggaccgccctcatcgggggcctagccttaaatggaaacacagacgaggccttatcctacttttcaacgatgattgatgttggattggacccagatgagatcacctttctcggagtcttagctgcttgttgtcatggggggttggtggatgagggccgtaagtactttgcgcaaatgacctctaaatacaaacttaccccgaaagcgaaacactattcttgtatggtggacctccttggtagggctggtcgattgcaagaagcagaggctcttataaggagcatgccaattgaggcagatgctgtcgtttggggggctttgttttttgcatgtcgtatgcatgggaacgtgacaatgggagagaaggctgcgtggaaacttttagagttggatccgggcgacagtgggatatatgtgctactcgctaatatgtatggggatgctgaaatgtgggatgaggctcggaaagtgaggaaaatgatgaagactagaggagtggagaaagctccagggcgtagctccattgagattgatggcattgtgaatgactttacaataagagataaaacacatcctgattctgaagagatatacacatgtctagttcaattaacaaagcagctagaattgcttgaatataacccatggatgacagttctcgtttaggaggtttgtatccaaacttgtggccatcatggacgcactgtttccaatgttcattgatatactacgctgcagtatcttaattaggcgttcactggcatcgagagaacgtcttctctcttctttattaggaagaaagggagaggttgatgggggactgtccgggctgattgattcatacgaaacgaacgaaagaaagcaagaaaatcccaaatttcttcactttctatctctaacccccccccacatctctctctctc

SEQ ID NO: 456 - DNA, 10576 bp, Portulaca oleracea
  unsure (1)..(10576): unsure at all n locations
tttattttttattttttgttttttaaattttgaagtttttaatattttgaaacttataaattttaaaactctaacctttaatttgttcatttcatattccagaaatttatctaaacttatataaacattccaaaaattactaaaaataacatttactatacctaccactcaccgctgaaatttacaagaaaaataaagaacaacgaaaagaagagagaggggaagacaacaagatgaaatataggagaggatgaagaagagttttcaatggggttagagtgagtttggtttattttcatgtttttagtcctttgttgccaattttgattatcgagttcaattagtaaactaatttttcgcactttaacttgccacaaccaataagcttataaaagtgtttttttttaaaacaattttatcaaattaagtgacaataaattgatcgaaaatatttaataacatttttgatatcctaaaatacttgagtgacaatttaatccaaactccgcattccgccacccccactagtatgctcatcgacattggccctgactcggaccgacccgactcagtcggagttgaaatcggcggtgactcgtgcgaggagggaggacgaagagagagtgttgtgagctttgaaagcttctcggccgaactcagctttgactgttagggaggttcaggaggatgttcatcggattattgatagtgggtatttttcttcttgcatgcctgttgctgttgacactcgggatggcatcagattggtctttcaggtacattttttagtgtaatgttagtgtcttttttcttattcatatatgtctggtttttgttttgaattttgggactgtgctggaatttttgttgattgaggatttctgtgaagttggggatgaatgatgaaattgggtttgaggattttttgtagattgtggtagtaggagttgaattgtgtttgggaaaatgggtttataataatgagttttgggtgttattatcatgcggttgaagctcaaactattcatgtgcaaattttttacaatgataatttgagaatgagagtttgctagtgctaattttgggaaatttgggatgtttacttacctacccttggtcctctacatgcaacttaaataggtcaatttatcaattgatgattattgtatacaaattgatgaatttcgcagtaatattgataagtttatcatgaattttacaaggaatattgatgaatttcttttcaaatttaactccttggaggacctaggtagttactccaagtctccaaggagtaccatataacaattgttcttcctcctcaacttgaaagattcattggctactactaaacccaaatttgctatcagtatctgttggaaatctgttggttttactcgtctggaaagtaaatttctgatgacattgcagctatcgtggtgtattttgctctttctgaaataactaatttttcaaaagaatgtccttttccattttgtggcacaaggtaggaccaaaccaggagtttcgtgggctggtgtgtgaaggagctaatgttcttccatccaagtttgttgaagattcgtttcatgatggatatggtaggtttttggccttgtgttgatggagaatagagcgttatgttctggcgcaaccttcctttcattgaattaaattttatctgtcaagttatgcaggaaaagtgattaatatcagacgtttagatgaagtgattgaatccatcaatggctgatacatggagcgtggttattttggcatggtcagtaatttttcttaaaattgtgtattttttttaaaaagtttatagtctcttattttcttgtgaatggatcttggggaaactgatttattcaactttccgtcaaacctagatgtgtactgtgagcttcacgaccactaaatgtttccacgcttatatttgtttatgtttatgcttgtttaggtttcgggtgtggagcttctttcagttggtgtgctgaggctacagatggctgaggcagaggtcaatgatatatctattcggtttctggataggaaaacataagttcgattttcacaattcttgagataggcaattatcataacaaactctcggcgtattttcaacttagtaatccccgctgtggtatattaggcgggaaccaacagtcagaaaaacaaagcctgaaacaatactatggcagcttacaaccaagaaaggccaggtattttcttcgtgatgtatctattgttctctcttttcaaaaggttacgggaaatgttgcatggctgattttcagttgtcttctgaagaatttgtggcttcacatcttttattatattttggtgcagcgttttgtccacgttggagggactgtatgattgcaattaatatctatgcttatctgaggacttcccttaatgttagatttaaaactgtgtttgtccattctgaatctgtattatatgcttctatagaacgccagctttgatgttgctagattgaggaatcggtggcggtgcaattaaatccaatgccatgataattgtgttctttatgttcttttttggcagttgtataatctgaatcaaggaagaagagatgtagagattgttttgactatgggaataatggaagatgtcagcattttccctcagcctctgctggaggtaattcagttttgggactcttttaatccactaactttaaagctttgtctgcttgaacgtgttgttgacttttccacattgtcaaaagggttcgaattaatttcaatgcgtttaatccaattactttaaagctttgtattgctacagtgtgttgttgactccttcaacttggcaaaggtcaaagaggcgttaatcaattttaatgctcgaatgcactaagaaagaacaactgaagtctgtgaatgatttgatgaactcaacattttaaaatctataaggttacatagtcaaagcctctaaaaatttccaatataaaggtgattgtccatgcaaatacagtggatgctagtgttgagaatatgttgaaatgttaggtggcgaatgcccgctcccatttggctcacatcatgtgtcgtggtgcctcaggtgaaactctggacagttttactggaaactatatgtaacataatttgcaaattttgtgacacatatgaatgccgctttcaaatcttcaacaaacaacctaagctgctgtagggattaatttatctaggatattttgaaatcataaaagctttcaaacgtacaatatttagggctttatgagacttaaaataaactcataggaagttcaatttgtaagaacagatgatgctttcatggaccactctcgggtctaattggaagggactttcatggaatactttatttcctacatgattacatagatgttttggtttattttcccctgctaacgaagatacgtgaactgtgatttctgaacatactgttactttgtaaggttcttattcatgtggttagctataaaattcatgacatagttgatatcgtggaggagctggtgaactgagctgggctagtttgtggtttggggggattgtttatccatctgacaggaagatctacttgaatgatgtattgatgtcaatatctagttgcttgtaaaaggtactgagagaggttaccacgtctttcaattgggactcttgctcatagattcatgggtatggtagattgtgtgtaactgtagagttggcctagatgcatttcctttgaaaagttatggcgaggaaaacaagtttcttctgtttccaaaattcttgtctttctcaaattttcttggcatctagtccaatcgagattaatccattcctctgaatctcctgacagctttgcatattctccccggaatcttttcggcaagaatcaaaaagtgaatatttcacttgagaggggtcaaattgattctatatttcgggtaaattatacagttccatggattgaagccgatgacaagcgtacacaaaggtcaattatgatccatgtgataaaatatggtcctgctagtttgtaggtcaagcatttctttagggtgcgtttggttggnnnnnnnnnnnnnnnnnnnnnnnnnnnnnnnnnnnnnnnnttattttccccatgtttggatgcatgctgacttcgggaaatttttcacgatgggcccaccatttnnnnnnnnnnnnnagggaaaatttcccttaagggggactaagggaaatttttcccggggaacatggaaagatttccctggggttcctaccaaacactcccttagtataatgactagtgtgattgggcattcagaactcaaggactcccggtacttaggtacacggcaaccagcgtgatagtaataccttgaccattgggcgtgcgacagctggcatggaatttagccgccctttgagacccaagtggagcggaacagctggcctcacatttcaggtaatgacagtcatttgtgatcttgatttcttgtttctggttttatataataagtaataaccatctactatttagttatctgtttatcatattctgggttcaaattttcgagctagtcatcaaaatgaatacaccaatgccagttacagttttttgtatgatgatactagcatgttaattttatcatacatttttcatgattaataattatgagtctgacttggcattacacgtgtctatcaatattagtaataccaacttgtacattttatgcataatataatttatcaaaaaatataaataaaaatagttttatatagcttatgggtgttaatcatccttaaaataataatacatattatcaatgatttaaataaaattcaagatgataatcatcttaactcaaaatgcttattactttcaataaagatagttcttggttgggagagggacaaagaagcaaatagttcaacctaacaggaataatgaccgattgacccctataaatatcccaagcaagaagaatttgtgctcttgaccactcgtgttcaatgatgtttgcaattagcaacaactacttaatacagtaataccatgcaaactaatacattgtgaagatgaggagtcaattcaagtttaaagttcaagcttaatttgttggtacatatcattaggagtgcatttagttggtcaaaaactctggggaaatggtcaattttcccaagctaacttattttttccatgttaagttgtattttgacaatgaaaaaagttttaaggagatccatgattgcccacatttcctttttttggaggaggggggggggggaagagatttttttggggaaaatttttcgcagaaaaagcttcctatgaaaaatttcttcagaaaaaattttcgtagaacttttaccaaacgatgtctaggctaatcttgccattatatttatatctgaactaaattcatgttgaagtattatggttgtaattaggtgtataatctgtcaatggggtagagaaccaaaatgaagatagttaaatttagggacagtgacataccaactactttatctgggtataatcatttcccccatttatctgggcatgtaagcaaagtcttccctaacttcaccttattccttatattatttttctacttccatcctttctacacatctgtctttcagacacctactcttttttttcttttttctttttttttgtgctcaccactacccaatactttgcttttctttcaattccccccttgttcctaccaattttcatcattaaccttgtttttatgacatctttcagtacgtcttttgtgcatttcctcattggtgtaagtagatgtccaacttaattcctgtatttttttttatctaaagttaatatttttaacctgtgtacttttactcttacatagtcctaggtactgcagttggctgctgttattaaacatgaaatttaatgcacccttttctgatgatcatggttcttgcatgaaccaacctcctcaaatcacctcctccaccccatattaactgtatttttattttttccccctttttttgagtatatataatatctcttttttttaactgtttctttttaacaagttaaagaaaatcagagaaagagtattaaattcattacatttatggtccagcagcctcatgggcatatttcagggccaaaccccattgaagccatgattgtatcatgttgaagtatttttgctaatctcttgatctgttgctgctgtttttcaagatcttataatacaaaaatggagaatgtgagtaatgttgatcatggaggtttgtcaaaaatggaggactatgaaatagtagagcagattggtaggggtgcctttggaactgcttatcttgttcttcataagttggaacccagaagaaagtaagattttccttttaatttcttcctattttgtattgtgggatttttatttgagttcttaaattggcagatatgtgctgaaaaagatcaaattagccaagcaaactgagagattcaagcgaaccgcgcatcaagaggttagttaattaaaatgtgtttctgtgaaattctaatctcttccattagattgttttgcagttgaaatgtcaattgaattgaatgtctgaaaatgatgtttttcctctgatttttcaaacagatggacataatagcaaagttgaataacccttatgtggtggagtataaagatgcatgggttgaaagggtaatattctttttgcaagttcctgttttattaaaataaaaagcaaatatcaaggatttggtgatgtaaatgcaggattcatatgtgtgcattgtgacaagctactgtgaaggtggagacatgtaagatttcaccaaattactgttatagttcaaatttactgttaaagatggatttagagtgatctgatatttcagggcagagttgatcaagaagtccagaggaacatttttccctgaggaggtaaataaacacggtgaaacgataacaaacaccatctcatcatcatcgaacaatattcaatatcactaggtcaaggaaatgctattctgtaaatctatgcagaaactctgcagatggttgactcagctcctattagccgtggactatcttcattccaatcgcgtcttacatcgcgatatcaaggtctaatttcgaacaacattctgtttttctgtttgcttaaactgttagtgtttcacattgtcatgtttctgttgtgattacattttacagtgttccaacatatttcttgccaaggacagtgacatccggttaggtgacttcggtcttgcaaaactcctcagcaaagatgatcttgctttctcggtatcgacttatcttcactatttcaaggcttttactgtcttataggaagcgctgcgaaattgactataaaaaatgcagattgtgggcagtccaaactacatgtgccctgaacttcttgctgaattaccatatggttacaagtctgatatatggtccttaggtaaaggaaaaaacctcacaaactagctacattttaactgacaaagtgacaattactttgtgctgtgtgtttaatatttgacgctcgtatacacaggttgttgtatgtttgagatagcagcacatcaacctgcatttagggcacctgtaagtcattcagtttgcttttcatatctgtatattattgcaatgcaaaaaagattactaaagtaagaactttggagctactcctaacgacaggatatggcgacattagtcaacaaaatcaaccgatcgacgatttctcctctcccaactatgtactctgccaatctgtaagtcgtgacagatcatgagtaaccaatgtagcttaagacgtactaccttcagtttttcagttgagcaagaaccacggaacttttgatggcgtagtttttgatgaatgaatgtaatgatgtgcaggaagcggttaatcaagaccatgttaaggaaaaacccagaacataggccaacagtaagtaacagttaatatttgccttatggtcatcataattcgaccaaattcaaaactagaacatgtctgaatttaaatcctggccggggtgtccaaattttaaggacaagtcagatgaggtgaaattcggattatcggacaattgggttaggacacgaggcacttggtgtatggacattttagtccaaattttgaggcattcacgtcttggtcggatcgcacccaattttagtgaatgtccggatcgcacccaattttagtgaatgtcgaaagattgcattacaaattctgacaatagggtcgagttccagtaattctgtccaaattattaaatgaccaggatttgggtttgctgatattgtcaccgtctgagttgttcgacctgaatttcaacctaacccaactttggacagggctgtccaaatttgaaagaatagttgggttcagccaaattcaaataatcgaacaatcaggaacaatcgggttcggacataagcacacttgatgtatagatatttttcactccaaattttcaagaaatcttttgaataaaatattcgcacatcaaggtcctggtccgatcacacccgatttcaatgattctgtccaaactaataaacaatcggggtctggctttgttgatacagtccaacattcaaattatccggacccaaatttcacccagacccaatcttttgcgtactgttaaaaatctgtccaacctgataacttagatttgttcaacaccggaaaagaccgggtatggtcatagaatttttgtcctaattttcacattgaccgatttgaccgaaacccaatttaaatcatgcttgtccgatctgaaaagtatgtgaaaaaactgggtatcgatcctcaagtattcatatgatgtccgatttatccgagcccgaattttttgtcaaccctacttgaaagaatacatctgcaatattattgacatgcaattcattactgaataatacaggcagcagaactgctaagagatcccctgttacaaccctacctatcagaatgccacacatcttccccagttttcttgcccatcaagtcaccatccaccgccaccaacaaacccacccggccaagcatcccccgtttcccctccaaaccctccacccccaccaccgccgccaagttcggaaacctcccaccacgactccccagaatcccacgcgccgccgccaagaccgccgcagcctcctcctcctccgactcccaagaaacccgggtcgaaaccaaacgggtcgacccgacgagctgctcggaccggatctggaaggcggaggagggcctccgtgtgatctcgacctacatccagcagatcaaggacgccggattgtccaccgacctcgtcaacatcctggccggagctccggacgaaaacttgccggaaaagctcgccgtcgattacctgacgagaataatggacagactcaggggggcacagaaggaagaagtgaaggcggagatgagtgctcaggtggagcagagggcggaggcgctggagtcactgctggagctgtgcgcgaggctgctgaagcaggaaaaatacgatgaactcgccgggatattgaagccatttggagaggaacctgtttcgtcgagggagactgcgatttggttgacgaaagggttgatgagtgctgggaaacaggaagcagaaacttaggtttataatatcagtaataatcggacgatgtgttgtttgtgcctacatttatgtgtttctgttgtgtatagcaaactgtttgttcagatgttggtttttttggcaagattgaattctctaaagggcatgtaaatttgaatataaacagtttcactcatcttggacttatatatatagaggatacgaagctatctcaactgaaaatttaagttgatagttgataggggtgattttatactttaacgcgtcccttcatgcatatgcttttggggtttgaagtgtggactgacctctttcacctcgtgtaaataaacatctactctatgttactctggttccacaaataaatatctactcgatgcaactttgataccatgtggagtcatctcaaaccaaaacttaagcaaatagttggagatttaatgatggttttatactccaacacgtcccctcatgcaaatatgctttgagcttgaagcgggaaacgacccctttcacctcgcgcaaataaacaagggatgtgagatccgaacatactcaatgtggctataataccatgtaaagtcatctcacctatagaaaaagaaaatttggttatgtcactatttaaagcttttgagaaatcccataaaaaaaattcactgaatccatcatgctccttaatttgattagtgaggtaaaaaaatagattgaagaaattggagagggaattgcatgcctaaagcgaatgaaatgattcatggaccaaaacgtgaaactctatagaagaaatgaatcaaaaatcaaacgacaatatattagtagaagaaaaatgactcaaatcaaacaacaataatattattttgtgacatataaaagcatgtataagcatgttgggagccatgtttcttacaacttcactattttctaattaatactatat

SEQ ID NO: 457 - DNA, 4357 bp, Portulaca oleracea
  unsure (1)..(4357): unsure at all n locations
tagaattgttcatatcttttaatttcattttatctccattaatccaaaaatccctaaaaattagtttggtgttcttatgagttcnnnnnnnnnnnnnnnntcatccacatgcttgtttagaccctaggcttccgcgattctctccaagaagagtatatgtaaggtggtggtggagatggagatggtggaggtgaagagatgtggatgtaaggaggcggggaagatggaaagggtggaggtagaactgtagatgtaaggaggcgggggagatggagagggtggaggtggagaatgagttttggttcattttcatgcttttagtcttttgtttccaaatttgattatcgggttcaattgataaacaatattttttcgcattttaacttcccacaatcaataaacttataaaagtgtcatttttaataattttatcaaattaagtgacaacgaattggtcgaaaagtatttagtaacatttatgatattttgaaatacttcagtgacaatttaatccaaatttacatgcacaattagccaattcaaggtttttaccatattttgtacacctcaaaaacaaaaaatggaaaagaggaaaaaaaaaacccaaataaaaaaagggaaaaaaaaaaggaggggatgagagttttagaaccaaaaatcaatcaacagtggagtgagaactgagcggtgagcggggtggaagaactgcaacacaaaaatccttccaaaaccctaaaaatcaacaaccgccatagccatgatcatcagatagctagcagaagaaattccgaaacactcattcgcattcatttcgtccaaaccctcgaaaattttcttctccaactcatcacatacaccagccatgccgaagaagaacgaaggtgttcaattcaaatcatcctccattaaaatccctcgttcttcttcttccacccatccaccattccaactttcccacctcccattctgctctcaaaccctaacttccaccttcttgcgcgccaaattctcgttcacccagttcttagactccctaaaacaccgccaaattcgcccatccccactactatgctcttcgacattggcactggctcgggccgacccgactcagtcggagctgaaatcggcggtgactcgtgcgaggagggaggacgaagagagagtgttggtgagcgaggtgctcgtgaggagcaaagatggcgaggagttggagaggaaggacttggaaatggaagccatggctgctttgaaagcttctcggccgaactcagctctcactgttagggaggttcaggaggatgttcatcggattattgatagtgggtatttttcttcttgcatgcctgttgctgtggatactcgggatggaatcagattggtctttcaggtacatttttcggtgtaattttgttagttttttttgtcattcatgtctggtttttgttctgaattttaggactgagctgggaattttggttgattgaggattgctgtgaaggaggggatgattgaatggttaaattggattttaggatgttttgtagattgtcgttgtaggtaaggctgtcaaaagttcgggtccgggtctatcctggttcgggcaagtcggacattggacaaaaatttgatgtccgatatccagttttttgggacattttcgggtcggacaaattggacaaacatgaatttgggtctaaactgggttcggacaatagaagattggaaaatattttgttccaattttcggtcaaattggacaatataaaaattcggacgaaaattctgtgaacatacccacttctttcaggtcggactgaaccggaacttcgggtcaggcattttttgacagccctatttgtaggagttgaagtgggaaagggaaaatgggtttataacaattagtttttggtgttatatcgtgcggctgaagctcaaactattcatgtgcaaattgtttacaatgataatttgagaatgagagttgcctagtgctagttttgggaaacattgggatgtttacttaggccccaggtccacaaatatatcgtacacggtggacctaccctaggtcctctaaatgcaatttaaatgggtcaatttatcaattgatgattttttgtaacaaattgatggatttgcatatatggatgaatttaaatagcgcaaactcgcttccaatatctattggaacttggaaatctgttggttgggctcgtctgaaaagtaaatttctgatgacattgtggctgttgttatgtattttgctctttctgaaataactaatttttcaaaagaatggcctattctattttgtggcacaaggtagaaccaaaccaggagtttcgtggactggtgtgtgaaggagctaatgttcttccatccaagtttattgaagattcatttcgtgatggatatggtaggtttttggctttgtgttgatggagaatagagtgctatattttggcgaaaccttcctttcattgaattaaattttatctgtcaagttgtgcaggaaaggtggttaatatcagacgtttagatgaagtgattgaatccatcaatggctggtacatggagcgtggttattttggcatggttcgtaatcttgattaattttttaatttattataaatttatactcacttattttcctgtcttgtgaactgatcttggggaaccggattcaattttccttaaaacctaagtgtatgttgtgagcttttcgcaactattagatgttttcatgctacatttgtttattcttctgtttgtttaggtttcgggtgtggagcttctttcaggaggtgtgctgaggttacagatggctgaggcagaggtcaatgatatctctattcggtttcttgataggaaaacgtaagttcgatcttcacaatccttgagataggcaattatcgtaacaaattgtcagctctctcctcttctttgtctggaaagtttcacttgtttcagtggttggttggagtattttcaacttagtaatatctgctgtggtatattaggcgggaaccaactgtcggaaagacaaagcctgaaacaatactccggcagcttacaaccaagaaaggccaggtattttctggttctttcattttcttttgaaatgaagcgatgttgcaatttccatctcatgtattgtaattatgaaatcgtttggtgttaaaggagaatgtaatcttttgtttgattttaggttttctttgtgatgaatatattctcccctcgtttcaaaggtaatgggggagtattgcatagctgattttcagttgtcttctgaagaatttgtggcttacttgaggatttcccttaatgtttgattcagaactaaatttgtccattccgaatctctattacatgcttgtatagaaggccagctttcctgttgccagattgaggaattgggggcggtgcagctgaatttgatgccctgatagtcgtgttttttatgttcttttggaaggtgtacaatctgaatcagggaagaagagatgtggagactgttttgactatgggaataatggaagacgtcagcattttccctcagcctgctggaggtaattcaattgggggactttttttaaatcagcttttgtcaaaactgaagtgtgtgaacgatttgatgacctcactacatagtttgctcgtgcatagttttcttaatactattcagtagaaataatgaaaaaaatatatgaacaactgaagtgtgtgaatgatttgatgaactcatgtattagcattttgaaatgacattttagaatctataaaggttacatagtcaaagcctctaaaggtttccaatataatggtgacttttcatgcaaatacgaaatacaatggatgatggtgttgagaatatgttgaaatgttaggtggcgaatgcccgctcccatttggctcacatcatgtgttgtggtgcctcaggtgaaactccggacagtttttactggaaactatatgcaacataatttgcaaattttgtgacatataggaatgccactttcaaatctcctacaaacaacctatgaagctgctatagggataaatttatctagggtgttctgaaaatcgtaaaagctttcaaatgtagaatgttcagggcttcacaagactcaaaataaactcgtagaaagtcaatttgtaaaaacaggtgatgccaaatctcttaatagaggctgtttttgcttctgtgacaatgggtttctagtcttaaccaccacatggggggagagagggacaatctgtttgtgaactaatatgctcgagttccccatctgcctgattcaagtttgatttctgttcatctgaaatatcgccctcctttgtgtcccagacacag

SEQ ID NO: 458 - DNA, 737 bp, Portulaca oleracea
gcgtacacaaaggtcaattatgattcaggtgatgacatatggtcttgccaatttacatttttctagttggaaatcttattatatacatttctttttgttgtagttattttggatgggacttcttcagtataatgactagtgtgatttgaccaattcagaactcaagaactcctggtactttggtacacggcaaccagcgtgataatagtaccttgaccattgggcgtgtgacatctggcattgaatttagccgccctttgagacccaagtggagcggaacagctggcctcacatttcaggtaatgacagtcatttgtgctctttgattgcatgttcctggtttgatataataaccatctactacttagttatccgtttatcatattctgggttcaaagtttcgagatggttatcaaaatgaatgaacacaccaaatgccagttacagtttttttgtagacattaattaatttcttgttcctggaattgtagcgtgctggtgttcgtgatgagaagggggatcctgttatcaaagatgtttacagcagcccgcttactgccaggtatatatatgcttcagaatgttgattctggaaccagcaatcgttataaaagaaaaaccccaaatggaatgttggcacctcctctctttaaatttctgattatttaatgaggaacgtgaaactatctcagccaaaagtttacggttgaaagccaatgatggttttatactcttaa

SEQ ID NO: 459 - DNA, 717 bp, Portulaca oleracea
ccaaaatctttagctgatagttgacgcgtgtagggcccaatgtttgtttgatactcttaacaaggaaatgttttaatgcagtggcaatactcatgataacatgctgcttgccaaaggcgagtgtgtctacactggtgatctaggatcttcaatggttagtcatgacttcacctatgtttctgcagtgtgaccataatttttttcccctttcatttctcataaggtttttgcatgccagcttgtgttcagcatggagcaaggccttcctattttgccagagtggttgtcttttaatcgagtaaatgcccgtgcacgaaccggcgttgaagttgggcctactaatcttcttttgaggttgaatatttcgccacatccttttcatttaaattaaaaatctttatttcttggttaagtttgaaataaacaaatctcatacgtaatggtatattgtttcagtttgtgcggtggacatgtggtgggtaatttcccccctcatgaagcattcgcgataggtggaacaaatagtgtgagaggatatgaagaaggtgccgttggctcaggccggtcttacgtggttggctgtggagaaatttcattcccactggtactttccatttctcagttctcgatactttgttctcttcatttttcctgccctcttcccttaatctcttaccgttttgagatgcccttgtagttcacacatactcatttttt

SEQ ID NO: 460 - DNA, 10513 bp, Portulaca oleracea
  unsure (1)..(10513): unsure at all n locations
taaattttatctgtcaagttgtgcaggaaaggtggttaatatcagacgtttagatgaagtgattgaatccatcaatggctggtacatggagcgtggttattttggcatgatcagtaaattttctttgaagttattatgtttttatttttaagtttgtagtcacttattttcttgtgaacggatcttggggaaaccgatttattcaattttccattaaacctaggtgtatattgtgagctacaactactaaatgctcgacccatatatttgtttatgttgatgcttgcttaggttacagatggctgaggcagaggtcaatgatatatctattcggtttcttgataggaaaacataagttcaattttcacaagggcaattatcacaacaaactgtcggcgtatattaaacttagaaatccctgccgtggtatataaggcgggaaccaactgttggaaagacgaagcctgaaacaatactccggcagcttacaaccaaaaaagggcaggtattttctggtactctcattttcctttgaaatgaagtgatgttgggatttacattacctgtattataattatgcaattgtttggtattaaaggagactgtactcttgtatttggttttaggttttctttgtgatgtatatattctcctctcttttcaaaaggttacgggaaatttgcatggctgatttccagttttcttctgaagaattcgtggctttacatcttacacagcgacctttcaacggtcggaagtttctgacccgtcggccgagcccgacccggcccgaccttcagatcaggtaccctcagcccgagctctgaccctacgggccacggaccgggttaacgggtcgacaattatataagatggatttttttacacaaaaaacctaaaaattcacgtatttaatttatgtatttagtcgggtcgggtcataaaaaataaaatctaatctgggatttttttttttaaaaaactaatgtttttagttgggtcggcgggctggattggtcagacccttggccattgcccggcccgaccatacttcggggccccaacttttcaacttttttaggccgggccgagtcaccatctaaaattggggccttgacctgcattttttcgggccgggtggatccccgacccattgaacaggtcatcgcaactatatatgcaccaacaagcaaccaacacaaacacaaaaaatgggattgggttagtcaacctttgaattcaatgaccgccaagccaagaggtttcattttgctgttggccatcgcaactaacattttttcttaaaaactcgggtaaatgggattgggttagtaagccatttacaaggtaaattgaagaggcggaccaaccaaccttttgcgtcctttgattgaaggagtagctacaacccagaaacaaaaaattgctttgaagagagccgaaacatggcaagatgcaaagttcgggacaacagtgtaattttagagtttgaattattattatccgaatattgtaatccaatttttgaaagattcgatcaaatatatttttccaaaataaaagttctatgatgtttgcaattagcaacaactacttaatacagttctgggttgggagagggacgaagaagcaaatagttcaacctaacaggaatagtgaccggttgacaccctataaatttcccaagcaaggagaatttgtgctctttaccactcgtgttcaatgatgcttgcaattagcaactacttaatacagtaataccatgcaaaactagtacattgtgaagatgaggagtcaattcaagcttaaagttcaagcttaatttgttggtacatatcattagacgtacgttcgattggtcaaaaaccttgaaaaaatgatcaatttggaagttgatctactttttccatgtttagttgtattttgatattgggaaaaattttaagggatccacaatttcccacatttagagaaaatttcccttgtgaggtaaaggaaacttttcctggggaaatgaaaaatttccctggaattgtttgccaaacactctctaaactaattttgccattattattcatatctaagctgaattcatgttgaagtattatggttgtaattaggtgtataatctgtcaatggggtagaaaccaaaatgaagatagttaaatttagggacagtgacataccaactactactttgagggtataatcatttccccccatttatctgggcatgtaagcaaagtcttctctaacttcaccttttccatatattatttttctacatctactcctccttttgcacatctctctttttgacaccaacctttttcttttttttttttttggctcaccacgctcaccactgcccaatactttgcttttctttcaattcccccctttgttcctaccaattttcatcattaaccttgtttttatgacatctttaagtacatcttttgtgcatttcctctttggtgtaagtagatatccaacttaattcctgtaatttttatcaaaaattaatctttttaacctctgtacttttactcttatatagtcctaggtactgctgttattaaacatgaaatttaatgcacccttttctgatgatcatggttcttgcatgaaccaacctcctgaaatcacctcctccaccccatattaactgtattttttccccttttttttgattgtaatatctctttttttaacaagttttttttttaaaaaaaaaatcagagaaagagtattaaattcattacatttatggtccaccagcctcatgggggccaaaccccattgaagccatgagtgtatcaagttgaagtatttttgctgaatctcttgatctattgctgctgtttttcaagatcttataatacaaaaatggagaatgtgagtaatgttgatcatggaggtttgtcaaaaatggaggactatgaaatagtagagcagattggtaggggtgcctttggaaccgcttatcttgttcttcataagttggaacccagaaagaagtaagattttttccatattatatttactgtattattactttgtgtattgtgtgtgattgtagatttttgtttgagttcttaaatttggcagatatgtgctgaagaagatcaaattagccaagcaaactgagagattcaagcgaaccgcgcatcaagaggttaagttaaataaaatgtcaattgagactgaatgtttgtttcagagagaatggtctgaaaatgatgtttttacagatgaacataatagcaaagttgaataacccttatgtggtggagtataaagatgcatgggttgaaagggtaaatattctttttgcaagttcctgttttattgaaaagcaaatatcaaggattttgtgatgtaaatgcaggattcatatgtgtgcattgtgacaagctactgtgaaggaggagacatgtaagtaagatttcaccaaattttactgttatagttcaaatttacagtttaggaaaagatgaatttagagtgatctggtgtatcagggcagagttgatcaagaagtccagaggaacatttttccctgaggaggtaaataaacacggcaaaacgataacaaacaccatctcatcatcattgtcgatcaatattcaatgtcactagatcaagaaatgctattctgtaaatctatgcagaaactctgcagatggttgactcagctcctattagccgtggactatcttcattccaatcgcgtcttacatcgcgacatcaaggtctaagtcaacgccttttttaacaacattcgtttttttttgtttgttcaaacatacgggttgatcttaaactgtttgtgtgcaaacttgcaattgcattttacagtgttccaacatatttcttgccaaggacagtgacatccggctaggcgactttggtcttgcaaaactcctgagcaaagatgatcttgctttctcggtatcgacttattcttcactatttcaaggcttttatactgtctatctaagcattgttattcaaaactgaaaaattgacactaaaaaatgcagattgtgggtagtccaaactacatgtgccctgaacttcttgctgaattaccatatggttacaagtctgatatatggtccttaggtaagcaacaaaacaacctcacaaactagctacattttcactgtgtgttcaattaatcttcgctgctcatatacacagggtgttgtatgttcgagattgcagcacatcaacctgcatttagggcacctgtaagtcattcagtttgcttttcatgtctgcatattataaagttaacacttaagtaaactttggagactcatcacaacaggatatggcgacattagtcaacaaaatcaaccgatcgacaatttctcctctcccaaccatgtactcggccaacctgtaagtcgtgacagatcatgagtaaccaatgtagcttacgacataccttcagtttttcagttcagcaaacttttgatggtgtagttactgatgaatgaatgtaatgatgtgcaggaagcggttaatcaagaccatgttaaggaaaaacccagaacataggccaacagtaagtagcaattaatctttagaaatctcaaaagtcaaaactatgtagtgttggcaaaatctgccccaccatatattcgatcgaattcaaaatctagacaacccgaatatgtccgattttaaatcctgcgggttgtccaaattttaaagacaagtcgggttcggtcaaaactcggataattggacaaacgggttcgaacatgagcgcacttggtgggtatagatattttcagtccaaatttttaaaaaatctttcgcaaaagatattcggacattcaggtcctggtttgatcatgcccaatttcagtgtatatgccagaagatcgtgttacaaattcgggcaactgggtcgggtcagtaacaaattaacaaacgacccgggtctgtctgggtttgctgataatccatcgtctgaattgtccagaccagaatttcaacctgaccgaatttgaacctgaccgaatttgaacctgaccccattctggtccgggttatccaaattttaaagacaagttgggttcggtcaaatttggataattggaccatcaagttcggacatgagtgcactttcattataaatatttaaaatccaaactttcaagaaatcttttgaataacatattcgaacatccaggtcctgctccgatcacccccaattgcagtgatcctatccaaattaacaaccagggtctaggtttgctgatacagtcgacattcgaattatccggaccgaaactgtaccccgacccaatcttttgcccaacattgccaaaaatctgcccgacccattaacccagatgtgtttgacccggtaaaaatcggatacagtcataatatttttgtccaaactttcacattgcccgaaacctggtttagaccaaattaaggccctgttctttnnnnnnntattttgcggtatggtgtggtagggtgtggtggaattgtggtaggtcattggtatgtggggtaggtaaggagagagaatgtnnnnnnnnnnnnnnnnnnnnnnnnnnnnnnnnnnnnnnnnnnnnnnnnnnaagtgtggtgagttgtggcaaacagcggtatgctgtggtaccgcagtttgccannngcagaaaagaacagggcctaatgtttgtccgatccttaaaatacgcgaaaaaactaggtatcagctatcaaatactcgtacaatgtccgattcatccggacccagattttttgggagccctacttgaaaaaatgcatttgctttgcattattactcacatgcaattcactactgaatgaatacaggctgcagaacttctaagagatcccctattacaaccctacttagcagtttgtcacacatcctccccagttttcttccccatcaagtcaccaaccaccaccaacaaacccacccggccaaccatcccccgcttcccctccaaaccctccacccccactgccgccaagttcggacaccgcccaccacgactccccagaatcccacgcattgccgccaagaccgccgcagcctcctcctcctccgactcccaagaaacccgggtcgaaaccaaacgagtcgacccgacgagctgctcggaccgtatctggaaggcggaggagggcctccgtgtgatctcgacctacatccagcagatcaaggacgccgggctgtccaccgacctcgtcaacatcctggccggagctccggacgaaaactcgccggaaaagctcgccgttgattacctgatgaggataatggacaggctcaggggggcgcaaaaggaggaagaaggggcggaggtgaaggcggaggtgagcgcgcaggtggagcaaagggcggaggcgctggagtcgctgctggagctgtgcgcgaggttgctgaagcaggaaaaatacgatgaactcgcgggaatattgaggccgtttggggaggaacctgtttcgtcgagggagactgcgatttggttgacgaaagggttgatgagtgctgggaaacaggatccagaaacttagatgaatgcatcagtaatctgatcggatctttctgatgttgtttgtgctacgtctttctgtgtatagcaaactgtttgttcatgttcagatgttggtttttggttgaatgataatgttgcataattgcgcccaggattccaaggcaatgctttggattttggcatgattcaattcttagaagggcatgtaaatttggatataaacagtttgactcggtttggaattgtatataataaggtgcatgattgaaccaaaagtctaagatgatgcctaatagctgtagattcaatgataaaatttgatatttagctcgcgaatgctcttattatcatctcaatcaaaagttagtcaatagttgaagatcgaatgatggttttatattatcaaagcagtgatcgatctagaaaattctttcacgatctttttaaatcagtgctggagtcgcaatagtatgattggggttcgtgaaactcaataaaaaaatcctttaatataaacatggttgttaggtaaaatatattttttaagttaaatggccctataaaattattatttgatagctgagtaattacaaattactatcttggatggttaaagtttcaatcctaagttgcaaattttattattcttctttgctctttacatattaattaataaatagtaactcatagtttatctctttaatttgcaaatttgatatgaaacttttgtgatcttttacttccgtatgtaattttaaatattaatttgatctaagtcatacaaaaattcacacatcaaatcatttttctcgaaagagattaaaatatattcatgaaactatcttttacaataaaagtaggagagtggtttaagtcataagaaaaatataaaaaaatatggcctcgttcttttgtgcgttaacgtacccaaacgcaacgcaaaatcaataaaacctaacgcatggcaaacgcaagaaaacacaacttatcacaatctattattcacctctattcacctttttattaattcccaccgcaacccaaacgcaacttatcgaaacgcaaacacaacgcaacgcaaacgcaacgcacaaaagaatggagccttaatatgagttggactcttcataaacgaaaaaaaatctgaatctacccctacttaaaaccttttaagaaaccgcaatttttttcctggatccgtcactattctccttagtttagttatggagctcaaaataagattgaagcaattggagattcgaaattacatgcctaaaatgaattaaatgatccatgggccaagtgtggaactatagacgaaatttataatcataacaaacgataatattagtagaaaaaatgactcaaatcaaatatgaaataacaatattattatgacgtataaaagcatgcataagcatgttgggatccatgtttcttacaactttactattttctaattaatactatatatccatatcctaatccttgcctccaataatgtcattattttcgttaaatacgcttaaacaatgtgatcctcttgatcccaaaacatattttatgtgcaatcaataattagttcattatactcattcctatctttaattattttattatgtaccaaactaaaccacaggtttgaatctttcaatgaaaataaaataaattcttttacatagatggaatcttgagaatttgatagtatatacacatttttattaatgtatttatatataaaaaagaaattatataagtcttttttatttgtctttctaactacttatcctagttctagtttcagcccccattcttttgtgcggttggtaggatgtggagatagtgtagtgcggtgaaattgtggaaaatgcggtaaggtgtgcaatgacatggtaaaatttgtggaaaatcgtggttgatgtgacaagtgaggacagagaatgtgtagaggagaaaaatgcggagaacgaaaagtgaggagagaaaaaagtgatgattgtgataaaatgtggtataatatggtaaattatagaagaatattgagtaatataatgagttgtggtaccactctacaccgcacaaaagaacagggcataagaaggactctttacatagtgatttttaatgttttactatgactaacaagtgatttgaaaatgaccttttaaatcaccataaaattatgcgccttacaatatatttatgataccgtttaaaagctaaactctcgtgtggaactccaaagaaaaggatgggaagtcacctaatgggttccatgaatttgggttgtgaactacaataactttgactccaagaaaagaaataattagggcaataccttaccttatcattcaaataatcaaatctaatctcttctttcattttcattccctctctctaagaaaaaaaaaattaaaattaaaattaaaattaaaataaagaaaggtaggaagccgtgcaatccacgtcccaagatgatgcgtgaatataatactatacaccacacggcaagtcgatggcaggactgtaaaactcacccctcctggaggggcaaaatcggaacacattcgattgcctccccaatcagtaattaggcgttcgttggcatcgatagaacgtcttctctcttctttattaggaagaaagagagaggttgatggggggctgattcattcatacgaaaccaacgaaagaaagcaaagaaaatcccaaatttcttcactttctctctctaacccccccatcctatctctttctctctcctctcaatcacctcaaatcttaatcatccctctctctcgatctctacgctcttcgccgggttggttttcgtccactactttttcttgattatcgttttgtttttgggggtctgttcgttcgattgtttcgttaattgatctggggatttcacgattcagttgttgatgggtcggtaaaggattgatcgaatttcgcaggttagggttagggttagggttagggttagggttttcggttttgtttgattgttgggagtcaattcgtgatgagggttgcttgatttggttgtgggatttgttgacccacctgagaaattgaagaaagggggaaactttggttgttgggtatcggttttttctttgtttgtttgaattaggtacgagttcttgttgaattcgtttgattttctgcagtttgatgtcttttatgttgaattgggtcttcttattccaacatgcatcgatttgacattgtgtattgtgtgtttgttgctgtaaattgcgagattcttgtgtaagattaagaggttctagctttagatccggagaatctttcctccatggcctttggagggtttcttttgggtgatttcttaggcaaagcatgccaataatctcaattgctcttttgtttaagcaataatttcgatttgaggggcattggattatggtgttttcttttgtttaagcatgctgataatctcaattgctctttttgttatcagaatacattggtttgttgtaagttagtcgttatactttgtatgttggtggacatattcattcatcatgggtgctcttttgtgctgcatgacgtgctcctggagtttgtgctctagatggtgtgattatttttgttcgattgtagaggagtatatctcttggtggatgtcatatgtattgagttttgcatgtatatcaatgtgggctttatctttttgtttcccttttgtcgctcagaacccacgaaaaaatggatcacgatgagaccggatgccaagctcctcccgagggaccaatcctgtgtgtcaataactgcggcttcttcgggagcgtggccacgatgaacatgtgctccaagtgctacaaggacgccgtcctcaagcaggagcaagccaagctcgctgcatcctccatcgaaaacatcgtgaacggatcatcgtcatcatcatcgaccacaactgacaaggctcagccagttgcagt

SEQ ID NO: 461 - DNA, 1319 bp, Senna obtusifolia
ctgaggtcaataatatctccattcggtttcttgataggaagacaggtgagcctactatagggaagacaaaacctgaaacaatacttcggcaagttacaaccaagaaagggcaggtctacagtatgcttcagggaaaaagagatgtagagactgtattaactatggggatcatggaagatgttagcattattcctcagccagcagatacaggaaaggttgatttggtgatgaatgtagtggagcgtcctagtggaggattttctgctggtggtgggatatcaagtgggattacaagtggtcctctgtctggactcattggaagttttgcctattctcatagaaatgtttttggacgaaaccagaaactcaatatttccttagagaggggtcagattgactcaatatttcgtataaactacacagacccttggattcaaggagatgataaacgaacatcaagaacaataatggttcagaattcaagaacccctggaacaattgttcatggtaatcagcctgataatagtagcctgaccattagtcgtgtcactgctggtgtagagttcagtcgacctgtcaggccaaagtggagtggaactgcaggacttattttccagcatgcaggggtccgtgatgacaaaggggaacctatcatcaaggacttttatagtagtcctctcactgcaagtggcaatacccatgatgacatgttgcttgcgaaatttgagactgtctatactggttctggcgaccatgggtctcctatgtttgtctttaacatggaacagggaattcctcttttgcccgaatggttgtccttcaataggacaaatgtgcgtgccaggaagggtgttgatataggtcctgttcgctttcttgtaagtctctctggtggtcatgtagtgggaaatttctctccctatgaagcatttgctattggtggaacaaacagtgtgagaggctacgaagaaggtgctgtgggctctggtcggtcttatgtagttggctctggagaaatttctttcccaatgttggggccagtagaaggtgttatattttctgactatggaactgatcttggatcaggcccaactgttcccggtgatcctgccggggcgaggcagaaacccggaagcggatacggatacggatttggcatccgtgtggattcgcctttgggtcctttgcgtcttgaatatgccttcaacgatgcgcaagccaagaggtttcactttggagttggtcatagaaactaggccttttcaatgcttactacccggactgcttgacgagttcctcattgctccacacgtccaatt

SEQ ID NO: 462 - DNA, 630 bp, Senna obtusifolia
gtctcgcaaggggaattggactgaggaaagggtaaagtcctccactcttctctgttcagcatcgttatcattcctttctgggacggatgacaagaagccattgaaaagagcttcgtctcctattctctgttcagcctctttagcattggcggagtccacgagtccagaggggaaggagactccgcagaagggtcactcgtcgtcgagtcgacagaacgaagagagggtgctgatcagtgaggttcttgttagagacaaggatggggaggagcttgagagaaaggaccttgagtttgaggcacttcaggccctcaaagcttgccgacccaactctgctctaactgtgcgtgaggtccaggaagacgtgcatcgaattattaacagtgggtatttctgctcgtgcatgccagttgcagttgatacgcgtgatggtatcagattggtatttcaggtggaagcaaatcaagagttccaagggttggtatgtgaaggagccaatgttcttccagcaaagtttctagaggattcttttcgagatgggtttggtaaaattatcaatattaggcgattggatgaagcaatatcttccatcaatggctggtacatggagcgtggtctttttgctatggt

SEQ ID NO: 463 - DNA, 1653 bp, Sorghum halepense
ttgaatacagattacatatggaacattttgtgcgtgcgtgcacacacacacacacacacacacagtttttatctgtatgcctgtatggaaccttctactcataggtgccaaacccagaagcagggcccaaaattctctgcaaaacaccatagtcttggaatacgaatatctagcaacgaatattttagcagaaacaggatcaatattcttctgtcacattgttgattgttgctattagggcccaaaatgaaagtaaaattatcagcccagttaagcgtctcttacccagtctcattattgggctcacctggctgtgctaatagcacattgggcagcagcagctgctgtttatttctctatagaagaatagtgattgcaggtgtgcttgctgctgctggagcaagctcttctgagcaggcagattgttgctcaaatgagaggatcttgtatggttggaccatcacccaatgatttcctgcggtagcttaacttggcctgcttgctttactctttcactgccctactttcatattgggcccaagtagcaataatgttatagatggatgctgtgactgttcttaatagaatatttgttgagcggtacaatatgctatccttgtaatagctgagtacaacagttgttccgagccccttttgcatagacaatctggagccctgttcttcatgtctgaatagattggcagcttgaaaatcagtaatatgcagagttttttcccccctgagaacttgtatacacagttgtctgcaaatgccatgcattactattcatggtggtcttacactgctactttaatgcacattttacttactctgatctcgtgaatgaacaaatcaaggttttaaatcatcatttgattactttgtattcttgctctgaatgcagtttgggccactggaaggcgtgatctttggtgactatggcagtgatcttggttctggtcctaaagttcctggtaattcatatattgtactctaatgtgatagttatttatttttctaggacacatttgacagaatggaagtctagcacaatggggaatttacttgaaatcattttaccatctatacatattaccttcttttctgttagacagtatacacaattcttacttggaccatctgtggtgattggctcttcaggtgacccagccggagctcgtggaaagccaggcagtggctatggctacggtgttggcgtccgcgtggactccccactgggacctctacggcttgagtacgccttcaatgataagcaagcaagccgattccactttggtgttggctacagaaattaacctgtatattggtcacattcagagtcaaccttgttcttctgagcattttgggctggtagaaactagaaactagtgccatgccttccattttttggcgatgccaaagcaagttttgcttaggtcagatttcattttttgtaacatatagttccttcacttctgtcgagtgttcttcagctagagaaattaaatggacccttactggtagatcatcctacctctgatatctggaaggccctgtagtggaacaggaaggtacgaagaagaaagagggacgaatgctgttgtaatagcattgcacattcctagcgtatttatgcatgtgtatatgtgctct

SEQ ID NO: 464 - DNA, 244 bp, Sorghum halepense
ggcccgaggagcgggtgctgatcagcgaggtcgcggtgcgggggaaggacggggagccgctggagcgggccgagctggaggccgcggccgccgcggcgctgcgcgcgtgccgccccaacgccgcgctcaccgtgcgggaggtgcaggaggacgtgcaccgcatcgtcgagagcggacttttccggtcgtgcatgcccgtcgctgtcgacacccgcgatggcattcgcctcgtcttcgaggtcct

SEQ ID NO: 465 - DNA, 3598 bp, Sorghum halepense
ttacaacaaaactgtgcaattagattttttttatctatatttaatgttttatacatatgtcgaaaaatttgatgaaatgagtaaaaagttttcgggttggaaactaaacaaggccttactacctttattgcctgtcacagagagtcaatttgttagagttgattcaatagtcttttatttttgtcgaaaaaaaagtaatcacatccacaactgaaggaagccgagcaggcacagctagttaccccaccgaagcaatcccactctcacagcctcacttctccctctgccccacgcaaagcacccaaaggcccccacggcccaccgcctcggcgcctcccgctcaaatcctcgccgcgccgcgcggagcgccgtggtgccccagctcgcatgaggtgtgcctcctcgcgcccgcagccatgggagctcagcagagcgtcaacgcagggaaaggtcattgctctttccttttgatttttttgttcgtggctattattgtgcgtgttggtaatttgctggcgtcgctcatctgttcgtggaaatgccgcagccaaggtggatatgcaagtcgacctcacccatatgctgtgcgaggcgctgctgctgccgcccctaaggtgctcggtactttgcctgctagggagccctctaactgatgtgtgctttccctcttggtttttccttgcgtataatcctgacctgctgtttttctgggtggtttcagaagctctggtgtcactttatcgcaaatcgttggaaggtaggcgtgtgtatgttttgcatccactgtaaatttgttcaagtgcaccttgtactttagcatccggtgtttccttgtctctatgcgcatgcctttgatgcctggtgtttagaacatgtctgtcctagcacgttcttgcacatgcccatcaatgtcttgcttgttcacgacttcatgcacgtgcagattcttatactatctgtccatctccataccagatctgtgcatttgggcgtcatgcctatgcatctttctacgagtctgtatgtgtatgtcttcattattgtctgcaattttactactgcattgtgaatctagagtttggtttggcctgcaggatctctctcaaacacccaaacctctttgggagaagtgagaagttggatgtgatattggataaaggaatcaatgactccaatgttgttgttgcctatagacgcccaaggcctgagtggttatcacagcaatcatttgtaattcaggttggcattgcgttttgtatcttggttatccttttatgtttgttatctaaagtaaagctgaacactgaaaacctattgttgttgtaatcttttgactgaatttacactttctcactatcctatgttttgagcaatcagcactcaatgacaccagaagttgctgtccatggattcccggctgataacttcacacgatcagggagcagagggataaaccttagtcgattatcatttggtttggagcttaatgaaccagccacatcaaactggacgtcgggaactagtgttaaatttgaggtgggcctcaacttaatttcaattgattatcattaatttcatgttatacacgttctttatctgttgcctttttcccacagcatatccgtcctattaataatcagggccactccattgccagagaccatgacggctttcctctgacatgcaggtgatgattttttaggggatttctttaaattgcagctgaaagtgctaattatactcttgttaattgtcgtgcagtggtaacctccatgacaacatgatcatcttgaagcaagaatctggttatgcagatgtcaatgacaatagcttcttaaaagtaagttaggcctactttatgatgctatttctaccataatgcctaccttatacagtaactcttattggtaggttaacttccaaatggaacaaggattgccacttgtaccaaagtcactgaccttcaatagagttaaatgtgcagtttcaaaaggcattaagttgggtccgacatttttggttactaggtaatgcctacccctactattcattctctagaaagctcttctctgacagttcatatctctctacctcacagtttgacaggcggatccattgtgggggacatggcaccatatcaagcttttgccataggcggacttggtagtgtccgaggctatggtgagggtgctgttggttcaggaagactatgtctaattgctaactgtgaatatacagttcccttggtatgtcaatgtagacccaatctgttttatggagtttttttggtgcttataatagttggaaaaaacctggtatctatagcaaaggggatggaaactgtgctagagaaagatgaatagacaagcagttgacaccacatatgcaagccatagcacttatttttgactagtcaaatgaagtggcaacttattttagctagttagtttaccgattaacaaatggttaattatgagtttgtggtttcctgatttcggaccttgaggcttcactgatttctgttcgcagattatcatgtgaaacatgtttgaccattctcagtttatcacgtgacatatgtagaagacctttagtgctctgtgttagtaaaaactaatgatctgcttgttctactcataatttcgaatatttcatgttgatcactgaagcgttatgctacaagatctgaatcttgagagttgctgctattacgcgccagcccttgagttgcacactgtttagagcagtaaacaagtgttgattccatttacttcccctcattgatgttgagtggtgtaacatctgcacgttgcactggagttttttttctttgatgattttgttgaatgtgttcacaattctgtaagttatggtggtagtttgcagccacccacaactccactgatcacacagtttaagatatgttcatctccacttttttttagaaaaagaaaaaacttggaagctttcttgaatcctttaagcaagatctgggacggcaaaatttgcagttaaccagaaatcagcaatctgtctctagttggagagaaacaatgatcagtacaattttcaagaaatcagcaccaccaatctagctccagcattttgtataaactagtgttgagaatcttagatatcactaagaattttccaaggaagtgtctaagaattttcaaaaaacagcatcactaagaattttgatatcaccaatcatgattttttcaagaaatcggtgatcactaagaactttccctagtatctttgatattctgtttacctttgatatcaccaatcatgtgaatctttgatattctgtttacctttgtgctgtccaataaatccctatcgagaacagtgatatttgttaacaacgaagtattgaaacatgtttttgtgaaggtgaagcatctggagggttctattttcatggactgtggcagtgacttaggatctgcccgtcatgtccctggtaagggtgttgtgtcctctgcgcatactagttcactaatttctattagtttcaaaaatggacttgaggttcattacttaattgaatacttcgcaagaaagtaacatcataatttcttaagctaagtgc

SEQ ID NO: 466 - DNA, 1589 bp, Sorghum halepense
cctccatgtatatagaacatggaagagttactaactttaaattttacatcgttcctctctaggattgagtagccttctctctaacactgctgccaattaacagcatatagtaccatttgtgggaaaatgccacctcaaaaacaaagtgacaagtttttgcgaacaaaaaccaatttgctaaacatatattctgatttctgaacttgtaatatgtctaaaataaaatcactatgttacaacttattagctcttagcctcctacctctttatatgcacataatctaaacttactcaatggattgcagctttgcatattcacatcggaatgtttttgggaggaacaagaaattaaatctctctttggaaagggggcaaatcgattcgatatttagattgaactttactgacccttggattgatggcgacaataagagaacctccagaactgttatggttcaggtatttacctttaatatgacaacgctttccagttctgctagttaggaccatgcatatgtttatagctatttcttgtaccagaactctaggactcctggaacacttgtccatggtggtgatcatcctgaccatgggcccataacaattggacgtgttactgctggcttggaatacagtcgaccattcagacccaagtggagtgggacacttggcttaatttttcaggtaaatattctgctgcttatgcttttaggaatagccatgcggtatggtaacgttttgtgtctgcacagcatgctggtgctcgtgatgataaagggagtccggtcataagggatttctataacagccaattaactgccaggtctctgttctcattgtcttatttccttagtttcacatgaaagattctcacacagtcagtataattgttaagatttccacctcatgtttttcttgttgcattgcagtggacatgattatgatgatactctgctagctaagtttgaaagtgtctacacagattctggagaccatagctccacaatggttggcacgaatgcttcttccttacccaacttggcaatttttgtagccatcgttgcttatctcctgctatcactgttccttgtagtttgttttcaacattgagcaaggtctccctgttcttcctgagtggcttagcttcaacagagtgacagcacgtttgaggcagggatatgaaattggtccagctaggcttcttctaaggtttgttttaatcacattcttgtactggacctgtagcaaaaaatatcatgaactgaatgccctgcatatgaacttgcactgacagtttttccagttctgttacattataatctctttgtttgatgatgtagtgcttctggaggtcatgtggagggaaattttccacctcatgaagcatttgctattggtgggactaatagtgtaagaggatatgaagaaggtgctgttggctctgggcgttcttatgccgttggtagtggtgaagtttcatgccgcctggtaaacttctttctcccgaccttactgtctttttgtcgttgtcaaatggaccacatggaagtacgacagacacaactgtgtggtaatttaccacagaacgc

SEQ ID NO: 467 - DNA, 2447 bp, Sorghum halepense
atggcatggaacaacatggttgagagaaacaggagttttccataggaagaggagaaggtaggtggcattggtagccctgaggtgtgggagatgatacatgttcgggcagatgtgattgcgacctcatgatcaaattgtatatatcttaacaatgtcaaatatgtgggcactgagcatgcagtataggagttgttggttattcattgtttatagagatacattgataaatgacaaatcacaatgattccttggattggatacaggtttcatatgctgagatactttctggaggggttctgaggctgcaggtttcagaagctgaggttaataacattagcattcgcttcctagacaggaagacgtgagaacctatattttctctgagatttcttgatcaaacactgttttaaagtgcttaaatttctatgtttcttatgtttttcatccttctgtttcctttgcttgtggtagtggtgaaccaactcttggaaaaacacagccagaaaccatccttcggcagcttaccaccaagaaagggcaggtcagagcgcattttcagaagtgcctttctcaatctgtctatttatgttttatatacctcagggggactattgatgatatgctgaaatgcaaatatcatctttcagtcatgttctagatgttgcatgaaatgctaacccttccaacttcacattcgtgctgtgttgcatcattcatgcactgaaatttctatgcaaaggctaataccagaatcaccagcgctggttacaatataggcatataagtttgattggagacttggagcctgtatagcgtataaccaagtccctcttttctttctttatgattgtgtatattctgtcatttccacagtaatatttggactcaaactgggtgctttggacttaaaacattatgaaaggggcactgcagccttctgaaccaaataatattagcaatcatctaaaaattaccatgtcataatagtatatagattttacctttttatccatgtcctgttgtcttatgctctaccattaatgttgcctgttaaaacttcaaattgatcttgtctatttaaaattaaacaggcttacaatagggcacaggtgaaaagggacgtagaaacaattcttactatgggaatcatggaggatgttacaataattccacagccagttggaggtgaagctatctttaagttctgtcattgtttttgaagtagatctgatctcttatgagtgctaatattcatgtgctttgtaatcgtctgcagattctaataaagtggaccttgtcatgaatcttgttgaacgcccttcgggtggtttctctgctggtggtggaatttcaagtgggtgagtacgaacaatgctttgtcaactgagctcagtttagcgattgcataaatgggtgtatccagtgactttatgctttaagaaattcttttctgagtcactagtgctggggatgtgctgtctttttcctcttttaacctccaaagttgtagcacatgtgcaaagtacagtcgaactgttattcttctgctgattatatgccattatgtttttctgcaggataacaaatggacccctttctggacttattggcaggtcagtatgttattctttcacaggttaagtggttaagatgtatgtatatacatctactctttttctgcttctggtgctattttcgctagttagtttctactctctgcataggctcaatgtcatcatgattcatcaaagattcccagggaagttttccttggctgactattgtttgtgttggttttaaaaaagtggcactgtgctcaaactagggcctatgttcgagagggcatattgtgctccaaatccttgggactaaattcaaatctgaacaaagttggatagtccttaatattcctggagttatgtccctcttccaaacaggccaccaatgggctttggctcttatctcgttcggcttaatgttatcaagaatcctcattatctaaggttcttataaatgtttggagggctcgatggactcttatgggctatgattatcatcataattgtcctgtagccaccagattcagagcagcttaagctataagcttatcctctaaagcccaaatctttcgggttcaagaaaagttagcactttttattttagaatctgtcaattattgtgataaactcatggtgtgtaattgtatagatagctgactatttttaattcaaatatgtaatagatcttgtttgacatcagatgcgttaactttaaaccccaggccatctgtttactagttcgctagccacatgtgcccacttaacatattcctttcttaaaggtttaccaagacttatagcatttggacattggaatctgtttgttagttggcttgaaacttcagtggaaatctattcttaaactgacagcttatgattataataata

SEQ ID NO: 468 - DNA, 8404 bp, Spirodela polyrrhiza
ggtctcgaggtgttcattgtcgccgtcgctcggattcggaggagatggcagcgtcgtcccgcagaacttgtgcttctgcctggagaggggcgaagcggccgtgccgctccctttcgcgtcgcggctccctttcgcccgtcagaatattagcttccatctgcagagagccagagacttggttcaccggttcgtctcctcggttccatttccacgcggcattggctgtgctatccctttgtctttcctccgttctcctctctcggcggggcaggcacgggcggagcccgagccgcctggcaattaccctcgacgccacggaaaggaggatgaagagaggatcctcatcagcgaggtcttaatacggaacaaggacggtgacgagctcgaaagggaagacctcgctgcggaagcagcggcagcgctaaagtcatgccgtccaaactcagcgctcactttgcgcgaagtgcaagaggacgtgcataggatcattgagagcggatacttcttctcttgcatgcctgtggccgttgacacaagggacggcatccggcttgtttttcaagtacatcgctatcccacctcaaattttggtcgatgtcaaagaaatttcttcaacgccaatgccttctccgtataatgcttcttatgggcatgatccaatgcacagtcatgtttatttgcttaactgctaactggatatttatttattctaattacaattaagcttgttcttttgagtggggagacgggtttttgtaaaaatgtgagagtagaaacgtgccgaccgaacttctttgtgacggttgtccagtgggtcatataaaattagcaagcgctgactttccttctggttgcgttacgaccatgtgtacttcccgttgtagcatcttgtcactggtttatacagtaggcaaaggttcatgggtataccctttgactgacattgacaactgacccttgggacagcagaaccagctcacatagcagaagagttttccctctccctacgcatttttaagcgtgttggtggacttctttttatgttttctatgatcataaaatgtagatcggtatgggttttatgaagtggttgcctccaggtgaatctaaagatacaagtcttttggcactctcggttatgtttctagtagctgtgccttaacttcatgggtacaatttaagttagcaatcaaaaaattttgtatgtttcgttcgaattattgcctcattacattaggaaacttagtatagtttagtcttagaatttattccttctttgctgaggaggtctgaatttaccatagctacttgcccattcttctttgattatcttaatagatcttttttgcctctccattttttacatgactttgtttgacttggtacaaggtagaacctaatcaagagtttcaaggattagtatgtgagggagcaagtgtgctaccttcaaagttcttggaggatgcatttcgtgatggatatggtaggttatgtagcgttttgccgtaaattataaccttttttgtttccttggtttttatatgcattagaaaacattgacttgtttactatgtgagaggttttatttgattgaagtttttgatgttaagttatgcaggaaaagtggtcaatgtgcggcatctaaatgatgttgtcaattctgtgaatggatggtacgcagagaatgggctttttggtttggtcagtgcttgctcaactctgaaattttttggaatgagaagatgcttgtataaactaagttttttgtcataaatggctgtccagtgatgtatttgcatcttatttttgacttgtttcgatttttataggtgtcaggtgtggagatcctttcaggtgggattatcagactgaaaatctcagaagctgtggtcaatgacatcacgttgagatttcttgacagaaaaacgtgagtatatttcccttcattgatatgtcgcttaaaaatgttgtaaaacatagctgaaatggtcgaggcactggatgttgattgctctttggacactgctagcggtgaacctaccactgggaagacaaagactgagactgtgcttcgacagctgactacgaaaaaaggacaggtacaagctgaaactgcccccatcctctattgttcctttccttctgattactatctctgtagttactttcttttgtgttggtgtgtatttatttaaagaggggtaagtgacgtaatattatgtatcatataactgttttttggaaggtaagtgtatttatcactgtctgtcttttttgctctttatgacccactgtcttattgaggaaatggtggcgtgttcgtggattaaaacaaagaactatcttttgaagaagaaataagcacttaaagttttatgaatttccaccgttaatggcgtataacttcgctagctgttatctgttactatgccacagttacccagtttacattttctagcttattctttcgtcctctgatcttctatctgagactgttggaacttgatgaatgctgttagagaatttcgaatttgacatttatcgctggattgacaattttccagtttctttctccattctttgaattgcaatgcaggtttacagtttgcttcaaggaaaaagagatgctgagacaatattaactatgggaatcatggaagattgcagtattattccccagcctgctggaggtaaaactttttaaatggaactctttttagttgcggaacccttttatcgatacagattttaaatcatgttattcagtgtaattctttggtttttgtgcttgagtataaatctttgacttcgtgctagaaacatccaagggatctatttgctgaccttattatactgatgatgatctggatcatattttaagaaaatggtttcgggtctttgaataattaattaatcgtgaataattattaattaaataattaatagcagaataaggaaaattcattatcatgtggggattccacgtaacttgatatagtggaaaataataagaaaaatgatctaagagcatcctgaaaataagagagaaaagagagggtcaacttgcccagtgttgagttgcacctgcagcttgcatcagggttgctatttgataattatgttgggcagggggttcagaagtttatattttttgtcccacacaactggtgcagggattagaggcccgtgtcgcagtttgtgtgctaatgcaggtcatttgctacaccagaggcgttcaggagaagtatttccatacttttgtatagcttgtgggaactcaagcgactgcatccttatgtaaacgttttgtttacagaataaatcagtgtgttcttccacgagatgttcatatttaggaagattaaaagttaggcattttttccaaaaaaatttcgccaaatcattctatttttcctttctcttgcacatctatgattggtgtggcgaatattttcggaaatgataatgagacttgtggtgtaagcggctacatctcccaacaactccgaatggtggccgttgtgagctggattagagttatgactttactgatgctagggaagttgtggtggctgtaaatgccttggaccatttggccgctgtccttgcacataaatttgctcattagtcaaaaacgtttttttctcgttgattaattgcttgtatctttgctcttccatttttctgtgatgcttaaggcagttactttgtcatcgtagatactggaaaggttgatgttataatgaatcttgttgaaagaccgaatggaggtctatcggctggtggtgggatctccagtgggtatgtgttcttatagcatcatttgatcgcattaaaatgcatgtctgtgcatgtgagcatcaattggcaggcacggtttgccatattcatacttggtctcaaatgtgcaggataactggtggccctctatcaggattgattgggaggtaaaactccaagatatgctttgcttcggtcaccttactattgtgacattcgttttccttcatattttgttgtgtgcatagtactttttcataattgctgcggaggaacttaagttgttttcatactatatgattctaatctgtctttacattgagcacataacttccaaaatagtgtgccatacttttggcccttttctttgtggcttcctgttgatttcatctgtgtcatcaatgaaatagtggtattacctaccaccctttaaaagaaaaggaagttttatgtgaaaacttctgcaaaacgaagagttgtttggaagagattttctttattttttagagctgagtagttgctgaattcggtgtgaagtctactacaaagttgaagtctactacaagtgcatagttggaaaatacacgcaaagtaccatgcagacttacattggccgtgacaggaggtttatgtcctatttaagccatattacactgaaattgtgtaggcagatgtttacaaggtctcctcctccatgccgaagataatagaaatctcttggtcaggtttccctaagtgattgcttcgttttgtttcaatcgctaagtgttctgagaattccctgatgtattcgcataaagggccagttttcacttgtgttgctttgtacgcaaaacatggggtgcttattagtgactgcttttgacaatccattcgtgttgtctattttgattgtggaacgtatcattttccatcaagttgaaggggttcaatggcattgggtggccctcatcctctccccttaattgtgctccccaccttatttccctgttttatctttgttccccattcactatattgtatgcgtaggcattcgagattgataatgcttaaatgattagagggaaaaagaggatgaaaaaaatgatgattcagcctagatcaccactatgaaatgttcattcttttcttttccttctttggggggtttgtgtctcttcctttgtttttttccttctcatttctccttttgtattttttttagtgttgtcttatcattggccttcactgtttgaccattgggtgcatatgtggcccggcattacggtgcagtgcagccctgcaagttatctagtgttgctggcaaatgtgtcatgaccggcctgtgctctcatcatgtcacagtggccggtgccaaactgctgcagtagtcatcttcactgtctccgatgcattaattatcatttgtgatagaattgatcttgtacacataagataacatatgcaatattcttcaacaagtctattgctgatacttagcatctcaaaggtgatcaacgttgtacatgggaagtaaggttgtgcttcattgcgttggtcacatgctggttctataaaaagaaaaaatgaaatgacatggaagcaaccaaagttcagggactggtattcctggttgagctgggttgttttcctgatgccaaaagatcgaagtcttctggtttgatgacatgttgattagattgtttaattgactgataatctttatgagtgtatgcacttccgtaacccactttttcaattggactaatttaggtgagatttatggaacgaaatatgagcaacttgcctcaccttacactgataagttgatgggtatacctcgacataatctgcttacactttgtccccagcattgcatattctcaccgaaacctgtttgggcggaaccaaaaggtcaacttttcaatggagaagggacaaattgactcgataattcgcatgaattatacggatccttggattgaaggagatgataagcgaacgtctaggtcaatcatggttcaggtgtttgaagagttcttgctatcagtctgctcaatttgtgcgttgatgcatctctgtgagacatctttcttgttgtggagcagacttcgacgactcctgggacacttgtgcatggtaatggtcagtctgatcatgctaatgtgacaattggacgagccacagctggcattgagttcggtcgacctctgagacctaaatggagtggaacagctgggattttatttcaggtatttctcttaatccgctgtttactttgtcctgctggattcctgatatccgtgtttgactggcgatagataatttatctgcgaattggattagtgataccaaaattttagaaaatctccatcatcatcttactttatcggcattttgagacaaggcacattccatgctcttatatgattttcttgtcgtaatatgtgagaataagagtaaagttgtaaagcaatcaaagttcgaagaacaatctaaacttttggtttgtgtaaaaatcatgcaaatgaaatattattttcctcgaatcttatctacttttccgctcattcatttgtactttccccattccccagaccacagtcggcccacaaccagaaaccctccaagttgaaccgcttgtagaattaaagtggctcactgcaaccttttgacgtagcactggtagtgatccgaagcctggatgcctttaatccgtcaattgcgaataaagttttctctccaaatactccatcctcttgaaatcgaccgtctcctaatttgatcggatcctgtcagaaccatgcgagcggcatgagttcaattgatctgtctttgtgccagtatttacgctactgaaaggtgaaaaaaaatacccaatagatgaaaaatctaccccagttttatatttcagatacaaggttctaaatatgtttccttgaaacgtgggtagctttctgttgacctaagtggaagaatcgcactcacctcaatgggtcagagttctttctccatgaccacatgaccggtggaatgatgtttatgagtgacagccaggtcctctgattgaccactggaagggatttctctgatgtagtagaggtagcattttgacttttataaagattaccccgaatctttctggtcaactaccgcaatttgacatctgggcttggatatcagcgtaagcccaatttcctacgatccttggctcactctgggtcggctgtgggatggccccaccccaagtggtggtccaacgctgcatctagtgactataagtatagtgggtggagtgtccctgtcttgcagtgcgtatcacagaacttgttggggttgactctgtgccattcactctgcaaccggtcatacagtgtctcacggtacctgatgaattccacctaggaagatatgccctatctgccctcttctaatagactagcccgaatacttattgatgttatccagatccgtatcatatctgatgtaaaatgccaagaattccgtaaaggtcaacggtgagcagtagccgataaggtttgacttcctaaaatccggggagttaatatttttcagttttttgaaattaattctgcgcgagtatctgtggttttctcttcagcatgccggtgcccgtgatgaccgaggcgatccgatgatcaaggacttctacagtagcccattaactgccaggtatcttaccccattgccgggatatgaagaccatccatatgcttgctccgacctccatccccttttttttttttttttttccctctcatgcgccagcttagattataaatatataacagcatagtgtttctttgtttcttctgtggcttcaagtggcaacaattatgacgacatgctgatagccaagcttgaaagcgtgtatagcggttctggggaccatggctcgccgatggtcagctctctcatcctgagcttccaatcatggcgtcatctccactgtttccccgttgacttgaggcttctggttggtgtatgcccacagttcgtcttttgcattgagcaagggctaccggtctttcccgattggctgtgcttcaaccgagtcaacgctcgcgccaggaagggtgtagaaatcggcccgactcgcctcctgttgaggtacgaccttttattgccttcccccgttgactccgaacgagggcaggcttttatgtatcatttccaaatgtaggagttgacttttgtctctcattcatggcgagtgaggccgggagagtggggcctcctccgccccaccgcctgcagtataaatggaatgttcttcctcccgctcttctccaccgtcttcgagagttcatctccgctcttgcagtctctccggggggcacgtcgttgggagcttctccccgcacgaggcgttcgccatcggcggcaccaacagcgtcagaggctacgaagaaggcgccgtgggctccgggcgctcctacgtggtcggcagcgcagagatgtccttctcaatggtgggtcaaactgctcgcgcgtctccgtttcccgcctcactcccgagattctctgcgtcaactcatctcaccgttgacttctcagttcggaccggtggacggggtggtgtttgcggactacggaacggatctcggctcgggcccgacggtac

SEQ ID NO: 469 - DNA, 1651 bp, Spirodela polyrrhiza
ctctagagctggtttatctgcggcaattaaatgggttgtgctgaccaggtgatccagccggggctcgggggaagcccgggaccgggtacgggtacggggcggggatccgcattgactcgccgttgggcccgctgcggctcgagtacgccctcaacgaccgccgggccgccaggttccacttcggcgtcgggcaccggagctaagtattgggcctgggcctgggcttatttccagcgtggtctggtgggcccggcccggtccggtccccaggaaagtcaaaagataccgaggaagccggtgggtcgaagaggagtaaaagcagctctagaaacccgcccgtccgtgtaccgtgagcgggggcgtcgcgcgttactgttggtgattatcatcaccgcctgtgttggcgtactccacccgcatatcttgtctctggatccagagatagagagagagagagagtcgtacttctcgtcaagtccacgtggtggcggcgataaaggagggacggagagggggggggctgacagtgacgtcgcgccagcgtggaaacagttcggtagtcgccgtccattaatgtccttctgctcatccgatgggacgcgtctccattcctcatggcgatgcacacgggggctctagagagagagagagagagaggggcatcctgcagatgccgcaggccacttggaaaattacagtgaaagagatctcgagcagtgagtcggagggctcctccccctcccccccgggcagagatggagatgggcactgtagcacgcggtgcaaccaagtggaagggccctcgccggcgctggctggagggaagcttgaagctcgactctctagaagagcccacatggtgaactccatccatgtgggacctctgagctgactaatcctcgtctgcttatgagtaggaggataagaaggccgggtaactcggttggatcgtacgcgcgtttaattccatacatggtcaactgtaaaaagaagggtttagggagggagaatttgatccctgtgattgacccacggcgagctccggaggtctgtggatgggtcgtcctcctcctggaaccctagaattctttgacggggcccgccggcgctttcgggaaacatgcaggaacgagagagcacggcatctacagctacttgggatctcgattttggagagcatagtcgaatgacgagatcgaaatctgagcccggaaaccatggcggtcttctttggaacagcggcgttgacggctcgattgttcttgccaccggccagacgaacgggagaaaggacccggatctcggccggatccctcttacagagatgacgagaggatttgggctaccagggcacgtcgatctgggtcgggagcccgagttttgacttgagtgctcgcatctgcaagttggatgtggcgactgttacggaatcttgctgccggggcttcgactagacttttcagctacctctgaagcttctaacttgtggatcatctgccctcgaaaccctaaaacgtactttaggagcccttaacacgcttcccacgtcggcatcacgtgagaaagcgattgtggtgacgtgagtttgaagatagaacagatagctcctctctctaaatctctctaaatctctctcggtctctctctctct

SEQ ID NO: 470 - DNA, 254 bp, Taraxacum officinale
tactgtttaactgatcttttgttaagttatgcaggaaaaattgtgaacataagacgattagaccaagttataagctccatcaatgggtggtatatggagcgtggcctttttggtttggtttgcatctaatccccttgtcatttttttctcaaaaaaacatattatatatattaaaaaaatggtagattacattaacaatgtttattttattgaaatgatcaggtttctggaatggagatactttctggaggaat

SEQ ID NO: 471 - DNA, 274 bp, Taraxacum officinale
aaaatttcatttttgttatattttgtaagctatttattaactaattaaatggtgttttatgtttgtgattcagaattcaaaaacccctggtactcttgtacatggcaatcaaccaaacaacactaatctaacgattggaagagtgacagctggcattgaatacagccgaccttttagaccaaaatggagtgggacagcagggcttatttttcaggggcttcctgtatggtcggattggctggtttttaacagagttactggtcgtgcaagaaaa

SEQ ID NO: 472 - DNA, 812 bp, Taraxacum officinale
aggtggggccggtagaaggagccatgtttgctgactatggaactgatcttgggtcgggcacaaccgtacctggtaaaattccttctcttttttgttcgaaatacaaaataaaaaataaataccatcaaatcataaattaaaataagcataaaacttatgttttagttatttttaaatattgtgtatggaaggggacccggcgggggcgaggctaaagccgggaagtggatacggatacggaggcggaatacgtgtagcctctcctttaggccctcttagacttgagtatgctttcaatgatcaaggaacaggcaggtttcactttggagttggtcaacgcaactgactttattttttttattttacttttttctttatttatttattttttttcaaaagttttgattatgttatgtggatggtgaaaatttgtctaaagatatgaatatatagtaatgtttttatgttttcgagatatttttaaggaccattgttttagttcttcaaagaaaatacataaaaggagggcacacgtgagtttggatctcttacacacgtgcttgtgatccttgagttgttggtttgctcaatgttacgtagaacaatgtgtttggtgtctcctaagttcattgaagctatgccttttagttatgttggtgattggttccgattgtaaaccttcaaattataaaagttgtcaacattattgatatattaggccactagttgtaagactcgactggttgaataaaacaaaatattaaatacgaatgtgtaattgagaaaatttgtttgaaattaaagtttgaaat

SEQ ID NO: 473 - DNA, 641 bp, Taraxacum officinale
atagcagcccactaacagcaaggtgtgtaaatcttgttccttgtgtttcctatttaggcaacatacttttgcataaataaaaaacttaaatcttatatttatatatttgatgtagtgggaatatacacgatgacatggtacttgccaaacttgaaagtgtttatactggttctagtgaccccagttcttcaatggtaataacacataacaaacattttttaatatttttctactaattttattacgaaagtaccctcacaacattttttgcagttagtagtaaatatggagcaggggcttcctgtatggtcagattggctggtttttaatagagttactggtcgtgcaagaaaaggccttgtaattggccctgcttgctttaatttaaggtattacttacaaaaaatatatatatatttttttgttaaaaaaagaaaaagaaagtttggtcatttaatttggtgtgaaatattgaatatacagtgtatgtggtggacatgttgtgggaaactttcctccccatgaagcatttccgattggtggaacaaacagtgtgagagggtatgaagaaggagcaattggatcagggagatcttatgctgttggctgtggagaagtttctttccctttggtaaatcatt

SEQ ID NO: 474 - DNA, 256 bp, Taraxacum officinale
gtttggtttgcatctaatccccttatcattttttctcaaaaaaacatattaaatatgttaaaaaacaatggataaaatgattaggtttctggaatggagatactttctggaggaatactcaggctgcaagtgtcagaagcagaagtcaacaatatatccgtacgttttataagtagaacgtaagatctctattttgctaattataaaaaaaagttttaatttataaaatgttttgatattaacatctatttattgg

SEQ ID NO: 475 - DNA, 624 bp, Taraxacum officinale
ggttcaaaccggtttcaaaacactgcttgtaagtaacatctacatccttacattctatacgttagtggcccttaaaattgataggatattatatagtaggtttactaattagctcttaaaattgataggatcacaagtagcccattagcaggacttattggaaggtaatatattatttacattgtgtgaatattaaaattatagaattaatatttaatttttggacactgaagctgtgcatagatccatggactgaagcagatgataaacaggcatcaagaacaataatggttcaggtaactatttaaaattttgattttgtttattttgtacgttatttattaactgagtggtgtatcatgtttatgattcagaattcaggtatccctggtacacttgttcatggcaatcaaccaaacaacactaatctaacagtttgttgtttttttaatatgtattaagttttgtaaattatgcagtttttatgtgtatttacttaaaatatggatacaaggaaacaaagcggcggttgtgaagccttaggctatggggagtggttagcacattgaggatgtgctaacacacgccacgtaggcttttttaggcttagcatttccttagcat

SEQ ID NO: 476 - DNA, 264 bp, Trifolium repens
gtataattgaagtttagataatcggttttctgatgatatttgaattgaatttcagtatatttgatttgcattgaaatttaatattatagtgttgcatgttgttagtgatgataattgaatatgttatgtgagtactggtttcttgtggtataaggtagaaccaaaccaagagtttcaagggttggtatgtgaaggagctaatgttattccggctaagtttttagagaactcttttcgagatggatatggtaataatttgttcct

SEQ ID NO: 477 - DNA, 393 bp, Trifolium repens
tcaatttttccttgtagtggcaatacccatgacgatacgttgcttgctaaaattgagactgtttacactggttctggtgaacacgggtcttctatggttcgttatgaactgaattcagtccttcaatttaaatatgtaaatgtttcttaccattatttgcttggttttgcagtttgtcctaaatgtggaacaggggcttcctcttttgcttgattggttatccttcacaagggtgaatgcacgggctaggaagggtgttcagattggtcccactcgtcttaatttaaggtatgaagtacatgtattcaacccccttctcttggaaggaaggagtaaccagtgcattgttgttcaccctttatattaattcaaaacacaatcttatgtttttcc

SEQ ID NO: 478 - DNA, 1474 bp, Trifolium repens
aatcaagataaaacatgataatttcatatttatctaatctaagttttaaagctgattgtggcattttttttatcaaattgggttgttgacaacataatatagtctattcaatggaaattgatatagttcaccaaagggaaagtatccgatatttctttattctctcttataattcaccaaagggaaagtatccaatatttctttattctctcttttatgaaacacacctccctggttttgcacagtaactgagtaggatttttggcatcatctgtaattgtattttcaggtatacagcatgcatcagggaaaaagagatgtagaaactgtattaacgatggggatcatggaagatgttagcattattccccaaccagcaggtaatttatacatgcagaaaatgggctttaatttaaggtgaataattgtaacaaagaaacactgtcagttctaactgttttctgctaactacacttgccaagttgtaatgcaatttcttattggaccttctatgttcagcattttactgcgctaactcctgccaaaagagacttcagtccagtttgtattagcttttagcttgtgggatcatttcaattaatgtaactacataatatttcacttactcaaaaaaatttataaacttataggtttatagataaagtgtcagagatagcttatggaaaatgaaaaagtttaatcttatttcaacctctacaagaagctactgtttaaaaattcagtgttataacgaaattattatacttttttcatatatgttttggagaagaatcattaagaaaaaaggagaattattcatgataatttaatgagaaactaaggaactgacgttaatgaaaatgtaaggccaggccgaaagaaaagaaaaaagaaacatggacattattcactatgaaaatataagtagcttgcttttgtagagtgttagtgctaaacaggactttattaggttgcagaagtggcccaattattttcttgttctgcttgtgtattgttatcctgtaatggacacaatattttctactattagatccacaacactctctaaagtataaattttgctgttatagatacggggaaggttgatttagtgatgaatgtggtggaacgtcccagtggaggattttctgctggtggtgggatatcaagtgggtaagtgatgcaagtctaaagcatgcttaaataatgtttaaatttactaaatgcataaattaccttgacctccttgacatttattaactactctagcttctcctgtaatttcggaagttattgtaaacttccttacttttaatttcttcaagacaactgccccttcataagtttcgacatataccaactctgtatggttcatattggtggaaaatataagtagaagggtatacttgatacatatcattaaactagagcggaaatcaacacaattttttcttttggttactgtataatctga

SEQ ID NO: 479 - DNA, 503 bp, Trifolium repens
tggatatggtaataatttgttccttttttccttacgtgtgcaattgtagtcgtctacttggtgttcgcgtgtaacattcgctgtttacaaatttacttgtgctgtgcagggaaggttatcaatttgaggcgattggatgaagctatatcttccattaataattggtatatggagcgtggtctttttgccatggtaaattccccttaaattctgttcgaatttcgtaatatagccttgctttgtgatcggtggaaattcagaattcaggttgatttttcatgttttcagtagtcttagcagcaaagtatcatcatattatgctctaattagtttacattggtaatttgacctttttttcaatttcccctggccttgatctccacgttaggtatcagctgttgagattctatctgggggtattttgaggttacaagtttcagaggccgaggtcaataatatttccattcggtttcttgacaggaagacgtaaggaccttctttca

SEQ ID NO: 480 - DNA, 338 bp, Trifolium repens
agtgattttctttaccaacttgattttatatgtaggggtgagactacggtcgggaagacaaaacctgaaacaatacttcggcaaattacaaccaagaaggggcaggtagttttatgacctagcaccggatattccaacaatgattgttcatagtttgttatatagcttttggaaatttaatgaagaattggtgtacttttaatttttgagcaaaactgcaaatcaagctaaaacacgataatttcgtatttatctaatctaagttttaaagctgattgtggcattatttatttatttattttttatcaaatttggttgtttacaacattataatatag

SEQ ID NO: 481 - DNA, 222 bp, Trifolium repens
aatagtagcctgaccattggccgcaccacaggtggcatagagttgagtcgacccatcaggccaaagtggagtggaacagcaggactgattttccaggtgctttattaactgttttggtggatgtttttttgtctgaagctgtaacatatttttatttctaattttagtctttccacgctacctctatcaatacctcttgtgaattatagattttcctagtgt

SEQ ID NO: 482 - DNA, 1224 bp, Trifolium repens
gttctgtccgtggattggttcctcttctgcgcatgttgccagtctttgagtgcataattatagctcgtcgaataacatcgaaaatggttgggacaataatttgtatttttgtttgaccttcagtttgtcgcatcacttctttatttttcaaccgaagaaatgcactcgtttttttaactggatttttcctactaatttttagtttcttatgtttccctataagtttatcgcgctccctatttttactcatccactacttaaataacggatgtcataaaatgagaaatttgagaaaaaagcaccgtccactacttaaatagcggatagtgtctgagaaatttgtagggcggaaaaagaatatctcactaagtttttcaaaattagttaatttcggttcgtacaatccaaaacactcttggggataatttggtcagaatgggggcctgagagcaatataggggccagaagagcaattttctcaggatatacgctatcaaaagcccagcccatattacatttaacacaagaaataacaacaggcccacttttctctgacactgaaaaacctcgtcggagaaccggaggaatcaacggcagtaaccaccgcactgcacttcactcacttcccattcaaattctgtatctacgaaacgacacacaaattccgctacaatgcctcgaaacgacgatatccgcttcatctcttcttcgatcaaaatccctcttccttcaaaaccaaaacccctaaacactcctttcaaaaccgcaatttctcacttcaccaacgcaactaactcgttttctcagttcgttaactcgttcagaactcactccactgagttaactcgtaccgtgttccgaaaatcgcactctctatgctccgccacgttatccctaaccgacgagaagaaagtaccgtcgcctctttctacggcggaggaatctcagttgaaaactcgacagaatgaagagagagttttaatcagtgaagtattggttcgaaataaagacggcgaagaactcgagaggaaggaccttgaagcagaagcggctcaagctctcaaagcttgtcgacctaattcagcgctaacggttcgcgaggtacaagacgatgttcatcgcattatcaatagtggatacttttgttcttgtgttccggttgcagttgatacgcgtgacggtattcgattggtatttcaggtataattgaagtttagataatcg

SEQ ID NO: 483 - DNA, 545 bp, Trifolium repens
acttcatttggttcacttccagtctctccggtggtcatgtggtaggaaatttctctccctatgaagcttttgccattggtggaacaaatagtgtgagaggctatgaagaaggtggtgtgggctctggtcgatcgtatgttgttggatccggagaaatttctttccctatggtacttgaattttatcaagtcttttcctgctcaattagtttagctttttgtgtgtccttattaatactaattttcaagacatgcacctgaacctagctgtatctgaaatttgttgttgaattgtgtaattttcaagacatgcacccaagaataaaatccttatttgcaaagcccaaaaccaaatacatacactgccaacttataacagtagtggtggttggtttattatcaaagaataaaataatactacattcttatgaataagaatgtgtatctaataaataaagggataaaagggcaacttggtactataaagctcctaccatatgggacaagggttggatcaattgcggaactatagaaggcaatgtcacc

SEQ ID NO: 484 - DNA, 295 bp, Trifolium repens
atcctggtccttaatgaggcatatattatatggggcatttggttttttattaggtgaccctgctggagcaaggaataagcctggaagcggatacgggtacggtttgggcatccgtgtagattcgcctttgggtcctttgcgtcttgaatatgccttcaatgacaagaacgagaggaggtttcactttggagttggctatagaaactaaacattctctcaaggtatcactttgcgtcttgtataattctttctttcttttttggtttgtatcggaaaactagtaaatatattttct

SEQ ID NO: 485 - DNA, 1304 bp, Xanthium strumarium
atacgaaaaaggggcaggtgtatagcatgcttcaagcaaaaagagatgtagatacattgctagcaatgggtattatggaggacgttagcattgttccccagcctgctggagactctgggaaagtggacttgacaattaatgcagttgaacgtgtaagtggaggcatatcggctggtggtggaatttcaagtgggattacaagcggccctttagcaggactaatcgggagttgtgcactttatcatcgaaacctctttgggaggaaccaaaagattaatctttcattagagagggggcaaatcgactcaatcttccgtatcaactatactgatccatggattgaaggagatgataaacggacagcaagaacaataatgatacaggcacctatccaattttgaatatgattttggctgtgattcatgatatttttattaaagaactccaggacacctgggactcttgttcacgggcctcatggaaatcaacccaacaacagtagcccgacaatcacacggattacttctgccattgaatacaaacggccatttagaccaaagtggagtgggactgcagggcttgtttttcagcgtgctggtgctcgtgatgagaaagggaaccctatgatacgagacttccataactgcccactaactgcaagtggcaataatcatgatgatatggtactagctaaagttgaaagtgtttatactggttctagtgacctgagctcttcaatgtttgtagttacaatggagcagggacttcctgtatggtcagagtggttagttttcaatagagttactgtacgtgcacgaaaaggacttgtggttggccctgctctcttaaatttaagtttatcaggtggtcatgttgtgggtaactttcctccccatgaagcattccccattggcggaacaaacagcgttagaggttatgaagaaggggatattgggtctggaagatcttacggtgttggttgtggagaaatatctttccctctggtagggccagtagaaggagttatgtttgccgactatggaactgatcttggatcaggcccaaccgttcctggtgatccggctggtccaaggtcaaagcccggaagtggatacggttatggagttggtgtgcgtgttgcctcacctttagggcctcttagactcgagtatgctttcagtgacaagggtaaaggaaggtttcactttggagttggccaacaaaattgagttcatctgaatctaaataaagatttttccctctaaattttgatcatattattccctttttgcatcatgaaatgt

SEQ ID NO: 486 - DNA, 3448 bp, Abutilon theophrasti
tcctatgattgcagaagctgtagattataaggtggatgaatttgatggttcaaaattttccagtgaagaggagttggctgttgatgcaacaccattaactggagatgctttaggcatcaagacatctgagatcatggagacagaggtggttccaggtgctggcaatgcgatcttggatgatggctttaatcttgctagtaatgatgaagagcaacatgttctggatgcccatcctgtgcatgataaaattattgaccctgttgggactgatggaattgaaacccccgaggttttggcttgtgaacaaacttctgaaaccaatgctgagaagaaagctgatgttgctagtgggggtctgcttggtaaagatgattcaggaacccagctaaatgatctcaaaggagaagcaggtatagaaatgttggaacaagcgtccgctgagaatgtagatggacgggttacagatggaattcaggcaaaggatcgttcggctcaacctacagaaataatggcagctcaggaaacagaggatttagatagtgattctcagaacaaaagcttggtaaccatggcagtagaagaacctgattcgcctaagtctgtggagcaagcttcagtttctcaagaaattggttttgaaggtgaaatggaagagaagcatcatcagaatgaaggcgttgaaattggaggctcagatactgatggagagtctgaaagcatgttctttgagaattctgaagctgctaagcaattcttggaggagctagaacgaggatctgccgttggttcaaactgggtgctgatacttctcatgatcattctcagaggattgatgatcagattgtcattgaatcagatgaagaagaggataccgatgaagaaggggaggggaaggagttatttgattctgccgctttggcagcccttttgaaagcagcaactggcggtggctctgacggcggtaacattacgataacctctcaagatggaaccaggcttttctctgttgaacgtcctgcaggtttaggatcttcactccaaaatgcaaaatctgcatctcgatcaaacaggcctaatatatttagcccctgctgtgacaagtaggagagactccgacgacaacttgagtgaagaagaaaaaataaaactggaaaagttacagcttataagagtcaaattcttgaggattgttcagaggctcagactttctacagaagattctctagcagcacaggttctttatagactggcacttcttgcagggaggcaaactagtgaactgtttagtgttgattctgcaaagaggacagctctggaacttgaaacagagggtaaagatgatttaagcttctccttaaacatattagtacttgggaagattggggtgggcaagagcgcaacaataaattcaattttcgatgaggtgaagacctcaattcatgcatttgaacctgccactgcagttgtgaaagagattactggaacagtagatggtgttaaactgaggatcattgataccccaggattgaaatcttcagcaatggagcaaggtgccaatcgcaaggtcctagcttctataaaacaattcataaagaagtgtccccctgatgttgtggtctatgttgatcggttggacaccccgacccgggatcttagtgatctgccgatgttaaggtcaatcactaattctcttggctcctctatctggaaaaatgccatagttgcattgactcatgctgcttctgcaccccctgatggaccatctggatcacctatgagttatgagatgtttgttgcccaacgttctaatattgttcagcagtctattggtcaggctgttggtgatctacgcatgatgagtccgagtttgatgaatcctgtttgtcttgttgaaaatcatccatcatgccgtaagaatagagatggccacaaggtgctacctaatggtcaaacttggaggcctcagctagagctgttatgctgttctatcaaagtcttatctgaagcgagttctctctccaaacctcaagatccatttgaccatcggaggctctttggttttcgtgtccgatctcctcctcttccatacttgttatcttcgctgctgcagtctcgtagccatcctaaactcgctgctgatcagggtggtgagaatggcgactctgatattgatatggctgatttatctgattccgatcaagaagaagatgaggatgagtatgaccaactaccaccatttaaacctctaaggaaacaacagcttgccaagcttaacaaggagcaaaggaaggcatatttcgaggagtacgattatcgcgtgaagctcctccagaaaaagcagtggagggaggagttgagaagaatgagagagatgaagaaaggaaagcctgccattgatgaatctggtaacatgggggaagatgttgatcctgaaaccggtggtccagctgccgtacctgttccattaccggacatggtcctgccaccttcattcgatgctcataatccagcgtacaggtaccggttcttggaaccaacttctcagttcttggcgaggccagttctggacacccatggttgggaccatgattgtggctatgatggtgttaacgttgaacatagtctagcaattgccagccagtttcctgctgctgttgcggtgcaactcaccaaggataagaaagagtttaacatccatttggattcttcagtttctgccaaacatggtgaaaatggatcaaccatggctggctttgacatccaaaatgttggaaagcaattagcttatgttataagaggggagaccaaattcaaaaatttcaaaaggaacaaaacagctgcaggcttttctgtcacgtttctaggtgagaatgttgcaactggactcaaactcgaggatcatattgctgttggaaagcggctgatgttaactggtagcactggaacggttagatcaaaaggtgattcagcatacggagccaatctgaaatacagctccgggatgcagattttccaatcggccaggatcaatccactttgggtttgtctctagtcaaatggagaggggacttggctttgggtgcgaattttcagtctcagttttcgttggacggagttcaaaaatagcagttcgtgcagggttgaacaacaagatgagcggacagataactgttcgaacaagcagctcggatcagcttcagattgcactcactgctattcttcctattgtcatggcaatttataaaagcatcaggcctggggttagtgacaagtattcaatgtattagcttgtttatcagatcagattatattggaggaggcttttcattgtatcctttcctccgcaatccttgaataatttgctttaagattacttttgagcatgaactctactgctttgatgagatttccattttgtttcttaataaatgttatttaagcaaggtaa

SEQ ID NO: 487 - DNA, 3799 bp, Abutilon theophrasti; identical to SEQ ID NO: 2

SEQ ID NO: 488 - DNA, 245 bp, Abutilon theophrasti
gacaaggtggaaatgggctccaatggtgtagctgaccaatctgtttcatccacaaagagcagggaggaagggaatgcggtcttagatggtgaagctaaacttgtcactcctatgattgcagaagctgtagattataaggtggatgaatttgatggttcaaaattttccagtgaagaggagttggctgttgatgcaacaccattaactggagatgctttaggcatcaagacatctgagatcatgga

SEQ ID NO: 489 - DNA, 1128 bp, Abutilon theophrasti
ttaactggagatgctttaggcatcaagacatctgagatcatggagacagaggaggttccaggtgctggcaatgcgatcttggataatggctttaatcttgctaataatgatgaagaacgtgttctggatgcccatcctgtgcatgataaaaatattgaccctgttggcactgatggaattgaaacccccgaggttttggcttgtgaacaaacttctgaaaccaatgctgagaagaaagccgatgttcctagtgggggtctgcttggtaaagatgattcaggaacccagctaaatgatctcaaaggggaagcaggtatagaaatgttggaacaagcgtctgctgagaatgtagatggaggggttacagatggaattcaggcaaaggatcgttcggctcaacctacagaaataatggcagctcatgaaacaaaggatttagatagtgattctcagaacaaaaggttggtaaccatggcagtagaagaacctgatgtgcctaagtctgtggagcaagcttcagtttctcaagaaattggttttgaaggtgaaatggaagagaagcatcatcagaatgaaggcgttgaaattggaggctcagatactgatggagagtctgaaagcatgttctttgagaattctgaagctgctaagcaattcttggaggagctagaacgaggatctgccgttggttcaaactcaggtgctgatgcttctcatgatcattctcagatgattgatgatcagatagtcattgaatcagatgaagaagaggatactgatgaagaaggcgaggggaaggagttatttgattctgctgctttagcagccctattgaaagcagcaactggcggtggctctgatggcggtaacattacaataacctctcaagatgggtccaggcttttctctgttgaacgtcctgcaggtttaggatcctcactccataatgcaaaatctgcatctcgatcaaacaggcctaatatatttagccccgctgtgactagtaggagagactccaacgacaacttgagtgaagaagaaaaaataaaactggagaagttacagcttataagagtcaaattcttgaggcttattcagaggctgggactttcttcagaagattctata

SEQ ID NO: 490 - DNA, 371 bp, Alopecurus myosuroides
caaagaacaaagaactgcataccttgatgaaatggactaccgtgagacttcatacctaaaacagcagtggaaggaaggaatcaggaggcaaatggtcgctgaagctcaaaacagtggagtgtcatctgcagttgctgatgattacgaagagagcagcacgtccccagagaccgtgcacatgtcagacatggaaatcccattgagttttgactctgattatccagcgcaccgctaccgtcacctcataactaatgaccagctgtttagaccagttttggatccccaaggatgggaccatgatattgggtttgacgggatcaattttgagtcatgtcaagatttaaagaacagcatatctgtatcagtcgcgg

SEQ ID NO: 491 - DNA, 461 bp, Amaranthus albus
gatgatgaagaaaatggcagactccgtcaaagaaatgcctagtgagtacagtgaaaacgttgatgaagaatctggtggtgctgcatcattaccagtaccaatgcccgatttagcattgcctgcttccttcgactccgataatcctactcacagataccgttacttggattcatccaatcagtggctagtcaggccagttctcgataatcatggttgggatcatgatgttggttacgaaggtatcaacgtagaacacatgtttgtagtcaaggacaggattcccctgtctttctctggtcaagtctcaaaagataagaaagaagccaatcttcagatggaattagccagctctataaaacatggagaaggaaaagctacgacaatgggtttcgacgtgcagagtgttgggaaggacatggcctacacgttacgaagcgagacaaggttcagcaattaccatc

SEQ ID NO: 492 - DNA, 1927 bp, Amaranthus graecizans
tctgctgcgtctgggaagtctgcaactccttctgttcgtcctgcacaacctgctggacttggacgtgcggccccactcttggaacctgcagcaagaacagctcatcattcgcgggttaatgggcaagcttctcaggcacaaatcaacagtgctgaagacactacaaacggggagattgaggaaggtgatgaaattcgggagaagcttcagatgataagagtgaagttttttacgtcttgctcataggctggggcaaactcctcataatgttgttgttgctcaagtgttgtacagattaggcttagcagaacaacttagagcaagaagtgggggccgtgttggggccttcagctttgatcgtgctagtgccatggctgagcagctggaggctgctggacaagaaccccttgatttttcttgtacaattatggttcttggaaaaacaggagttggtaaaagtgcaactatcaattccatatttgatgaggtgaagtttggcactgatgctttccaaatgggtacaaagaaggttcaagatgtcgtgggtactgtgcaagggattaaggtgcgggtgatcgatactcctggacttttatcatcttgctctgatcagcataagaatgagaagatccttcactccgtgaaacgtttcattaagaaatctcctccagatattgtgttgtaccttgataggctggatatgcctagtagggatttcggtgatatgccgttgttgaggactataacggagatatttggaccatctatttggttcaatgcgattgttgtcttgacccatgctgcatcagcacccccggaagggcctaatggtactccttcaacttatgacatgtttgtcactcaacgttcacatgccgtacagcaggttattcgccaagctgctggggatatgcggctaatgaaccctgtttctttagttgaaaaccattcagcgtgcagaacgaatagggctggtcaaagagttttgccgaatggtcaggtttggaagcctcatttgctgttgctctcgtttgcatccaagatattggccgaagcaaatatacttttgaagctacaggattcaccacctgggaaaccgttcactgctcgtgcacgagcaccacctttaccattcctcctctcttcacttttgcaatcaaggcctcaattgaaattacctaacgagcagtttggtgatgatgatacattggacgatgatttggatgtatcttctgagtctgatgaagagtcggaatatgatgaattgcctccatttaagcctctaactaaagcccagctgtctaagctgcccaaaactcagaagaaagcttactatgatgagcttgaatatagagagaagctttttatgaagaaacagatgaaggaagacagaagacgacgtaggatgatgaagaaaatggcagactccgtcaaagaaatgcctagtgagtacagtgaaaacgttgatgaagaatctggtggtgctgcatcattaccagtaccaatgcccgatttagcattgcctgcttccttcgactccgataatcctactcacagataccgttacttggattcatccaatcagtggctagtcaggccagttctcgataatcatggttgggatcatgatgttggttacgaaggtatcaacgtagaacacatgtttgtagtcaaggacaggattcccctgtctttctctggtcaagtctcaaaagataagaaagaagccaatcttcagatggaattagccagctctataaaacatggagaaggaaaagctacgacaatgggtttcgacgtgcagagtgttgggaaggacatggcctacacgttacgaagcgagacaaggttcagcaattaccatcggaataaggcaacagctggtctctcagctactctgatgggtgatgctttatcagctggagtg

SEQ ID NO: 493 - DNA, 456 bp, Amaranthus graecizans
gctagtttgaatggggaaaatgatgcggatttttctgctgctgagggaagttcaagattactagatgaagcggagatgactgatgcagtagaggaatttagtgagggaagagatgataatatagagagtaaagagattagggaagaatcatcaatggcaaacagtcacgaggattctgtgattactgtgagtgatgatggtagtgtgatcaatgatttttccgcggaagagtctcaaggtgatgggtcagaagttgcacctttgaatgctgtggagattgaagctgcagaaggtgatgaggacgctgttgataaatctgttgtctttgaggcatcaaaaaaaagcaatgttgggccgatggatcaaaatgatactggtgctagcctagccgaggatgtcaaagatgtaataacaaatggagacgttgatcatgtcaatgaaacagagaaagaagta

SEQ ID NO: 494 - DNA, 932 bp, Amaranthus hybridus
attttcgtgtacaattatggttcttggaaaacaggagttggtaaaagtagcaactatcaattccatatttgatgaggtgaagtttggcacggatgctttccaaatgggtacacagaaggttcaagatgttgtgggtactgtgcaaggaattaaggtgcgggtgatcgatactcctggacttttatcatcttgctctgatcagcataagaatgagaagatccttcactccgtgaaacgtttcattaagaaatctcctccagatattgtgttgtaccttgataggctggatatgccaagtagggatttcggtgatatgccgttgttgaggactataacggagatattcggaccatctatttggttcaatgcgattgttgtcttgacccatgcagcatcagcacccccagaagggcctaatggtactccttcaacttatgacatgtttgtcactcaacgttcacatgccgtgcagcaagttattcgccaagctgctggtgatatgcggctaatgaaccctgtttctttagttgaaaaccattcagcgtgcagaacgaatagggctggtcaaagagttttgccgaatggtcaggtttggaagcctcatttgctgttgctctcatttgcatccaagatattggccgaagcaaatatacttttgaagctacaggattcaccacctgggaaaccgttcactgctcgtgcacgagcacctcctttaccgttcctcctctcttcacttttgcaatcaaggcctcaattgaattacctaatgagcagtttggtgatgatgatactttagacgatgatttggatgtatcttccgagtctgatgaagagtcagaatatgatgaattgcctccatttaagcctctaactaaggcccagctgtctaagctgcccaaagcccagaagaagcttactatgatgagctt

SEQ ID NO: 495 - DNA, 1056 bp, Amaranthus hybridus
ttcaacagtctctttcttttccctacatttgcccaggactttaagaaggtaatattcgaggatggaccatggggtggaacataatgaggaaaatactgcaaaagtgaaggtagttgatgatgggttgacagaatcgaaggaggttagtgttgatgatgatgggttgttggaaacaaatcttgaggaggaagctgttggtgttactgctcatggttataacaactctcaagggtctgaggagtttgaggaggcagttgaattacctttagacgacacgaatgatgggtcgaaactggattcagatggtgttggtgttggtgttagtgctagtttgaatgaggaaaatgatgcggatttttcggctgctgagggaagttctagattactagatgaagcggagatgactgatgcagtagagggatttagtgagggaggagatgataatatagagagtaaagagattagggaagaatcatctatgggtaacggtcacgaggattctgtgatttccgtgagtgatgatggcagtgttacggatgagaaattgttaacagttgatgagagggtcctaggccaagactctggggcctcaagtgcgatcaatgatttagccacggaagagtctcaaggtgaagggtcagaagttgcacctttgaatgttgtggagattaaagctgtagaaggtgatgaggacgctgttgataaatctgttgtctttgaggcatcagaaaaaagcaatgttgggccaacgaatcaaaatgatactggtgctagcctagccgaggatgttaaagatgtaataacaaatggagacgttgatcatgccaatgaaacagagaaagaagtaggggatcctttggatgacgttaatttccagactccaaaggagaagcctgatgaaacgatttttactaatttgaaaactgatgatggtgatgtagtttcatcaaccgtcggcgaggagagtgcaggagttgtatccgagaaagttttggacaagaccagtacagaaaatgatgatagtattaaggaacttaaagcagaggttttaatccc

SEQ ID NO: 496 - DNA, 493 bp, Amaranthus hybridus
aatatagagagaagcttttatgaagaaacagatgaaggaagacagaagacgacggaggatgatgaagaaaatggtagactccgtcaaagaaatgcctaacgagtacaatgaaaacgctgatgaagaatctggtggtgctgcatcattaccagtaccaatgcccgacttagcattgcctgcttccttcgactctgataatcctactcacagataccgttacttggattcatccaatcagtggctagtcaggccagttctcgataatcatggttgggatcatgatgttggttacgaaggtatcaacgtagaacacatgtttgtagtcaaggacaggattcccctgtctttctctggtcaagtctcaaaagataagaaagaagccaatcttcaaatggaattagccagctctataaaacatggagaaggaaaagctacgacaatgggtttcgacgtgcagagtgttgggaaggacatggcctacacgttacgcagc

SEQ ID NO: 497 - DNA, 1136 bp, Amaranthus lividus
aaggagaagcctgatgaaacgatttttagtaatttgaaaactgatgatggtgatgtagtttcatcaaccgtcggcgaggagagtgcaggagttgtatccgagaaagttttggacaagaccagtacagagaatgatgatagtattaaggaacttaaagcagaggttttaatccccgagcatcaagatgatgatttaaagatagaggacaagtcgtcaaatactagttcttcacttaatgttgaagctttaacttctaaaccagagatctccactccttcagttggatcctcgtcgaaggagataaaaaaacgagagtgcttcttctaattcgggaactcaaaataatgctgttaatgagatgctgtcttctgggccagttggtcgtgatagcaatgctttagaaggaaataaaatgagcaggagaaccaaacagtcgagcaagggaggaaacaacagttaagcctgcagaaaaatcatctgctgcatctgggaagtctgcaactccttctgttcgtcctgcacaacctgctggacttggacgtgcggccccactcttggaacctgcagcaagaacagcacatcattcacgggttaatgggcaagcttctcaggcacaaatcaacagtgctgaagacactacaaacggggagattgaggaaggtgatgaaattcgggagaagcttcagatgataagagtgaagtttttacgtcttgctcataggctggggcaaactcctcataatgttgttgttgctcaagtgttgtacagattaggcttagcagaacaacttagagcaagaagcgggggccgtgttggagccttcagttttgaccgtgctagtgccatggcggagcagctggaggctgctggacaagaacctcttgatttttcgtgtacaattatggttcttggaaaaacaggagttggtaaaagtgcaactatcaattccatatttgatgaggtgaagtttggcacggatgctttccaaatgggtacacagaaggttcaagatgttgtgggtactgtgcaagggattaaggtgcgggtgatcgatactcctggacttttatcatcttgctctgatcagcataagaatgagaagatccttcactccgtgaaacgtttcattaagaaa

SEQ ID NO: 498 - DNA, 1154 bp, Amaranthus lividus
ctacaggattcaccacctgggaaaccgttcactgctcgtgcacgagcacctcctttaccgttcctcctctcttcacttttgcaatcaaggcctcaattgaaattacctaatgagcagtttggtgatgatgatactttagacgatgatttggatgtatcttccgagtctgatgaagagtcggaatatgatgaattgcctccatttaagcctctaactaaggcccagctgtctaagctgcctaaagcccagaagaaagcttactatgatgagcttgaatatagagagaagctttttatgaagaaacagatgaaggaagacagaagacgacggaggatgatgaagaaaatggtagactccgtcaaagaaatgcctaacgagtacaacgaaaacgctgatgaagaatctggtggtgctgcatcattaccagtaccaatgcccgacttagcattgcctgcttccttcgactctgataatcctactcacagataccgttatttggattcatccaatcagtggctagtcaggccagttctcgataatcatggttgggatcatgatgttggttacgaaggtatcaacgtagaacacatgtttgtagtcaaggacaggattcccctgtctttctctggtcaagtctcaaaagataagaaagaagccaatcttcaaatggaattagccagctctataaaacatggagaaggaaaagctacgacaatgggtttcgacgtgcagagtgttgggaaggacatggcctacacgttacgcagcgagacaaggttcagcaattaccatcgaaataaggcaacagctggtctctcagctactctgatgggtgatgctttatcggctggagtgaagctagaagacaagttaatcatcaacaagcaattgcggatggtaatgagcggtggggcgatggcgggtcgtggagatatcgcatatggtggaagtttggaagccactttcagggataaagactaccctatcggccgtttcctttctactctcgggctgtcagtaatggattggcacggggaacttgctctcggatgccatatccagtctcagatcccgatgggacgatctacaaatctggttgctcgggccaacttgaacaaccgaggatctggccaagtcagttttcgtttaaacag

SEQ ID NO: 499 - DNA, 791 bp, Amaranthus lividus
gacagccatttcgaagctttttttcccctctttttctctcacccttcaacagtctctttcttttccctacatttgcccaggactttaagaaggtaatattcgaggatggaccatggggtggaacataatgaggaaaatactgcaaaagtgaaggtagttgatgatgggttgacagaatcgaaggaggttagtgttgatgatgatgggttgttggaaacaaatcttgaggaggaagctgttggtgttactgctcatggttataacaactctcaagggtctgaggagtttgaggaggcagttgaattacctttagacgacacgaatgatgggtcgaaactggattcagatggtgttggtgttggtgttagtgctagtttgaatgaggaaaatgatgcggatttttcggctgctgagggaagttctagattactagatgaagcggagatgactgatgcagtagagggatttagtgagggaggagatgataatatagagagtaaagagattagggaagaatcatctatgggtaacggtcacgaggattctgtgatttccgtgagtgatgatggcagtgttacggatgataaattgttaacagttgatgagagggtcctaggccaagactctggggcctcaagtgcgatcaatgatttagccacggaagagtctcaaggtgaagggtcagaagttgcacctttgaatgttgtggagattaaagctgtagaaggtgatgaggacgctgttgataaatctgttgtctttgaggcatcagaaaaaagcaatgttgggcc

SEQ ID NO: 500 - DNA, 3902 bp, Amaranthus palmeri
aatggaccatggggtggaacataatgaggaaaatactgcaaaagtgaaggtagttgatgatgggttgacagaatcgaaggaggttagtgttgatgatgatggtttgttggaaacaaatcttgaggaggaagctgttggtgttactgctcatggttataacaactctctagggtctgaggagtttgaggaggcagttgaattacctttagacgacacgaatgatgggtcgaaactggattcagatggtgttggtgttggtgttagtgctagtttgaatgaggaaaatgatgcggatttttcggctgctgagggaagttctagattactagatgaagcggagatgactgatgcagtagagggatttagtgaggggggagatgataatatagagagtaaagagattagggaagaatcatcaatgggaaacggtcacgaggattctgtgatttccgtgagtgatgatggcagtgttacggatgagaaattgttaacggttgatgagagggtcctaggccaagactctggggcctcaagtgtgatcaatgatttagccatggaagagtctcaaggtgaagggtcagaagttgcacctttgaatgttgtggagattgaagctgtagaaggtgatgaggacgctgttgataaatctgttgtctttgaggcatcagaaaaaagcaatgttgggccaacgaatcaaaatgatactggtgctagcctagccgaggatgttaaagatgtaataacaaatggagatgttgatcatgccaatgaaacagagaaagaagtaggggatccttcagatgatgttgatttccagactccaaaggagaagcctgatgaaaccatctttagtaatttgaaaactgatgatggtgatgtagtttcatcaaccgtcaatgaggagagtgcaggaggtgtatccgagaaagttttggacgagaccagtacagagaatgatgatagtattaaggaacttaaagctgaggttttaatccccgagcatcaagatgatgatttaaagatagaggacaagtcgtcagatgctagttcttcacttaatgttgaagctttaacttctaaaccagagatctccactccttcagttggatcgtcgtcgaaggagataaaaaacgagagtgcttctaattcaggaactcaaaataatgctgttagtgagatgccgtcttctgggccagttggtcgtgatagcaatgctttagaaggaaataaaaatgagcaggagaaaccaaacagtcgagcaagggaggaaacaacagttaagcctgcagaaaaatcatctgctgcatctgggaagtctgcaactccttctgttcgtcctgcacaacctgctggacttggacgtgcggccccactcttggaacctgcagcaagaacagcacatcattcgcgggttaatgggcaagcttctcaggcacaaatcaacagtgctgaagacactacaaacggggagattgaggaaggtgatgaaattcgggagaagcttcagatgataagagtgaagtttttacgtcttgctcataggctggggcaaactcctcataatgttgttgttgctcaagtgttgtacagattaggcttagcagaacaacttagagcaagaagcgggggccgtgttggagccttcagttttgaccgtgctagtgccatggcggagcagctggaggctgctggacaagaacctcttgatttttcttgtacaattatggttcttggaaaaacaggagttggtaaaagtgcaactatcaattccatatttgatgaggtgaagttcggcacggatgctttccaaatgggtacacagaaggttcaagatgttgtgggtactgtgcaagggattaaggtgcgggtgatcgatactcctggacttttatcatcttgctctgatcagcataagaatgagaagatccttcactccgtgaaacgtttcattaagaaatctcctccagatattgtgttgtaccttgataggctggatatgccaagtagggattttggtgatatgccgttgttgaggactataactgagatattcggaccatctatttggttcaatgcgattgttgtcttgacccatgctgcatcagcacccccagaagggcctaatggtactccttcaacttatgacatgtttgtcactcaacgttcacatgccgtgcagcaagttattcgccaagctgctggtgatatgcggctaatgaaccctgtttctttagttgaaaatcattcagcgtgcagaacgaatagggctggtcaaagagttttgccgaatggtcaggtttggaagcctcatttgctgttgctctcatttgcatccaagatattggccgaagcaaatatacttttgaagctacaggattcaccacctgggaaaccgttcactgctcgtgcacgagcaccacctttaccgttcctcctctcttcacttttgcaatcaaggcctcaattgaaattacctaacgagcagtttggtgatgatgatactttagacgatgatttggatgtatcttccgagtctgatgaagagtcagaatatgatgaattgcctccatttaaggctctaacgaaggcccagctgtctaagctgcctaaaacccagaagaaagcttactatgatgagcttgaatatagagagaagctttttatgaagaaacagatgaaggaagacagaagacgacggaggatgatgaagaaaatggcagactccgtcaaagaaatgcctagcgagtacaatgaaaacgctgatgaagaatctggtggtgctgcatcattaccagtaccaatgcccgacttagcattgcctgcttcatttgactctgataatcctactcacagataccgttacttggattcatccaatcagtggctagtcaggccagttctcgataatcatggttgggatcatgatgttggttacgaaggtatcaatgtagaacacatgtttgtagtcaaggacaggattcccctgtctttctctggtcaagtctcaaaagataagaaagaagccaatcttcaaatggaattagccagctctataaaacatggagaaggaaaagctacgacaatgggtttcgacgtgcagagtgttgggaaggacatggcctacacgttacgcagtgagacgaggttcagcaattaccatcgaaataaggcaacagctggtctctcagctactctgatgggtgatgctttatcagctggagtgaagctagaagacaagttaatcatcaacaagcaattgaggatggtaatgagcggtggggcgatggcgggtcgtggagatatcgcatatggtggaagtttggaagccactttcagggataaagactaccctatcggccgtttcctttctactctcgggctgtcggtaatggattggcatggggaacttgctctcggatgcaatatccagtctcagatcccgatgggacgatctacaaatctggttgctcgggccaacttgaacaaccgagggtctggccaagtcagttttcgtttaaacagctcagaacagcttcagttggcacttattgctttccttcctctgttcagaaagctaatgggcggtcagcgtcaagatcaccctcttgagtattgataaaacaagtgatcgatagcattatgcgcgacaataggaagtaagttcgacaataggttgtcgtcaaaatttagcagtgagtaatctcttccaatcatccttttttggttttccatagccattttaatttccttgttagatatttgcgtgacctttatgcgtttaagattgaaactcatgttcatgatcttagtatagccttgctactttcgatttgaaggaattgtttgttacatgtgaaaatagtatgtactttcaatgcatatgaaattttgttcagtagttt

SEQ ID NO: 501 - DNA, 12344 bp, Amaranthus palmeri
tccaaaaaaaaaaaaaaaaaaaaaaaagaagacttgaaccttgataccaagcagaacatgtgatagattctagaatatgagtcttattagagtgtataacatcttatgttttttattgagttggttccttgagatagtaccaaaatcacaggttcaaattccaactaacccttagattcaagtggaatatttcgccctaaaggtacgaggagggtctgtgctacatccacacttctagcccaaaagagctctcgtgtgaggggggcttgttagagtatataacatattatgggatctcaaccatcagtttaaacttttggttgagttggtttcatgacaatgaggagtactagttagaattctcaccttggtttttgaataggggagtactagctcaaagacaaggcgataacagcttaatattcctgcagccgttcataagaatactgcccttctgttcctcaaaagtcattgttctttaatcatgcattaatgttcccttcttagttttacatggaaagaaatatccctttgataaaattggatttctagcctatctaccatcagagtatacaggtctgcactctgcactgaggaacataaagtataaaaaactgcaattaagttggcaaaacctgcactaggactataatatggctttaaagttccatatggctttcacagttctaaggtaaactcatattcacatcaagcatctgactaagtacacttccaatatgctgagtgtaaaaaatccatcagcagtctaaaacaatcaaaagcagcaaaggaacaaacatgataatttaaatttacaagataagcatgatcatcccaacatatggaatcagctacatgatatacaattcctccctaaactcccaaacttttcaattttcccccagcagagaaaaacctagaaacttaaaccattataatatataattccttcctaaactccctataaaacctcattgcctctcaataattagaaatttcaccttatggataccctatcactagacccgaatttattcaaagaaacaacatttttacaactattttagcaaaaaaatttccaagaaacatcaatcatgcttactttaacatacccagatagcacactattccaaattggaaaatatctcgcagacattttatcaaacacctttcgtgcatcaacgtgatcaccacattcaaaatacatactcagaaaatgattagaaactgatgcattgatgtgtttcataccagcacattttatacaaagatgcacccatttgtccacttaaagagatctagccttcacacactgtgttaagagaaatttaaaagtttaggctttaatcttataccttttctaggtaagagactaagtcatttaacggcttctttaaccattccttggttgcaaagatcattcaatggtacatggttgaacttctcaaaattaattgtcgggtcttcaaaggtttaagacaaaatcgagaaaaccatgccctttcttcgatggagaaatcggactgggactctgggagcattgtagtacagcaccatgtcaagtttgagattcttgattaaagaactaatttagaaaatggaaatttttacgctttcttggcggttaacgagatttaacattgccggagaaagatttcaaagtcttgaggttccagaggtcgttcgtttgacccgccgcacggaaggcaaaacgggtggcggttgcggtatctttctcgtattcatgtcccaaaatgaccaattttggtaggagatggtttcttaataagacgacctcataacaaaaagtctatatactacaaaatttcaactatctgtctatttaactaaagtatgagatatatctcacgatcaaattatttcatacaaggatttatgagaaaagttaacaaattagagtgaaaactctaatgaatattcatctttacgtgatattatgttacgtaaaataaaaacaaccttcttatgatagctactatatatagaaacacatcactacacgtgatattttgtatgcgcttgaagcttggacagtctatcactactttagtgaagaaaatcttatgaaatctcatgaaatatgtaagattaaatccttacacataagtaaacaataaagctacagtggcatgcacactctagtgaaagaacaagaaaattacttttattaggtaccttactccaataacctattattatgaggtatctttgccactgattttcaatcgttgaaattctcttacatcatagtgtagctataagtgggtactaatataagtgttgccgtgttggaggtgattttgcttacacctaaggttacttataatgtctctttttaaaatattctacatcatagattcatagctatatatgggtactaatttgggtgttagaggtaccatatccaattgaggcaaaatctcaggaacggaaaattatattctatgtataattataataatttgtaagagactcataaaagtgtagagtaagtaacaagagatcaagtctcgatatacaatgtgaaagctttgaatctaatacatcaacctccacaaacttaggcagtgaaatgatgaatctcatacttggaagttaaatcatagaatatgatgttactcataaaggcacataatcattcacactactatctttgggtcactactcacatggcatgtacaaagctacccaaatgggattattagtagataaaaccaacactaaaattgccaaatgcaagatacaaacaatatttagccaaagcatttaatactttaaatttacaccaatgatttaaatatgtaagactgttttgagttatatagtcattattatcatcacatttagtgtatcttgctcattgacactattttagaaggaaaggaagacaacaactcatgcccataaaaaaaaatacagttaaagagtctgactatcagattaaaaaagacccttatatgatgcaaattcaaaagaacgaaatattattcatatattttaacatctaattatttaaatcattatgttaatatgttttgtagctatgtacctaacacccatatctacaatgaattgtacacgtgagaataatacattagaaaatacttcattagtcatactttgaattttgaagctatgttgtgtggattagtgcaaatctattccttacctctctaaatctccaacctttcttttaattcctatcaacattgacatcatcaaatcaacatatattatttaaatgcataaagaaagacttgtgttttgagcaagaatattacacaagaaatgaaacaattagtcaataatgaatataaaaaataaataatttgtttgattatcagaaagcggagaaccattaacttatgtaggatacttggttaatgactttaactctatctttattaggaggtggagaatgtgtttttttatctttatctttacaaattaggagttgatgatttatttccaaattacaattaatattagaaatattgcatttgcattattcatttatcatccttagtatatgattagtttctaatctataggttaaaacaaagtcaagtaagattttgtttgatgagtctaatataaagattatagatatatatcaatttattttaaataatttgcaaattacaaccttaaagtttatcatttttacgcattacagcctcaatgtttattttcagcgaattacatccaccaaagtattaagctttacaagttcaagctaaaacacagaattccgaccattttgttggttagaattttaggttaagtggtcggagttttgtgtttttgtcctgaacttgtaatcttagttcctttggtggctgtaattcataaaaaaaaaacattaatgctataatttgcaaaaatgttaaactttaaagttgtaatttacaaattgaattgtcttaaaagttgaatgttacaagtaatttgaaaggaaaatttacctagaatgatccagcctattcatgattttcatacaataatcccacctattgattaaccatgaataatcctaactttaagatatattttcctagagtaaagttggaaacctgatgacctcctataatgattaattacaccaaaaaaataaattgaaaattaacttaaaattagaaaaaattttgaaattttacataaaaaattataaataataaaaaaatcataattttttttgaaattttttttaacatttttttgatattttattttaatttatccttttaaaaaaattaaatcttactatagcaagtcattcagtcatcggatttactctaggaaaatatccctcaaaattgaaattattcatagttgaaattatcgtagaaaaatcacgaataagttaaattatttaagttattttttcaatttaaagggagtaaaatcagtaaatagtacttcacatacactagcattttacacgaggctaccaatccccatttttacaaccgttagatcccatcatgaatctctaaccattgatctcttcttatccgctacacctatactactttttttcacgacccaaattttttctctctcgttatacttgggcagacagccatttcgaagctttttttttcccctctttttctctcacccttcaacagtctctttcttttccctacatttgcccaggttatttttattatcattatttatgttctcttaatttattgcttttctatatcattagcttttattgtattttctcttgcattaaaatgtaattaattattctatagatttaatgttttttgtatttgattgaatgacctgctctcaaattctattcttgaatgctcacatgcccatttttgctgagtttttttgttttaagaaaaagtgaattttgattgattttgtataaaatacagatgattttatatctgggtgtttatcggttttgggtaattttaggattttgtatcgaagtaccatttcgggatggaaaatcagatgggtgttaataatttatatatatttatacatgattgggtgatctgctttaaaatcttgttcttgtatgttatatgttctttaattttttggggttgttgaatttttgtgattttcttcgtatagctagctattagggtttattgatgtatgctaataaattagttcaaaagaattcgattggttctgattggtgtatagttgatttaatatttgggttcttggttaattttaggacttcaagaaggtaatattcgaggatggaccatggggtggaacataatgaggaaaatactgcaaaagtgaaggtagttgatgatgggttgacagaatcgaaggaggttagtgttgatgatgatggtttgttggaaacaaatcttgaggaggaagctgttggtgttactgctcatggttataacaactctctagggtctgaggagtttgaggaggcagttgaattacctttagacgacacgaatgatgggtcgaaactggattcagatggtgttggtgttggtgttagtgctagtttgaatgaggaaaatgatgcggatttttcggctgctgagggaagttctagattactagatgaagcggagatgactgatgcagtagagggatttagtgaggggggagatgataatatagagagtaaagagattagggaagaatcttcaatgggaaacggtcacgaggattctgtgatttccgtgagtgatgatggcagtgttacggatgagaaattgttaacggttgatgagagggtcctaggccaagactctggggcctcaagtgtgatcaatgatttagccatggaagagtctcaaggtgaagggtcagaagttgcacctttgaatgttgtggagattgaagctgtagaaggtgatgaggacgctgttgataaatctgttgtctttgaggcatcagaaaaaagcaatgttgggccaacgaatcaaaatgatactggtgctagcctagccgaggatgttaaagatgtaataacaaatggagatgttgatcatgccaatgaaacagagaaagaagtaggggatccttcagatgatgttgatttccagactccaaaggagaagcctgatgaaaccatctttagtaatttgaaaactgatgatggtgatgtagtttcatcaaccgtcaatgaggagagtgcaggaggtgtatccgagaaagttttggacgagaccagtacagagaatgatgatagtattaaggaacttaaagctgaggttttaatccccgagcatcaagatgatgatttaaagatagaggacaagtcctcagatgctagttcttcacttaatgttgaagctttaacttctaaaccagagatctccactccttcagttggatcgtcgtcgaaggagataaaaaacgagagtacttctaattcaggaactcaaaataatgctgttagtgagatgccgtcttctgggccagttggtcgtgatagcaatgctttagaaggaaataaaaatgagcaggagaaaccaaacagtcgagcaagggaggaaacaacagttaagcctgcagaaaaatcatctgctgcatctgggaagtctgcaactccttctgttcgtcctgcacaacctgctggacttggacgtgcggccccactcttggaacctgcagcaagaacagcacatcattcgcgggttaatgggcaagcttctcaggcacaaatcaacagtgctgaagacactacaaacggggagattgaggaaggtgatgaaattcgggagaagcttcagatgataagagtgaagtttttacgtcttgctcataggctggggcaaactcctcataatgttgttgttgctcaagtgttgtacagattaggcttagcagaacaacttagagcaagaagcgggggccgtgttggagccttcagttttgaccgtgctagtgccatggcggagcagctggaggctgctggacaagaacctcttgatttttcttgtacaattatggttcttggaaaaacaggagttggtaaaagtgcaactatcaattccatatttgatgaggtgaagttcggcacggatgctttccaaatgggtacacagaaggttcaagatgttgtgggcactgtgcaagggattaaggtgcgggtgatcgatactcctggacttttatcatcttgctctgatcagcataagaatgagaagatccttcactccgtgaaacgtttcattaagaaatctcctccagatattgtgttgtaccttgataggctggatatgccaagtagggattttggtgatatgccgttgttgaggactataactgagatattcggaccatctatttggttcaatgcgattgttgtcttgacccatgctgcatcagcacccccagaagggcctaatggtactccttcaacttatgacatgtttgtcactcaacgttcacatgccgtgcagcaagttattcgccaagctgctggtgatatgcggctaatgaaccctgtttctttagttgaaaatcattcagcgtgcagaacgaatagggctggtcaaagagttttgccgaatggtcaggtttggaagcctcatttgctgttgctctcatttgcatccaagatattggccgaagcaaatatacttttgaagctacaggattcaccacctgggaaaccgttcactgctcgtgcacgagcaccacctttaccgttcctcctctcttcacttttgcaatcaaggcctcaattgaaattacctaacgagcagtttggtgatgatgatactttagacgatgatttggatgtatcttccgagtctgatgaagagtcagaatatgatgaattgcctccatttaaggctctaacgaaggcccagctgtctaagctgcctaaaacccaaaagaaagcttactatgatgagcttgaatatagagagaagctttttatgaagaaacagatgaaggaagacagaagacgacggaggatgatgaagaaaatggcagactccgtcaaagaaatgcctagcgagtacaatgaaaacgctgatgaagaatctggtggtgctgcatcattaccagtaccaatgcccgacttagcattgcctgcttcatttgactctgataatcctactcacagataccgttacttggattcatccaatcagtggctagtcaggccagttctcgataatcatggttgggatcatgatgttggttacgaaggtatcaatgtagaacacatgtttgtagtcaaggacaggattcccctgtctttctctggtcaagtctcaaaagataagaaagaagccaatcttcaaatggaattagccagctctataaaacatggagaaggaaaagctacgacaatgggtttcgacgtgcagagtgttgggaaggacatggcctacacgttacgcagtgagacgaggttcagcaattaccatcgaaataaggccacagctggtctctcagctactctgatgggtgatgctttatcagctggagtgaagctagaagacaagttaatcatcaacaagcaattgaggatggtaatgagcggtggggcgatggcgggtcgtggagatatcgcatatggtggaagtttggaagccactttcagggataaagactaccctatcggccgtttcctttctactctcgggctgtcggtaatggattggcatggggaacttgctctcggatgcaatatccagtctcagatcccgatgggacgatctacaaatctggttgctcgggccaacttgaacaaccgagggtctggccaagtcagttttcgtttaaacagctcagaacagcttcagttggcacttattgctttccttcctctgttcagaaagctaatgggcggtcagcgtcaagatcaccctcttgagtattgataaaacaagtgatcgatagcattatgcgcgacaataggaagtaagttcaacaataggttgtcgtcaaaatttagcagtgagtaatctcttccaatcatccttttttcggttttccatagccattttaatttccttgttagatatttgcgtgacctttatgcgtttaagattgaaactcaagttcatgatcttagtatagctttgctactttcgatttgaaggaattgtttgttacatgtgaaaatagtatgtactttcaatgcatatgaaattttgttcagtagaaatcgtcctcagttcgtttttattgtataccctttgaaaccatgaattgaagattggttgaactgtaaatgaaactgatgtttatactccctccacgctttggaaatcatgatcagggtttgagaaggactatttgacaactcaccaatgtcaccataccttttatcaaaagagataaaggaggttggagttgttgactagggttgttcattcgggttatcgggttgattttgggtcaagtttttcgggttgttttaaaatagggtcttttgttcatattgacttttacatatttttaaattcattttgaagccggtcaagtcagattcagttataagattgaataattatcggattatctggtttgtttgaatgctattgtatttgtgagcaaaaaaagtcatagtatatgaatttgacaagaatttatttgctacaacctacaatgttttaatcaatcaactcaaaaaagtatgtccattaccatggcctcttttaaacctatgctgttgtgaacttgtgattatgtgtctgtctttttcgcgagtccattgtcatgcatcatactcttttgtctcttgaccaaaaacgtttgtagctcaatggatagagcatttgcatgtagagtagaaggtttggggttcaactcttactgggcttaggtgtcaactgtggggtttccatccctctttactctctccttgagggatacagatatatgtccgccctttcaggaaaagaaaccgtccactcgaaccctgccttgtgcgggataccgggattgtcctttacctttatactcttttgtctccttaaatttgcccgtaatttttaatagcaaatttagaggaattgagcaagtattcgatactatatcttccccatttggacatcatgatgaataatgatggattggccctattaacacaatctggccttcatctaacttttattatttagaagcaatttgacatgttgaagcttttgtgactttgtcattgataactttataatgttttcaagcatgttcttcacaacgaaaatgcatttaagcatattcttcacaacgaaaatgcatttaagcatattcttcacaactattaacaatattttgagtgaatttagttaaatttacttatgggtttgtttggttgccgatattatatggtgtgaaacggtaatggaaagttcgtgtaattttaatagaaacttttttctgataagttaatggtcatgcccagtgcagacatatttgttctgttatcatctcattttcttctcaaattcatttcttaaaatccgagatggggaagtatcaatgccataacagaaaatatgaacatataaacttctataggatcaaagctccgttaccacggaaattgcaccgtagtatcaaaattatcacaacaaattattattagccttgagttattagttaaaatcagagagttgaattgtgaaagtgataaattgaactgaattgaattaaaattaaactaaaggagaaggcaaacttgtaggctaatagtatatgtatattgaacttcccaaggctatttcaaatttattgttattgaatgtgaaagtggtaagttgaattgaattgactatagtctatatatttctgtgagagatggtgttattgagagactatctttaattgagcctatatattttttaaaatactgtagataggtattaagaataatataagtagatgttatattgaaaataagcattaagaatacggtaagtaagcattaaggataatgtaaataggcattaaaaatacgataaattagcattaatctttaataaattatatttgaaaaacgtctctcaagagactagctaatattttaatagcaattgagtaacgcttggaatacgctcaaacacttttttcagctttggtagctttaccctacatgtcccattcatttggtatagccttgtgatttgtgaaggtgtggtcatctgggcatgggtatcatattcttttcttatcacgctcttcaaccttacatcctcattcctatttactgcatagtgcatagttgatagtactactattttctttttaaatcgcgcataagattttgagcggtggctatctatttccctttaaaattagatagcgaaacagttgaaatttacagtatgttttattgtgtccagtccatctttggcttcatgctaaacctttatcttctcctacctctctctttaatttcattgctccatcaacttcaaatgagatcttgtgttctattgagaatcactcttatagaatttgtgggtatttttattattaatgcgtacttataattttgtcctatttttattattaggaatgatttatatttttaaaaattttcatctatatatttaattatatttttatcttatccacatgattgtcttactttttcataaaatgtacttcctttgtttcttttcaaatgtcttatttggtttaagcatgtttgccaatgcactaatactatccttaatatatttaattgtacatgattaaaaattataaaaagtagatattaataagccttatattgaaactaatcaaccaatatctcattttactatgttttaacttatagattatacttcataaattaagagtaaatgatgaatagtgaacttcttgttttgcggtatcaaatagaacgtaaaccacttttattcactttacttgatttttactccatttgtattaaaggccaatttattattaaattcacggcccgtttggttagtggtactaaatggttgtaatgggaatgatttatagtgtaaaatttcatcaaaactttcatatcattcccatggtaatgaaactttgatcacaaaaaagtttttttgttcacaaatttccattacctcctaattgttagagtatataaaatattctggggcctcaaccatcagcttaatcttttggttgaggccccaatgtatgttatatactctaacacgccccctcacacgagagccctttgggctagaagtgtggatgcaaacacgggttccctcatacctggtgctaaatatttcacttaaatgaggggtacgtggttgagattcgaacccgtgacctcttgtcacgttggcttctgataccatattaaggaaccaactcaaccaaaagcttaagcttttggt

SEQ ID NO: 502 - DNA, 866 bp, Amaranthus rudis
tttttttttcttttttttttcttctcacccttcaacagtctctttcttttccctacatttgcccaggactttaagaaggtaatattcgaggatggaccatggggtggaacagattgaggaaaatactgcaaaagtgaaggtagttgatgatgggttgacagaatcgaaggaggttagtgttgatgatgatgggttgttggaaacgaatcttgaggaggaagctgttggtgttactgctcatggttataacaactctcaagggtctgaggagtttgaggaggcagttgaattacctttagacgacataaatgatgggtcgaaactggattcagatggtgttggtgttggtgttagtgctagtttggatggggaaaatgatgcggatttttcggctgctgagggaagttcaagattactagatgaaacggagatgactgatgcagtagaggaatttagtgagggaagagatgataatatagagagtaaagagattaggcaagaatcaacaatgggaaacggtcacgaggattctgtgatttctgtgagtgatgatggcagtgttacggatgagaaattgttaacggttgatgagagggtcctaggccaagaccctggggcctcaagtgtgatcaatgatttagccacgaaagagtctcaaggtgaagggtcagaagttgcacctttgaatgttgtggagattgaagctgtagaagttgatgatgacgctgttgataaatctgttgtcttggaggcatcagaaaacagaaatgttgggccaatggatcaaaacgatacgggtgcgagcctagccgaggatgtcaaagatgtaataacaaatggagacgttgatcatgtcaacgaaacag

SEQ ID NO: 503 - DNA, 1625 bp, Amaranthus rudis
tgcagaacgaatagggctggtcaaagagttttgccgaatggtcaggtttggaagcctcatttgctgttgctctcatttgcatccaagatattggccgaagcaaatatacttttgaagctacaggattcaccacctgggaaaccgttcactgctcgtgcacgtgcaccacctttaccattcctcctctcttcacttttgcaatcaaggcctcaattgaaattacctaacgagcagtttggtgatgatgatactttggacgatgatttggacgtatcttccgagtctgatgaagagtcggaatatgacgaattgcctccatttaagcctctaactaaagcccagctgtctaagctgcccaaaacccagaagaaagcttactatgatgagcttgaatatagagagaagctttttatgaagaaacagatgaaggatgacagaagacgacggaggatgatgaagaaaatggcagactccatcaaagaaatgcctagcgagtacagtgaaaacgttgatgaagaatctggtggtgctgcatcattaccagtaccaatgcccgatctagcattgcctgcttccttcgactccgataatcctactcacagataccgttacttggattcatccaatcaatggctagtcaggccagttctcgataatcatggctgggatcatgatgttggttacgaaggtatcaacgtagaacacatgtttgtagtcaaggacaagattcccctgtctttctctggtcaagtctcaaaagataagaaagaagccaatcttcagatggaattagccagctctataaaacatggagaaggaaaagccacgacaatgggtttcgacgtgcagagtgttgggaaggacatggcctacacattacgcagtgagacgaggttcagcaactaccttcgaaataaggcaacagctggtctctcagctactctgatgggtgatgctttatcagctggagtgaagctagaagacaagttaatcatcaacaagcaattgaggatggtaatgagcggtggtgcgatggcaggtcgtggagatatcgcatatggtggaagtttggaagccactttcagggataaagactaccctatcggccgattcctttctactctcgggctgtcaataatggattggcacggggaactcgctctcggatgcaatatccagtctcagatcccgatgggacgatctaccaatctggttgctcgggccaacttgaacaacagaggatctggccaagtcagttttcgtttaaacagctcagaacagcttcagttggcacttattgctttccttcctctgttcagaaagctaatgggcggtcagcgtcaagatcaccctcttgagtattgataaaacaagtgatcgatagcattatgcacgacaatagggagtaagttcgacaataacttgtcgtcaaaatttagcagtgagtaatctcttccaatcctcctttttttttggtttttccttagccattttaattttccttgttagatatttgcgtgacctttatgcgtttaagattgaaaactcaagttcatgatcttagtatagctttgcttttttctaaaaaaaagaaaaaaaaaaaacaatagtcggccggcctccgg

SEQ ID NO: 504 - DNA, 3669 bp, Amaranthus rudis
ggggaagaagaggaaacaaaagacttagagagcaaagaaaatacagacgttgaaaacaatgttattgaagattttgtttcaacattggagggtagtgttgcagaaaaacctgctgtagatgagtctgttgaaggtactggggagaagctaactgatgagggagattctatagtggatgccattaatgttgatgctgttgaagttgttgggtctggagctgctgttggggaggtagaagaagcaaaagactcagagagtatggcaactacagaggtcgaaaacaatgttattgaagaatttgtttcaacattggatagtactgttggagaaaaacctgctttggatgagtctgcatctgttgaagatactgaggtgaagttaactgatgagggggattctattgtggattcgattcatgttgatgcgggtgaagttgttagatctggagctgctattgttggggaggtagaagaagcaaaagacttggagagtgcagcacctacagaggccgaaaacaatgttattgaagaatttgtttcgacaatggaggattctgtggtagacgaacctgctgatgtggactctagatccttaaaagaagatgaggtgaaggttcaaggtgaagaggactcgattgtagacgagattaatgttgatgttgttgaagccgtgagatctggagtagctgttgtgggggattctggagcagcgaaaatggaaaaggaaacggaaccagagggcaaggacgtaggtgcacccattcgcgctaattcttcagagattgttgatgttgaagatctctcaaatctggcagaaactcctgtttcagtagagattgatgagaacctgacgagtacaggagaggtcaagttagaaaatgatgaatccaagcagcatgagtctggtgatggtgtgaactttgtttctcttggggaccaagagagggttcaggctgatcctgttaatgatacggcttctgataatatcgatcagcatgaagcaaaaccagtagaggggcatgatgatgaagagtctgatgatgacggtgaacctgtattctttaaggatggggtgtcttccagagcttttgtggaagagttggcatctggtggtcattcagagatgattgatggtcaggttgtcacagactctgaggaagaagctgattctgatgaggaaggagaaggtagacaattgattgattctgctgcattagctgctcttttgaaagctgcggctagtggtaactcggattcaaacactatcactataacatctcaagacggatctcgccttttctctgttgagcgacctgctggtcttggaacatcactccgatctttgagacccgcatcaaatgcaagcaatcccaacatgtttgctcagcccaatgttatttctgcatctgaggatagcttaagtgaagaagacaaaaagaagctgcgtacaatacacgagttgagagtaaaattcctgaggcttattcaaagacttggtcagactgcagagcaatccgtagcagcacaagtcctctataaactagcaatgttcgctggtaggacagcggttccgtctttcagtctcgataatgcaaaacagactgcttcgcagcttgaggctgaagggaatgaagatttagacttttccttgaacatcctggttcttgggaaaactggtgttggcaagagtgccaccatcaactcaatatttggtgaagagaaggtaaaaatcaatgcattcgaacctgaaaccacgtctgttaatgtcgttaatggaattgtggatggggtcaaaatcagggtcattgacgcacctggtcttaaatcttctgcattggagcaaggtttcaaccgtaaagttttagcctcggtcaagaagattactaagaaatatcctacagatctcttactttatgtggataggctggattcacagacaagagatctgaatgatctacccatcttgaggacaatcactagctcgcttggttcttcaatctggcggagtgccattctcactctaactcacgcagcatgtgctcctcctgatggcccatccggtgccccattaggttacgacgtgtttgtgggacagcgtagtcatattattcaacagtctattggacaagctgttggtgatttgcgttttatgaatctaggtatgatgaatcccgtctcccttgttgagaatcaccctgcatgtcggacgaacagagaaggagataaggttcttcctaatggtcaggcctggagaccgcagttattgttgctatgctactcgctcaaaatattggctgacgcaagcttggccacgaagccacaagaacctgtagatcaccggaagctttttggtttccgtgtccgttcacctcctctcccatacctgttatcttcactgttgcagcctcgtacccaccctaaactttcagctgatcagggtggtgaaaatggtgattctgacattgacttggacgacttttccgattctgaccaggaagaagatgagtatgatgagctcccaccattcaagcctttacggaaaacccagcttgctaagcttagcggagagcagaggaaagcgtattttgatgaatacgactatcgagtgaagctgcttcagaagaagcagtggagagaggagctgaagagactcagggagataaagaagaatggaaaaattaacttgaatgacccaaatgacatgccagaagattatgatgctgagaatggagcccctgctgctgtaccagtgcccttgcccgacatggtattgccaccgtcttttgacagcgacactccagcttatcgttatcggttcttggagccaacgtcccagttcttggctcgtccagtgctggacacccacggttgggaccatgattgcgggtatgatggtgtaaatgtcgagcaaaatataggaatcgcaggacgcttcccagcagcagtaactgtgcaggtaaccaaagacaagaaagacttcaacatccacttggattctgcagtctcagccaagcatggagaaaatggttccagcttagtcggatttgatattcaaacaatcggtaaacagcttgcttatatcataaaaggcgaaaccaaattcaaaaacctgaagaagaacaagacagctggtggaatctcggttacatttctgggagagaatgtagccacaggagtaaaactcgaagatcagatatctttgggtaagaggctcgttttcgtagggtctacaggaaccgttcgttctcagaaagacgctgcatacggagctaatctggaactacgccttaaagatgccgatcatcccattaaccaagatcagtcctcttttgtactatcactcatgaaatggagaggagacttggcaatcggaggaaacgtgcagtcccagatatctgttgggcgtaatgcaaagatggctgttcgtgttgcgttaaacaacaaacagagcgggcagataaccgtgaagacgagcacttctgatcatttggctcttgcttatgctggtctagttcctattgctcttgccatttatcagaaattctggcctagtgctagtgagaattactctatctactaaaactttatttcaattttggtttctgttatttattttccatttatgttcaaattgtgatgaagactcttgttgttttcattagttacttat

SEQ ID NO: 505 - DNA, 584 bp, Amaranthus rudis
caagcattagtgaagagagtgcaggagatgtatccgagaaagttttggacatgatcagtacagagaatgatgatagtattaaggaatttaaagctgaggttttaatcaccgagcatcaagatgatgatttaaagatagaggacaagtcgtcagatactagttcttcacttaatgttgatgctttaacttctaaaccagagatctccactccttcagttggatcctcgtcgaaggagataaagaacgagagtgcctcttctaattctgaaattcaaaataatgctgcaaaggagatgccggcttctgggacagttggtcgtgatagcaatgcttcagaaggatcaaaaaatgagcaggagaaaccaaacattcaaacaagggaggaaacaacggttaagcctgcagaaaaatcatctgctgcatctgggaagtctgcaactccatctgttcgtcctgcacaacctgctgggcttggacgtgcggcccctctcttggaacctgcagcaagaacagcacatcattcgcgggttaatgggcaagcttctcaggcacaaatcaacagtgctgaagacactacaaacggg

SEQ ID NO: 506 - DNA, 1049 bp, Amaranthus rudis
cctagccgaggatgtcaaagatgtaataacaaatggagacgttgatcatgtcaacgaaacagagaaagaagtaggggatccatcagatgacattcatttccagactccgaaggcgaagcttgatgaaactatttttaggaatttgaaaactgatgatggtgatgcaatttcatcaagcattagtgaagagagtgcaggagttgtatccgagaaagttttggacatgatcagtacagagaatgatgatagtattaaggaatttaaagctgaggttttaatcaccgagcatcaagatgatgatttaaagatagaggacaagtcgtcagatactagttcttcacttaatgttgatgctttaacttctaaaccagagatctccactccttcagttggatcctcgtcgaaggagataaagaacgagagtgcctcttctaattcggaaattcaaaataatgctgcaaaggagatgccggcttctgggacagttggtcgtgatagcaatgcttcagaaggatcaaaaaatgagcaggagaaaccaaacattcaaacaagggaggaaacaacggttaagcctgcagaaaaatcatctgctgcatctgggaagtctgcaactccttctgttcgtcctgcacaacctgctgggcttggacgtgcggcccctctcttggaacctgcagcaagaacagcacatcattcgcgggttaatgggcaagcttctcaggcacaaatcaacagtgctgaagacactacaaacggggagattgaggaaggtgatgaaattcgggagaagcttcagatgataagagtgaagtttttacgtcttgctcatagactggggcaaactcctcataatgttgttgttgctcaagtgttgtacagattaggcttagcagaacaacttagagcaagaagtgggggccgtgttggggccttcagctttgaccgtgctagtgccatggcggagcagctggaggcggctggacaagaacctcttgatttttcttgtacaatcatggttcttggaaaaacaggagttggtaaaagtgcaa

SEQ ID NO: 507 - DNA, 1501 bp, Amaranthus rudis
cttatgacatgtttgtcactcaacgctcacatgccgtacagcaagttattcgccaagctgctggggatatgcggctaatgaaccctgtttctttagttgaaaaccattcagcctgcagaacgaatagggctggtcaaagagttttgccgaatggtcaggtttggaagcctcatttgctgttgctctcatttgcatccaagatattggccgaagcaaatatacttttgaagctacaggattcaccacctgggaaaccgttcactgctcgtgcacgtgcaccacctttaccattcctcctctcttcacttttgcaatcaaggcctcaattgaaattacctaacgagcagtttggtgatgatgatactttggacgatgatttggacgtatcttccgagtctgatgaagagtcggaatatgacgaattgcctccatttaagcctctaactaaagcccagctgtctaagctgcccaaaacccagaagaaagcttactatgatgagcttgaatatagagagaagctttttatgaagaaacagatgaaggatgacagaagacgacggaggatgatgaagaaaatggcagactccatcaaagaaatgcctagcgagtacagtgaaaacgttgatgaagaatctggtggtgctgcatcattaccagtaccaatgcccgatctagcattgcctgcttccttcgactccgataatcctactcacagataccgttacttggattcatccaatcaatggctagtcaggccagttctcgataatcatggctgggatcatgatgttggttacgaaggtatcaacgtagaacacatgtttgtagtcaaggacaggattcccctgtctttctctggtcaagtctcaaaagataagaaagaagccaatcttcagatggaattagccagctctataaaacatggagaaggaaaagccacgacaatgggtttcgacgtgcagagtgttgggaaggacatggcctacacattacgcagtgagacgaggttcagcaactaccttcgaaataaggcaacagctggtctctcagctactctgatgggtgatgctttatcagctggagtgaagctagaagacaagttaatcatcaacaagcaattgaggatggtaatgagcggtggtgcgatggcaggtcgtggagatatcgcatatggtggaagtttggaagccactttcagggataaagactaccctatcggccgattcctttctactctcgggctgtcaataatggattggcacggggaactcgctctcggatgcaatatccagtctcagatcccgatgggacgatctaccaatctggttgctcgggccaacttgaacaacagaggatctggccaagtcagttttcgtttaaacagctcagaacagcttcagttggcacttattgctttccttcctctgttcagaaagctaatgggcggtcagcgtcaagatcaccctcttgagtattgataaaacaagtgatcgatagcatt

SEQ ID NO: 508 - DNA, 233 bp, Amaranthus rudis
gatgagagggtcctaggccaagaccttggggcctcaagtgtgatcaatgatttagccacggaagagtctcaaggtgaagggtcagaagttgcacctttaaatgttgtggagattgaagctgttgaaggtgatgatgacactgttgataaatctgttgtcttggaggcatcagaaaacagaaatgttaggccaatggatcaaaatgattcgggtgctagcctagccgaggatgt

SEQ ID NO: 509 - DNA, 726 bp, Amaranthus rudis
gttgagttggttaatgaggaggatgctgttgtggattccattaatttggatgttgttgaagcagtaaggtcaggggttgctgttgttcatgtagtagaagaagaaaagctggactctaatgttgagtctgcggaaactgttgttggagataaggatagtgaggtggaatctgaagttcaagtaggggaggaggatacatttgtggttgaagagcctgcgttggatgtgtctgcgtctgttgaaggtagtgaagtgaagttaactgatgagggggattctatcgtggattcaattcgtgtcgatgctggtgaagctttacggtctggagctgccgttgttggggaagtagaggaaacaaaagactcagagagcaaagaaactacagacgttgaaaacaatgttattgaagattttgtttcaacaatggagggtagtgttgcagaaaaacctgctgtagatgagtctgttaaaggtgttgaagttactggggagaagttaattgatgagggggattctatcgtggattcaattcgtgtcgatgctgatgaagctttacggtctggagctgccactgttggggaagaagaggaaacaaaagacttagagagcaaagaaactacagacgttgaaaacaatgttattgaagattttgtttcaacattggagggtagtgttgcagaaaaacctgctgtagatgagtctgttgaaggtactggggagaagcta

SEQ ID NO: 510 - DNA, 505 bp, Amaranthus rudis
ttgaagctgtagaagttgatgatgatgctgttgataaatctgttgtcttggaggcatcagaaaacagaaatgttgggccaatggatcaaaatgatacgggtgctagcctagccgaggatgtcaaagatgtaataacaaatggagacgttgatcatgtcaacgaaacagagaaagaaataggggatccatcagatgacgttcatttccagactccgaaggcgaagcttgatgaaactatttttgggaatttgaaaactgatgatggtgatgtagtttcatcaaccgtcagtgaggagagtgcaggagctgtatccgagaaagttttggacaagatcagtacagagaatgatgatagtaataaggaacttaaagctgaggttttaattcctgagaatcaagatgatgatttaaagatagaggacaagtcgtcagatattagttcttcacttaatgttgaagctttaacttctaaaccagaggtctccactccttcagttggatcctc

SEQ ID NO: 511 - DNA, 1163 bp, Amaranthus rudis
ctctctcgttatacttgggcagacagccatttcgaagcttttttttcccctctttttctctcacccttcaacagtctctttcttttccctacatttgcccaggttatttttattatccttatttatgttctcttaagttattgcttttctatatcattagcttttattgtattttctcttgcattaaaatgtaattaattattttatagatttaatgttttttgcatttgattgaatgacctgctcacaaattccattcttgaatgctcacatgcccatttttgctgagttttttgttttaagaaaaagtgaattttgattgattttgtataaaatacagatgattttatatctgggtgtttttgggttttgggtaattttaggattttgtatcgaagtaccatttcgggatggaaaatcagatgggtgttaataatttatatttatttatatatgattgagtgatctgctataaaatcttgtccttgtatgtttatatgtcctttaattttctggggttgttgaatttctgtgattttcttcgtatagctggctattagggtttattgatgtatcctaaaaaaattagttcaaaagaattcgattggttctgattggtgtatagttgatttaatgcttgggtttttggttaattttaggactttaagaaggtaatattcgaggatggaccatggggtggaacagattgaggaaaatactgcaaaagtgaaggtagttgatgatgggttgacagaatcgaaggaggttagtgttgatgatgatgggttgttggaaacgaatcttgaggaggaagctgttggtgttactgctcatggttataacaactctcaagggtctgaggagtttgaggaggcagttgaattacctttagacaacataaatgatgggtcgaaactggattcagatggtgttggtgttggtgttagtgctagtttggatggggaaaatgatgcggatttttcggctgctgagggaagttcaagattactagatgaaacggagatgactgatgcagtagaggaatttagtgagggaagagatgataatatagagagtaaagagattagggaagaatcaacaatgggaaacggtcacgaggattctgtgatttctgtgagtgatgcagtgttacggatgagaaa

SEQ ID NO: 512 - DNA, 549 bp, Amaranthus spinosus
agttttggctgaaaatcataccaactgtaggaaaaatacctctggcgagagagtacttccaaatggacaggtctggaaacaacatttgctactactgtgcacttgcactaaggtgcttggtgatgctaattccctcttggggctcaaaaacagcattgaacttgggccatctaatagctctcggctgccttcgctgcctcatctgctttcatcttttctccgtcaacgccctcaaatgactgatggagcagatgaagttgatgaacattctatttcagatgatgaagacgatgagtatgagcagttgccacctatacgcattctgacaaaactgcaatttgcgaagttgagtgactctcagaagaaagattacctggatgagctggattaccgagaaattttatttttgaagaagcaaattaaggaagagtcacgcaagaggaaagagagaaagcttttaggggataaaagcatgccaaatgacgacagtacagatggtcatgatgtatctccagaggctgtacagctgcctgattttgctatcccgcc

SEQ ID NO: 513 - DNA, 620 bp, Amaranthus spinosus
tgatgaagaatctggtggtgctgcatcattaccagtaccaatgcccgacttagcattgcctgcttcctttgactctgataatcctactcacagataccgttacttggattcatccaatcagtggctagtcaggccagttctcgataatcatggttgggatcatgatgttggttatgaaggtatcaatgtagaacacatgtttgtagtcaaggacaggattcccctgtctttctctggtcaagtctcaaaagataagaaagaagccaatcttcaaatggaattagccagctctataaaacatggagaaggaaaagctacgacaatgggttttgacgtgcagagtgttgggaaggacatggcctacacgttacgcagcgagacaaggttcagcaattaccatcgaaataaggcaacagctggtctctcagctactctgatgggtgatgctttatcagctggagtgaagctagaagacaagttaatcatcaacaagcaattgaggatggtaatgagcggtggggcgatggcgggtcgtggagatatcgcatatggtggaagtttggaagccactttcagggataaagactaccctatcggccgtttcctttctactctcgggc

SEQ ID NO: 514 - DNA, 760 bp, Amaranthus spinosus
ctcacccttcaacagtctctttcttttccctacatttgcccaggacttcaagaaggtaatattcgaggatggaccatggggtggaacataatgaggaaaatactgcaaaagtgaaggtagttgatgatgggttgacagaatcgaaggaggttagtattgatgatgatgggttgttggaaacaaatcttgaggaggaagctattggtggtactgctcatggttataacaactctctagggtctgaggagtttgaggaggcagttgaattacctttagacgacacgaatgatgggtcgaaactggattcagatggtgttggtgttggtgttagtggtagtttgaatgaggaaaatgatgcggatttttcggctgctgagggaagttctagattactagatgaagcggagatgactgatgcagtagagggatttagtgagggggagatgataatatagagagtaaagagattagggaagaatcatcaatgggaaacggtcacgaggattctgtgatttccgtgagtgatgatggcagtgttacggatgagaaattgttaacggttgatgagagggtcctaggccaagactctggggcctcaagtgtgatcaatgatttagccatggaagagtctcaaggtgaagggtcagaagttgcacctttgaatgttgtggagattgaagctgtagaaggtgatgaggacgctgttgataaatctgttgtctttgaggcatcagaaaaaagcaatgttgggccaacgaat

SEQ ID NO: 515 - DNA, 1146 bp, Amaranthus thunbergii
ctagtgccatggcggagcagctggaggctgctggacaagaacctcttgatttttcgtgtacaattatggttcttggaaaaacaggagttggtaaaagtgcaactatcaattccatatttgatgaggtgaagtttggcacggatgctttccaaatgggtacacagaaggttcaagatgttgtgggtactgtgcaaggaattaaggtgcgggtgatcgatactcctggacttttatcatcttgctctgatcagcataagaatgagaagatccttcactccgtgaaacgtttcattaagaaatctcctccagatattgtgttgtaccttgataggctggatatgccaagtagggatttcggtgatatgccgttgttgaggactataacggagatattcggaccatctatttggttcaatgcgattgttgtcttgacccatgctgcatcagcacccccagaagggcctaatggtactccttcaacttatgacatgtttgtcactcaacgttcacatgccgtgcagcaagttattcgccaagctgctggtgatatgcggctaatgaaccctgtttctttagttgaaaaccattcagcgtgcagaacgaatagggctggtcaaagagttttgccgaatggtcaggtttggaagcctcatttgctgttgctctcatttgcatccaagatattggccgaagcaaatatacttttgaagctacaggattcaccacctgggaaaccgttcactgctcgtgcacgagcacctcctttaccgttcctcctctcttcacttttgcaatcaaggcctcaattgaaattacctaatgagcagtttggtgatgatgatactttagacgatgatttggatgtatcttccgagtctgatgaagagtcggaatatgatgaattgcctccatttaagcctctaactaaggcccagctgtctaagctgcccaaagcccagaagaaagcttactatgatgagcttgaatatagagagaagctttttatgaagaaacagatgaaggaagacagaagacgacggaggatgatgaagaaaatggtagactccgtacaaagaaatgcctaacgagtacaatgaaaacgctgatgaagaatctggtggtgctgcatcattaccagtaccaatg

SEQ ID NO: 516 - DNA, 514 bp, Amaranthus thunbergii
cgttgatcatgccaatgaaacagagaaagaagtaggggatcctttggatgacgttaatttccagactccaaaggagaagcctgatgaaacgatttttactaatttgaaaactgatgatggtgatgtagtttcatcaaccgtcggcgaggagagtgcaggagttgtatccgagaaagttttggacaagaccagtacagaaaatgatgatagtattaaggaacttaaagcagaggttttaatccccgagcatcaagatgatgatttaaagatagaggacaagtcgtcaaatactagttcttcacttaatgttgaagctttaacttctaaaccagagatctccactccttcagttggatcctcgtcgaaggagataaaaacgagagtgcttcttctaattcgggaactcaaaataatgctgttaatgagatgccgtcttctgggccagttggtcgtgatagcaatgctttagaaggaaataaaaatgagcaggagaaaccaaacagtcgagcaaggg

SEQ ID NO: 517 - DNA, 1089 bp, Amaranthus viridis
attaaggaacttaaagcagaggttttaatccccgagcatcaagatgatgatttaaagatagaggacaagtcgtcaaatactagttcttcacttaatgttgaagctttaacttctaaaccagagatctccactccttcagttggatcctcgtcgaaggagataaaaaacgagagtgcttcttctaattcgggaactcaaaataatgctgttaatgagatgccgtcttctgggccagttggtcgtgatagcaatgctttagaaggaaataaaaatgagcaggagaaaccaaacagtcgagcaagggaggaaacaacagttaagcctgcagaaaaatcatctgctgcatctgggaagtctgcaactccttctgttcgtcctgcacaacctgctggacttggacgtgcggccccactcttggaacctgcagcaagaacagcacatcattcacgggttaatgggcaagcttctcaggcacaaatcaacagtgctgaagacactacaaacggggagattgaggaaggtgatgaaattcgggagaagcttcagatgataagagtgaagtttttacgtcttgctcataggctggggcaaactcctcataatgttgttgttgctcaagtgttgtacagattaggcttagcagaacaacttagagcaagaagcgggggccgtgttggagccttcagttttgaccgtgctagtgccatggcggagcagctggaggctgctggacaagaacctcttgatttttcgtgtacaattatggttcttggaaaaacaggagttggtaaaagtgcaactatcaattccatatttgatgaggtgaagtttggcacggatgctttccaaatgggtacacagaaggttcaagatgttgtgggtactgtgcaaggaattaaggtgcgggtgatcgatactcctggacttttatcatcttgctctgatcagcataagaatgagaagatccttcactccgtgaaacgtttcattaagaaatctcctccagatattgtgttgtaccttgataggctggatatgccaagtagggatttcggtgatatgccgttgttgaggactataacggagata

SEQ ID NO: 518 - DNA, 1117 bp, Amaranthus viridis
tggtagactccgtcaaagaaatgcctaacgagtacaatgaaaacgctgatgaagaatctggtggtgctgcatcattaccagtaccaatgcccgacttagcattgcctgcttccttcgactctgataatcctactcacagataccgttacttggattcatccaatcagtggctagtcaggccagttctcgataatcatggttgggatcatgatgttggttacgaaggtatcaacgtagaacacatgtttgtagtcaaggacaggattcccctgtctttctctggtcaagtctcaaaagataagaaagaagccaatcttcaaatggaattagccagctctataaaacatggagaaggaaaagctacgacaatgggtttcgacgtgcagagtgttgggaaggacatggcctacacgttacgcagcgagacaaggttcagcaattaccatcgaaataaggcaacagctggtctctcagctactctgatgggtgatgctttatcggctggagtgaagctagaagacaagttaatcatcaacaagcaattgaggatggtaatgagcggtggggcgatggcgggtcgtggagatatcgcatatggtggaagtttggaagccactttcagggataaagactaccctatcggccgtttcctttctactctcgggctgtcagtaatggattggcacggggaacttgctctcggatgccatatccagtctcagatcccgatgggacgatctacaaatctggttgctcgggccaacttgaacaaccgaggatctggccaagtcagttttcgtttaaacagctcagaacagcttcagttggcacttattgctttccttcctctgttcagaaagctaatgggcggtcagcgtcaagatcaccctcttgagtattgataaaacaagtgatcgatagcattatgcgcgacaataggaagtaagttcgacaatagcttgtcgtcaatatttagcagtgagtaatctcttccaatcctcttttctttggttttccatagcctattttaattccttgttagatatatgcgtgacctttatgcgtttaagattgaaaactcaagttcatgatcttagtgtagctttgctactttcga

SEQ ID NO: 519 - DNA, 2847 bp, Ambrosia artemisiifolia
ttccaaacctaccactgcactcacccccaccccagctccatccccacccccaactcgtcctgctggtcttggcagaggtgcaccgctactggaaccggcacaccgtgtggttcaatctcaaccaaacggaaacacttctctgcaaaaccaagtcattgatgaaccaacgaatggggagcctgatgaaaataatgacactcgtgaaaagctccagatgattcgggtcaagtttttgagacttgcccgtaggcttgggcagacccctcataacgttgttgtggcacaggtcttatataggctaggtttggctgaacaaataagaggcagcaacggaggccgtgttgctgcttttagctttgagcgtgctagtgctatggctgagcagttggaagcagctggtcaagaaccacttgagttctcgtgcactatcatggttcttgggaaaactggggttgggaaaagtgcaaccattaattctatatttgatgaagtcaagtttggaactgatgcgtttcaagttggaacaaagaaagttcaggatgttgttggaaccgtgcagggtatcaaggttcgtgttattgacacaccaggccttttttcttcatgggctgatcaaaggaaaaacgagaaaattctcaattctgttaaacggtttattcaaaaatcacctccagatatcgtgttatatcttgatcgtttggacatgcaaagtagggattttggtgacatgcctcttttgagaaccataactgatatatttggtcagtctatatggtttaatgctattgtggtcttgactcatgctgcatcggctccacccgaaggcccaaacggtacagctactagttatgacgtttttgtgacccaacggtctcatgtggtccagcaagccattcggcaggctgcgggtgatatgcgtctcatgaaccctgtttcattagtggaaaaccattcggcatgtagaacgaatcgggctggtcaaagggttttgccaaatggtcaagtgtggaagcctcatttgttactactttcgtttgcttcaaagattctggttgaagctaatatgcttttaaagttgcaagactcgccacctggcaagccgtttgtaacaagaactagagtaccaccgttaccgtatattctttcaaatcttttgcaatcgagacctcagctgaagttacctcaggagcagtttggtgatgatgatgatgacggtggtgacatggatgagtcatctgatgaagagtcatcggagtacgatgaattaccaccgtttaagcggttgaccacttctcaagtgtcaaagcttagtaaggcacagaagaaatcatattatgatgaattggaatacagagaaaagctctttatgaagaaacagttgcaggaagaaaagaaacaaagaaagatgatgaaaaaaatggcagaagcagccaagaattatccaagtgatttaactgataataatgtagaagaagacagtcacggtgctgcaacagttcctgttgctgctcaagatatgaatttacctgctacatttgatgcagataacccaacccatcggtaccgggctcttgagtctgctaaccaatggctcattagacccgtgcttgacccgcatggctgggaccatgatgttggttatgaaggaatcaacgtggaacacttgcttgcactcaaagaaaagatacctgtgtcactttcaggtcagattaccaaagataaaaaagatgctaatctccaaatggaggtatcaagcgcattaaaacatggaaaatcaaagtcaacaactatagcattagatatgcagactgttggaaaagaaatgtcctataccttaagaagtgaaacccggttcattaattacagaaaaaacaaagcatcagctggtctttcagctacttacatgggtgactcgttaaccggtggtgttaaatttgaggacaagttaatgattaataaacgaggggagttagtggtggcaggaggagcggttattagtcgtggtgatgtggcttacggtggcagtttggaggctacattaagagataaagattatcctttgggtcgatttttgtctacaattggtctctcggttatggattggcatggtgatttggcacttggttggaacgcacagtcccagattcctattggtcggtttactaatttgattggccgtgttaatttaaataataagggttcaggtcaagttagtgttcgtttaaatagctcagaacagcttcaaattgcattagctgccttagttccacttgtcagtaagctattggggtattatcaggatcgcaattctgcatattgatcacatatttttgacttgagaatgaagaaagttattttggtttagcgctgctcgggtgcagtcttttgaccaatatgtgaagtaaagctttcattaacttacttgccttctgtgtctaatcttcttgtattaacataatacagtttcttgcaggttggcccgatcgctgaaataatagccaaaaagatggcgcaaatgttttgcaattctgggaaaagagtaggtaaaaatgcacaaagaatgtagcggtagagctagattttgagcaaatcccatgctgttagtttttctaatttatttttgtcttgtttttgaagctcttattgatatagagatgttcgttcgtgacttcttgttagaatgggaccgagtttagttattgtattatacgtataatggacatgcgagtgatgaaggtctaaatatggtgaatttggggctatggttgtgtctgttccttgttttatgttgcattttgctgaaaagaaaaataaatattttgccaatttttggtcatatttaaagag

SEQ ID NO: 520 - DNA, 1211 bp, Ambrosia trifida
ggcagaagcagccaagaattttcctaagtgatttaactgataataatgtagaagaagacagtcacggtgctgcaacagttcccgttgctgctcaagatatgaatttacctgctacatttgatgcagatagcccgacccatcggtatcgagctcttgattcagctaaccagtggctcactagaccggtgcttgacccacacggctgggaccatgatgttggttatgaaggaatcaacgtggaacacatgcttgcactcaaagacaagatacccgtgtcgttttctggtcagataaccaaagataaaaaagatgctaatctccaaatggaggtatcgagtgcattaaaacatggtaaatcaaattcaaccaccgtagcattcgatatgcagactgttgggaaagagttgtcttatacgttaaggagcgaaactcggttcattaattacagaaaaaacaaagcatcagcggggttttcagcgacttactttggtgattcgttaaccggtggtgtgaaattcgaggacaaattaattattaataaacgcgggcagttggtggtggctggtggagcggttattggtcgtggtgatgttgcttatggcggcagtttggaggctactttaagagataaagattaccctttaggtcggtttttgtcaactattggtctttcggttatggattggcatggtgatctggcacttggatggaatgcgcagtctcagattcctatcggccgatctactaatctgattggccgtgttaatctaaataacaagaattctggacaagttagcgtccgtttgaatagctcagaacagcttcaaatcgcattagtcgccttagttccacttgtcggtaaactattgggtttttttcaaggtcgagattcagcatattaatcacatattttgcgttcccgattgaagaaatttagatgtggtgtatgctgagaagcgtaatcttttgatgatcaacatgtcggccgaatcttgaaataactagcgaaaagaaggcgcaaatgttttgggaaagagtatttaaatgcacaaaaggctgtagtggtagagctagatttgaagcaaaatcaccatgctgctggtaatcctttttatttctttttgtgtttaatttcttctcagtatagagatgttctggttagaattggggcgtacgagtttagttattgtattatacgtatgatgagtatg

SEQ ID NO: 521 - DNA, 4407 bp, Ambrosia trifida
gagagcagcggctacaaaccatttcattcatgtccttgaacaaaaccttatctcgctccatatctaaatccttatccttcacaactcttattattatcattcataaaccctaactaattatccaattcccttcttttattcctttcaattacacctaccctatccattacagaatcatccatggacatcaaggaagacacgtctctctcaggttcttctgtttccgtttcttccaatacaattgtaactgaatctgttattgatagaaatgatactagtatggatattattaaggatagtagtagtggtttggctttgaatgctgttggtggttctgatgatgaaaacgagggttttgttagtggtcaggatgaggcttttgaaacggttattgataatttagaaaccctacctaatgtagatgaaggtgtaggtgtaggtgaaggtgtgtgagacttttttggagccttctgaatttcctaaggttgataatgatgaaattgataatattgggttggttgagaagaaattgagtccgagtccgagttcggttgtgacggaaccgaattcgaatgcggttgtggttgaaagtgaaggagataaggttagtgaaaaaaatgaggaattgaaatctgtagatgaaaaggaggtggttacggttacggatacggatacggatacggaacaggtagaggttgaggttgaggttgaagatgatgaagatgaggatgtgttgttagttggtggctctgatgaaagtaatcctgttgttgaaatacctgttttagaatctgatgtgaacgttagttcgggaggtggttctgttgtcgatgttggtaagcctgttgttgttgaaacggctgagttagagtctgatgttgcgaaagatgtgaaggtgacgtctgaaggtgagtctgttgtggaagggatggatgttgatttgccggtagtggcgggagtggcggtggttactaaggttgaagatgaaaaacctgaggtggaagctgttgatgtggaggatgtgaaggtgacttccgaaggtgatacggttgtggaaactgtagatgttgatttgccgttaccgggagtgggtggggtggcggtggttactaagaaggaagaagatggtggtgctgtggcggaaactgatgagtctggtttgtcggagaaggtgagttctgttttggaagaagtggtggataaggaggttgttggagtaactgatagcaagttttcgcctttggatgttgaagatgtagagaaggaggttgattatgcgggtcaggaaaacgagccagtggtggtcaaggctgctttgaatgatgtggaaaatgtttctgttgctggtttggagggagatgcagctcagtcaacagaagttttgaacaaagctttgcctgaagatgcagattatggtctagaaaacggggcggctgacaaatttgttctagaagaatctgcagaaaaagatgatgttgatgaacaaggctacacggatggttcccattccgacgatggggacacagatgaggtagaatttgaaagctcagcagctgctaagcagtttatagaggggttagaaggtggtggtgagagttctcaagatcgttcacaaatggacggtcagatcgtcacggattcagatgaagaggatgatgaagaagacgggaaagagctctttgattcggctgctttagccgcccttttgaaagcagcggctgatggcagttcagaaggtggcaacattacattctcttcagaagatggttcaagacttttcacagttgaacgccctgcaggtttagggccttcgctccaggccatgagagctgtcccgagaccaccccgtgccagcatttttaacccttcaagtctaatgagtgctaatgaaacagagccgaatttaagtgaagaagaaaagaagaaattggagaagttacaatccatcagggtgaagtttttaagactcgttcaaagattagggctttcaccagatgaatcggtggctgcacaggttctttacaggctggcacttattgcgggtcgacaaacgggtcaatcttttagtcttgatgctgctaaacgtaaagctatggagctagaagctgatggagatactgacctggacttctctgtcaatattttagtcatcggtaaagctggggttggtaaaagtgctacgataaactccatttttggtgaagaaaaaaccccagtcggcgcttttcaaactgcaactggttcggtaaaggagataactggtgtggtaggtggagttactgttcgggtttttgacacacctgggctacgcacctctgtcatggaacaagcgtttaacaggagcgtattgtcctcagctaaaaaattcacaaagaaaaacccaccagatattgttctctatgtagaccgtttggatgcccagacccgagatcataatgatattccattactgaaaaccattaccagctcgctgggctctgccatttggcgaagtgcaattgttacttttacgcatggtgcgtcggccccaccagaggggtcaaacgggaaccctttgagttatgaaatgtttgtgacccaaaggtcacatgtggttcaacaagctattggtcaagcggttggtgatttgagaatgatgagcccgggtttgatgaacccagtttctttagttgaaaaccaccagtcttgccgtaaaaatcgtgaaggtcaaaaggtgcttccgaatggtcaaacctggcgcccacagctgcttatgttatgttactcgataaagattttatcagaagcgaattctttgactaaaccacaagatccgtttgacagccggaagcttttcgggtaccgcatgcggtctccgccactgccgtacatgttgtcttcgatgttacagtctcgggctcatccgaagctagcaacggatcaaggcggtgatgtgggtgattcagagattgacctggtggatttgagcgattctgaccctgaagaagatgaagacgagtatgaccagcttccccctttcaaaccgttgaaaaaatcccaacttgctaagcttagtaaagagcagaaaaatgcttactttgatgaatacgattaccgggtcaagctgttgcagaagaaacaatggaaagaagaactaaaaagaatgaaagaacttaaaaagaaaggacctgatggtttggctggtcaaaattaccaggaagaagaaggtgaaggagacgcaccagcacccgtggcggtcccgttacctgacatggctttaccaccgtcttttgatagtgataaccccgcataccgattccgtttcctggagcccacttcgcagtttatggcccgtccggttcttgatacccatggttgggaccatgattgtggttatgatggagtcaatgttgaacaaaccttagccattgccaaccgttttccggctgcaattaccgttcaagtcactaaagataaaaaagacttcagcatcaatatggattcatctatttccgctaaacacggagagaacatgtctactatggccggtttcgacgttcaaccaatcgggaaacagctggcctacatagtcagaggcgaaaccaagttcaagaatttgaagaaaacaaaaccgctgcagggatttcagtcacatttctgggagaaaacactgtaaccgggtttaagcttgaggatcaaattgcacttgggagacaatactcgatcattgggagtgcaggcacagttcttttccaatccgattcagcttatggtgccaacatcgaggtccaacgacgggagctggattacccgatcggtcaagttcagtcaactatcgggttatcgatcataaaatggaggggcgatttggcgttagggttcaacagtttggctcagttctctgctgggcggaactcaaaagtgatggttcgagccgggattaacaacaaaatgagtgggcaaatcacggtgaaaactagcagctcggaatatctttcacttgcacttgcagcagttattccttctgttatatcggcttacaagaagttgcggtcaggtgctggtgacggtgacaaatactctctgtattaagttctctgcagggggaactctaaagtggcggttcgagccggattataacaataaaatgagtggtcaaatcttggtgaaaactagcagcttagaatatctcacttgcacttgcagcagttattccttatattattttggcttacaaaaaattgcggtctggtgctggttacaaatcctccccatatcaaggttagcacttagcaggcttttgcgttcgggcttatttggtatttttaagattattgtttttggtattatcgaataatatgcttaatgtactttattcagcagttgaaaacttttgtttaattttggtgcaatgagatgaaattacga

SEQ ID NO: 522 - DNA, 762 bp, Avena fatua
acagaatgtatttcttcgaggtatatttatttatggcaccctttctcatctaaacctgaagcgaggaagctctagctgttacgttccattgaaacaacatgcattacacacatagtacattgtacatcacatcatcaaattacagcaccgtaggcgccggagcattaatcgatccgttacatcgatcgcctctagccgatgatctggtcgaggacgccggtgttcttgaggccgagcacgatgccgacgcccaagatgtggccgacggagccgcaggcgagcgtgtcggcgagcgtgaacccggccgggtcgccggtctgtagcccggactcgcgggcctccagcttcaaccccgccgtcgccttccggttcgccgacggcgccagcccgaaccgcccggcgaacagcatcagcgtcgtcgtcgtgatcatgatgaggttggtggatgagccgatgtagtcgcaccggatgccctgggacctcttcctcagcgacggcagcgtcgccatggaccttggggaggagtaggtccggaggccgtggaactgcggcacggaggtcatggcggagagctgggaagccatggccgcgtcggatttcctgtgttccggatactgcgattgctcctcctgaaggcctcaatggtgcccctatgacatatgaggtattaatggcgcagcgatcccacattatccagcaatccatcaggcaggctgcaggggatatgcgtctgatgaaccctgtagcccttgttgagaacca

SEQ ID NO: 523 - DNA, 461 bp, Chenopodium album
accccaccagggaaaccattcactactcgttcacgagcaccacctttgccttaccttctctctacacttctgcaatcaaggcctcagttgaaacttcctgaggagcagtttggtgatgatgatgctatggatgatgatttgtgtgaatcgtctgagtctgatgaagagtcagaatatgatgagttgcctccatttaagcctttaactaaggcccagctggataagctgcctaaagcccagaagaaagcttactatgatgagctagaatatagagagaagctttttatgaagaaacagttgaaggaagatagaaggcgacggaagatgatgaagaaaatggcagccgcagccaaggacatgcctagtgagtacagtgaaaatgttgaagaagaatctggtgctgctgcatcactacctgtaccaatgcctgatctggcattacctgcttcctttgactcaga

SEQ ID NO: 524 - DNA, 573 bp, Chenopodium album
ttcagatgatgttgatgttcgtagtattgctattggggagcgtgatgcagattttgccgctgctgaggggagtccgagaccgttagataaagtggagaagactgaaattgcagtagaggggtccagtgaagggagagatgacaatgacgcgagtgtggagaagactgaaattcccgttgtggagtccggtgaaggtagagatgacaatggcgtgagtagtgtggagaagactgaaattgcagtagaggggtccagtgaaaggaatgatggcaatggcgagagtagtgtggagaagactgaaattgcattggaggggtggggagagatgacaatggtgagagtgtggagacgagggatgaatcattggtgggaaatagtggtgagggctctgtgactattgagaataatgatgatggtgtaacgaatgaggagttatcaaatgttgatgagagggttcttagccaagatgtcgctgtaacgaaagagtctcaaagcgaagaatctgaagcttcaccattgaatgttaaggagattgaagctatagaaggtgatgaggacactgttgagaaatct

SEQ ID NO: 525 - DNA, 636 bp, Commelina diffusa
catgcaaactgtagggaaggacattgcatacacagtgcgtggtgaatcgagatttaccaattttaggcgcaacaacactgctgctggagtttcagttactgttcttggggatacagtgtcagctggtctgaagattgaagacaaactaatagttaataaaaaggttcagaatgctgatgagtggaggtgcaatgactggtagaggtgatgtagcctatggagggcggcttgaggcaacattaagggacaaagattatcccattggacggtttctttcaactattgcactttcagttgttgattggcatggtgatctcgctcttggctgtaatcttcagtctcaactgccagtaggaagaggtactaatgtggtacttcattcaaacttgagcaacaaagggacaggtcaggttggtgttcgcttgaatagctcagaacaccttcagttagcgcttgttgccctggttccagtattgaagaatgtcttgcgaatgatgtctggttcttctcagtctatgtaacctgcaaggttccaagttatgcttttctactttctaaagtgccatacaatgtccaggtaaagtttagttcttctaagtggcacctaattataattttcatcaagctgtgctttta

SEQ ID NO: 526 - DNA, 2317 bp, Convolvulus arvensis
tggctgttgacctggctgtatcaaagctaaaagcgttggctgttttgccttcctgcaatgagtgacaaccggtacagaacctgagtagctatggattcatctgaagagaagcccaacctctgaacaagtctcagaaattttactctaattttctgcagttgctcaagcttctttttttcttcttcactcaagttgttctcagattcggaagtatttgaaagagccggagtaaaaagactggaacgattcgatgggggagcagctctcagagaacggagtgatgatcccaaaccagcgggacgttccactgtgaatagcttagatccatcctgagaggtaattgtgatattaccaccattggggtcagcacctgttgcagcttgcaatagagcagctaggggaatgatgatctagacttctctgtgaatatactagttcttggaaagtctggagtgggaaagagcgccaccatcaattctattcttggagaagagatggctccaattaatgcatttgcacctgcaacaactagtgtgaaagaaatctgtggaaatatagatggagtcaagattcgggtctttgatacacctggtctcaagtcctctgctatggaacaggctttcaatcgcagtgtcttgtcaaaagttaaaggcttcacaaagaagaatccaatagatattgtcctctatgtagaccgattagacgcacaaaccagagatcttaatgatctacccctgctgaagactatcacgagcacacttggctcttctatttggaaaagttccattgtcaccctgacacatgcagcttccgcacctcccgaggggccttctggttctcctttgagttatgaggtgtttgttaatcaaaggtcacgtgttgttcagcagtctattggccattctatgggagatctacatatgatgagtccaagtatgacgaatcctgtttctctcgttgaaaaccatcctgcttgtcggaggaatagggagggcaagaggatactaccaaatggccagatttggaaaccacaattactgttgttatgctattcaatgaagattttggccgaagcaagttctctttccaagcctcaagatccatttgaccaccgcaggctatttggtttccgggcccgtgcaccacctcttccatacatgttgtcttcaatgttgcagtctcgtgcacatccaaagctgtctgctgaacagggcggtgataatgttgactctgatattgacttggatgatttttctgattccgaggatcaagaaggagaagatgagtatgaccagcttcctccctttaagcctcttcgaaaagctcaaattgcaactcttagtaacgaacaaaggaaggcatactttgacgagtatgactatcgagtgaaactcctccagaagaagcagtggagagaagagttaagaagaatgagagagatgaaaatgaggggcaagagttctgctgcacttgactatggcaacaatgacgaagatacccctgctcccgtggctgttccgctacctgatatggtccttcctccttcctttgacggtgataaccctacatacaggtatcggttcttggagtctacttcacagtttctagcaaggccagttttggatacacatgggtgggaccatgattgtggctatgaaggtgtcaacattgaacacagtcgagcaattgcaactcgtttccctgcagcaattactgtccaagtcacaaaagacaagaaagatttcactataagcttagattcttctgtttctgctaagcatggagagaacggatcgagcatggcaggttttgatattcaaaacattggaaagcagcttgcatatattgttcggggcgaaacaaagttcaagaatctgaaaaagaacaagacagctggtggaatatcggttacttttctcggtgaaaatatagtaaccgggcttaagctagaagatcagattactttcggcaaacagtatggtctggttggcagtgcagggatggtgaaatcgaatcaggatacagcgtatggagccaatattgaactgcagagaagggaagccgattacccgattggtcaggttcaatcgaccgttagtatgtctctgattaaatggagaggggatttcgctatgggattcaacggtttggctgaattttctactggtcggaactcaaaggtggctgttcgggcaggactaaacaacaaaatgagcggtcagatctcggtgaggactagcagctcggaccatctctctctcgcactctcagctgtccttccagttgcaattgccatctaccggaagctttaccctgc

SEQ ID NO: 527 - DNA, 2317 bp, Convolvulus arvensis
gcagggtaaagcttccggtagatggcaattgcaactggaaggacagctgagagtgcgagagagagatggtccgagctgctagtcctcaccgagatctgaccgctcattttgttgtttagtcctgcccgaacagccacctttgagttccgaccagtagaaaattcagccaaaccgttgaatcccatagcgaaatcccctctccatttaatcagagacatactaacggtcgattgaacctgaccaatcgggtaatcggcttcccttctctgcagttcaatattggctccatacgctgtatcctgattcgatttcaccatccctgcactgccaaccagaccatactgtttgccgaaagtaatctgatcttctagcttaagcccggttactatattttcaccgagaaaagtaaccgatattccaccagctgtcttgttctttttcagattcttgaactttgtttcgccccgaacaatatatgcaagctgctttccaatgttttgaatatcaaaacctgccatgctcgatccgttctctccatgcttagcagaaacagaagagtctaagcttatagtgaaatctttcttgtcttttgtgacttggacagtaactgctgcagggaaacgagttgcgattgctcgactgtgttcaatgttgacaccttcataaccacaatcatggtcccacccatgtgtatccaaaactggccttgctagaaactgagatgttgactccaagaaccgatacctgtatgtagggttatcaccgtcaaaggaaggaggaaggaccatatcaggtaagggaacagcaacgggagcaggggcatcttcgtcattgttgccatagtcaagtgcagcagcactcttgcccctcatcttcatctctctcattcttcttaactcttccctccactgcttcttctggaggagtttcactcgatagtcatactcgtcaaagtacgccttcctttgttcgttactaagagttgcaatttgagcttttcgaagaggcttaaagggaggaagctggtcatactcatcttctccttcttgatcctcggaatcagaaaaatcatccaagtcaatatcagagtcaacattatcaccgccctgttcagcagacagctttggatgtgcacgagactgcaacattgaagacaacatgtatggaagaggtggtgcacgggcccggaaaccaaatagcctgcggtggtcaaatggatcttgaggcttggaaagagaacttgcttcggccaaaatcttcattgaatagcataacaacagtaattgtggtttccaaatctggccatttggtagtatcctcttgccctccctattcctccgacaagcaggatggttttcaacgagagaaacaggattcgtcatacttggactcatcatatgtagatctcccatagaatggccaatagactgctgaacaacacgtgacctttgattaacaaacacctcataactcaaaggagaaccagaaggcccctcgggaggtgcggaagctgcatgtgtcagggtgacaatggaacttttccaaatagaagagccaagtgtgctcgtgatagtcttcagcaggggtagatcattaagatctctggtttgtgcgtctaatcggtctacatagaggacaatatctattggattcttctttgtgaagcctttaacttttgacaagacactgcgattgaaagcctgttccatagcagaggacttgagaccaggtgtatcaaagacccgaatcttgactccatctatatttccacagatttctttcacactagttgttgcaggtgcaaatgcattaattggagccatctcttctccaagaatagaattgatggtggcgctctttcccactccagactttccaagaactagtatattcacagagaagtctagatcatcattcccctagctgctctattgcaagctgcaacaggtgctgaccccaatggtggtaatatcacaattacctctcaggatggatctaagctattcacagtggaacgtcccgctggtttgggatcatcactccgttctctgagagctgctcccccatcgaatcgttccagtctttttactccggctctttcaaatacttccgaatctgagaacaacttgagtgaagaagaaaaaaagaagcttgagcaactgcagaaaattagagtaaaatttctgagacttgttcagaggttgggcttctcttcagatgaatccatagctactcaggttctgtaccggttgtcactcattgcaggaaggcaaaacagccaacgcttttagctttgatacagccaggtcaacagcca

SEQ ID NO: 528 - DNA, 821 bp, Conyza canadensis
ctctctcttgttttttaatctcagacctacgttatatgatggggggaagttcaattgatgacgattgggagttcacttcgcctttgaatgcgcttcggactcttgttttggttggaaggacaggtaacgggaaaagtgcaacagggaatagcatccttggaaagaaggaatttttatccagggctagctcggctggtgtaacgagtacgtccgagctcaggacaactgtactgaaagatggccagatgcttaatgtgattgatactcctgggttgtttgattcttctgttgacactgagtttattggcaaggagattgtaaaatgtatcaatatggccagggagggtatacatggtgttcttgtggtgctctcagtccggaatcggttttcagtagaagaagaagctgcaataagtagcctgcgtactttgtttgggagcaagattaatgattatatgatagttgtttttaccggtggcgatgaacttgaagataatgagcagactttggaagatttcttagaagattgtcctttatcgttaaaggaaacccttgccatgtgtggagatagatatgtcgtgttcgataacaagacaaaagatcaacagaagaaaacactgcaagtgcaagaactcctgtctcttgtcaacatggtgctgacaaagaataacggaaagccatacaccgatgagatcttcagtgaattgaagagagggactaagaagcttcatgaacaaacagaagaggttcagtctttacaagggtacaccaaaaaggaaatatccgagctgacagagcagatgcataggtcatatgaggaa

SEQ ID NO: 529 - DNA, 558 bp, Conyza canadensis
ctgaagaaagaaccagagtcgagacaggttataggtgtttcattatctgcacagaaacctgcaattcccacttctgtagctaatcccaaacaggataaaaaacctaatcaaacccccattccaaatcctaaacctatcactgcacccactccagctccatctccatctccatctccatctccatctccagccccttctcgccctgctggtcttggtagtggcgcaccgctactggagccggctcatcgtgtggtggcacctcaggcaaatgggaatggcccccctcttcaaaatcaagtgatcgatgaaccaacaaatggggaggccgaggaaaatgatgacactcgtgaaaaactacagatgatacgggtcaagtttttgcgtcttgctcgtaggcttggtcagactcctcataatgttgtcgtggctcaggtcttgtatagactaggattggctgaacaacttagaggcagaaacggtggccgtgttgctgcatttagctttgaacgcgctagtgccatggctgagcagttggaggcagctggacaagaaccactt

SEQ ID NO: 530 - DNA, 887 bp, Conyza canadensis
gagtggccattaccggggacagttggtggtggcaggtggagcagttattggtcgtggtgatgttgcttatgggggcagcttggaggctacattaagagacaaggattatcctttgggtcggtttttgtcaactattggtctctcagttatggattggcatggagatcttgcacttggatggaatgcacagtctcagattcctattggcagatttactaatctgattggtcgtgttaatctaaataacaagggttctggacaagttagtatgcggctgaatagctcagaacagcttcagattgcattagttgccttggttccacttgtgagtaagttattgggttattatcaggaccgggatacaacgtattaatgtcatatttttgggttgaagaaagttctgtagtataagcttcaggagggcaatcgggctgattaccaacatatcggcccggatctttgaaataattgccaaaaggaaggcaggaatgttttgtcattctaatggaaaaagttggtaaatgcacagactgtagctagagctagatttcgagaaaatttccatgctgctggttcccttttttccgtcttcattttcatctttgctttcttcttgatatagagatgttctgattagagttgcgaccaagtttagttattgtatcatacacataatgccataatgagcatgtgactcaaggttttaatttcctttagtggacaggacttctttttgtagtttgcgaaatttgtttggcttacaacgttatggtgaattggggcctgttcgggttggggcagtggttttagctgttatttgttatatattgtattttgccaaaaaaaaaagaaaaaaaaacaaaacatgtcggccgcctcggtctcta

SEQ ID NO: 531 - DNA, 8073 bp, Conyza canadensis
  unsure (1)..(8073): unsure at all n locations
tgtaattccatgtcgtgctgtacttttcatgacanntcatgtttccgccaacggtgggatgttacaccataataaaatcttaaccatcgtaagttttgtagaataactttacacacgctagtatgagattcacaatgaattgtaacaaaaatgaatacaagaacaagattactttgttttgtttgattgatagttatgaaaaaataacgctcaacgataaacaatcaaacagagccaaagttataactaaacaaaacataaagagaagctccatcaacatttgtcaaaacattcccataatagaaaaacttagatttcgtcattgggatttagcccaactgaacatttaatacccttatgtctttcagccaaatgttggtcacaggtttgaaacatttgaaagacatattgggaagtccttgccaataaggtggggcatgaaagttttctttagcatttagctagtttactcaagaatggtagtgagacttctaccgccagtcatgccttcggattgactgtgctggtgacgtagtcggtctttaccgaatgatgaagaggcttgccgctaaatacaatcactgccgttgttaaaaaaaagaaaagaaaaacttagatttcaggaaaaacagtaatccactaaggtgggatataaatcattgttttggctagcttgtttattcaatgtgacattaattatcacttttattagtttgaaaattttatcaattagttttatagatttcaaaattatatttttattaacataaggtgtttacttattttaagattgaacgaaaaataacaaagataatgtggatttttaacttaatagtacaaattgaaattttaaaatgatgagttggaattaaaaataaaaaataatacaataaataaaaataaagtttttaaaaaatatgttaggttaaagaattgctcctttgaataataaatctaaatattgcattagagattatctacaataatttgatgtagatttaccctaaaaaactaaaaattaaatttattaattaacttcttaaaagattagtttagatatctttaaaaagctaaaaattagatttattaacttcttaaaaaaaaaaaaataatgtaaatttttgtattgtgtaaaacaagttactgtaagtgttggtgtttgagtagccacgcgattcctgacgtcttatccccaaaacccaaattaattaatattataaaaaccaactaaccccttccctccgaacccgatcacaatttcgtcttctttaaccccaactttaaacccctttaaatctctctcttgttttttaatctaaggtactttttattttcttataatttccgcagtctttttaagctattataaattgtgtatatattattgtctgatgatttgtatttttactgttcgtgctattattagggtttatatatggattttagctgtgttatatatgtttatttttttatttttttttatcttctgtatgattaaatatcatatatttgatcattgatagatttagttcagcaagttgataaatttcaataagctgcttatttattatataccttatggccttaaagctcttaactttttggtaaagcattgttttactcggttagcataacgatgaagtttgttcgaggctatagtttgaatgtttacatcggtgttatgttttatatagagcatacttgatcacatgactttgtgtataaggatagaattgtaactaacggaaagtttccgttatagacctacgttatatgatggggggaagttcaattgatgacgattgggagttcacttcgcctttgaatgcgcttcggactcttgttttggttggaaggacaggtaacgggaaaagtgcaacagggaatagcatccttggaaagaaggaatttttatccagggctagctcggctggtgtaacgagtacgtccgagctcaggacaactgtactgaaagatggccagatgcttaatgtgattgatactcctggtattgacgttattttgaaatacccgattaagattatatagtgcttatggttttgctgttaatctgttgtttgcttgaaatataatcgacggtttgcagtgtatgtttttaaaaaactaagatagttgtttactgatgcagaacgatgatgcacaatgtgtacaaacgctttgtaaatgccctaatggtttttaaacttggcaggcattgccaatattttggaacttaaaactgacaaaaaacaaagtaaaactcgaccactaagaaaatgcatgctttaatgacagcccaatattatgcaatctgcttaaaaagcatttaaagaaattccaagaattgggtaaaaatcttcaacgaaataattgagactccaaatgatgagatttgggcgcccttgtttttttctttcctttccaagctgatttataagatactcccttggatttgctcttcaaactacttttttttgcagaaaatatggcatatgccgtaatttctctgttgttagttaaccaacttagttatttattgttgttatggaatggcagggttgtttgattcttctgttgacactgagtttattggcaaggagattgtaaaatgtatcaatatggccagggagggtatacatggtgttcttgtggtgctctcagtccggaatcggttttcagtagaagaagaagctgcaataagtagcctgcgtactttgtttgggagcaagattaatgattatatgatagttgtttttaccggtggcgatgaacttgaagataatgagcagactttggaagatttcttagaagattgtcctttatcgttaaaggtagagcattggcagctggccaacacattttcactgatgcttttttattttttatttggaaacttgtctaatgcaaattgttggccatcgattatatgctctttttatgctatttttactcggcgttcttcatgaggctcttttgtgtttttaattgttggttgcggttgccttattattttcttagtcataattgcttacaggtctcactagtgtaaaatcttgaaaaatcttaaagtagaaatttttgcttcgataaacactgaattatctctggttgtcatgtcgtggtctccttgaatttactgccaaacataacacgtgtagcttatgctgcatttcgtatttggataaacagcgtgtagcccattttatagtgttctctcatcaccagtaattacattacatcaggctcatttgtatcctttcttgtgctcaactcaggcaagtactgtgataaattgtgataatacccttgatatatatgtcaaaagagcaattactcttgcatagggtttgcgttttagttttatccgctgaatttgttttgtttatttcttaaatataagacgatcctggtatttttcttgcatgtgaggcttaaattgtttcatgtgaaaaatgttgatttattcttgctttcaaatcctaagtagtcgcatcttttctacttcatctataaactggtgatacccatatataattgttttacttctttgtccgtgtaaagcaagtagggatttgatcttggatgggaccgtgttagtatctgaagcatttgtcaacatgtgaagtaaatagttaactggtgtttccttatattgtaaaggtttaatatttttaattgaaacgctttgccaattaatgacgattgcttcaggaaacccttgccatgtgtggagatagatatgtcgtgttcgataacaagacaaaagatcaacagaagaaaacactgcaagtgcaagaactcctgtctcttgtcaacatggtgctgacaaagaataacggaaagccatacaccgatgagatcttcagtgaattgaaggtgtagtgcatgagttttttttctcatttctttgcaagttatttaatagacctattataactagacttttatctcttaggtctaactatctgtgtattttgacagagagggactaagaagcttcatgaacaaacagaagaggttcagtctttacaagggtacaccaaaaaggaaatatccgagctgacagagcagatgcataggtcatatgaggaacagcttaagcgaatcaccgaaatggtattttacttttgcttgtctgttttttttttgaacagttcagctgctgaactgttaaaatactaaatcgaaacgtccactacaagttttgaagccacaaccacttggatgtggagaaagtgcccatttgcatattgatcagaaatcaacttgcccattatgtctgcattggccccttcgttggcaaataggtttagtggcctcagtcatttataaaagttgtcatgcacctatatataggcccaggccccagggattccaccaaagatatattataatgtctgtcaacacaccagtggtagacgacactaaaccatagcagatatgttctcttctgatggtaagtcgagtaaaaaatggaaccttagctgcattttagcccccgatttcataccgacttaacagatactgagaaatgctccttcgcttcttctccgatcagttcaatgcaaatatctgccaatgcttattagctaagcgagggctgtgaaatctttttaattgagagtaaaactaatgtcggaaaagagctatggccatgggttggtgggtccagtaacaagtcaaaatgggtaattcttcagtgagggttggaatgtattggagattttatgcaataaatttaaatttttggagacttttgaccaatttgacatgtttactttcaaaccaacttttataactatttgtccattcattagtaggttacgtttgaaaatagagagaaaaaagaaatgaaaagttttgttgcacctattataaggttttaaatttggtttattgtttttgttggccttatttgaattgggatacgaaaaggcatactgtaagcatgtagttagatataatatttgaattcaactcaaattatcgattattctggtaaatattttggtggtggcatattgctttacaggtcgaggctcggctaaaggaaacaactgccagactagaacaaaaattggcagaagagcaggttgcgcggttgaaggctgaagagatggctcaagctgctcaaaagaaatccaatgatgagatccgtaagcttagagagaatctggagaaagcccagagggagagtgatgagtttcgaaagagagccgaaagtggcaagtgtgctattctgtaattccgggcttccagttttatgtatattgttttgtttgtgttcataaccgctggataacaaaaaccttctttcactggtatgctgcatgttttatcaacttatatatgatataaatctacaaatttacttatgatggtctagagaacaactagggctatgagttagtcaagcatttatctattcatataagcttgaagtcaactccagcttaacctcgagctttatggagtttgaatacacaaaatgagttgagagcttgagtttacaacattttaactgagttcttatggagctttgagtgcaccatggactgcactacttatgtaagtactattatatagctgtcatcagctagtgctacaaatgagtcggactctgtccaattcatagaaagcttaatctcaacttgatcttgtttacgttttactgttttgagttagccggactctgtccaattcatagaaagcttaatctcaacttgatcttgttcacgttttactgttttgagttcttgaattgttgaacctagcttgttattgtaatgctgaactagtttgcatcatggaggcttgttgagcatttgagttccacttaggctaagatgcgattgagtttagcttagccagtaaagatgaacgcagactgaaaatgctgcctagttggttgtcccctggtcaaagtaccacctggataatcagtagtccttggcccaagagcggccagttttgtcgaaggtgctatctgcatcctgtcttcatccagtctcgatacctagctacatgagctggtgatttttgaaacaaagtctcatttgactaaaacatcctcaagacttcttcaaaccgaaaatggactctcattatgacattttggtgtgtccttgaagaaatttctgttctaacaaaaaatccgacttcaatttatattaatttttttacaaaactttatttagaagatctgtgaattaagcttcatgataatactctttgacaagttgactttgatgaagatgaggattcaagggtagactgaatgatacgaatatagctaccacgatatatgtacggagaccggagtacagaccaaggataattatggaacgagaaaccaaatgtatgtatagacagagagagcccatagaggaagaatgactagttccgaaagctcgatgagaatctagagaaagccaaaagggattcgcatcacatgggctcatcagctcctaaagaaacttgaaagtgccatgtacttattaggccaacctcatggggctcgattcttggtccaagtccagaatgttcagttcgatactttgatcgcgcttgggaaacttattgtttagtttaaataactatcaaaaaagtaagtagaaacatttttattaattaccatttagtttaaaagtgaccccattaatcgaacttacatgttgcacagtcggacgttgttgatgagctaaacatcggttctaacatctcacgattgattaggtaattagctgttttagctagatttatctctatattgaagaaaacttgggaaaaaaaaatacatcaaattttagtcacaaggagatggcacaaaaatcacgagtgtcattcataatcatagttgataaaatacatcaaggttatgcaaacattcagttgtcataataataagctaacaaacataaaagcaacctttattcaagcagacctttcatcttcattcagtatcatggatggacagacggtgcatttgatgtggttccatggccaaatcatctgaaaattagcatcatttcatgttataaaatgcattgaatttttttgattacactagctaagacctagctacaaatatactactcgtactaattatctatatgatggatggaaattaattaatgtaatcatacccaaggtgaagagacttgttgggaggaatgggataaggagaattaggtgcgtcgtcctgatccaaaggtcccattatattcagatgaaggttgctcctagcaagatatgcttctattgcattgtaatctacctgttgttgctgctgctgcaccctctgatcacactctgcgatctgcagtgtttttgttgttgcaaacaataggttaattattctcacgaaaaatgcgataacttcttatttgagcatcaggtttatgaagttttgtactttttccatatggtgtccaatcactaaaataactgatatttgtacaacatttcattaatttcgtgaatattccatgattaggtgacgttaccttagagcgcaggaacgtgttgtgatgttcaagctcgatcccctgctacagttttatgaaattatatgagttatgatcagtaatatgacaatttgcacacagtctgttgcacttgcaaattgattgtttttaaagccaaggttgttggagctaactgtacaagtcttgttggagtcaagtgttttagtgtcttacgtaaatacatatataagtcatagggcttagttgacgcagacggaaattttggataacaaatcgaacctgttgattataagaatacccaggaacaattcttcaaattatcgttgattcannnnnaataccgataatctggattatcacactaaacacacactctaaatagggaaaaaataaaattttgatttatgatcaactgatcacttccctgggttctattacatataaatagataggagaatttcgaatgggccctaaaatacaagtgggccgaaagttataagcaaaacaaagtccaaaaaaccgaaaaaaatgtccaaaagtcatagaaaaaggccgtttcagggctcgaaagtcgaccaaaccgcct

SEQ ID NO: 532 - DNA, 22558 bp, Conyza canadensis
  unsure (1)..(22558): unsure at all n locations
tatcaaattatttacactttcagtccctccaatgttcaaattcaaaagataaacacttccagtccctcaaacgaccaaaaattcaaaaatacttacacttccattctctgaacagctatttggattgtcactctatatataccaaccaagagcacaattcagtttcatcaacattccaattctcattgttatgcaaagccacttaccctatctaagcaaatggacacgtggtaactatagcaagttataagctttaagtccaacatatgaccaaaaaaaattgaaaaattgaagttttatattaggtcgggaagttttatactcatttataacggtcagtgggatagtaaaaccatctacgatgaggatgtttgtgggaaattcatgctgaagtggaagatgtttgtaaggtaagttgtaacacccaaatattttaaggtaatagaaaattaacatttatcatagtgttgacattaaattaaattcatagtattttgttttgagataaggggttactttagttgaaactttagtggctagcgggtataatacccacttaattaaaaagaaaacgtggcaaagggggagatagttcagccatattttgtgatgaatcatggtttcactatcaactccctctcaatcattttctcacaatttcttctacaatcttccatttacataaagtgatatatgaaattcttccatctaaattcccttagttaattcaaataataaataagcaaattgagggtttatagtggataggtggtggctgaaatcttacaagaagaaaggaagaaaaaaaattagaggttttatattgttttattgtaccttgaggtaagaattatccctacttgttcaattgtaaaattagggttcttgatttttgaaattagggttcttctcatttgaagtgggatttttgtaagtttaggaatttgttagaatcctaattagattgttatgagaaaatttgggaagatggaaatggtgttttgatggtgaacccatgttggtgaaagtattgttttagagtgtttggccaaatttttatattgtaaaaattatgggaaattttttatggaaaatgatcttgaaatccaatcaccatatatgatggttgaattttgagtttggttagttttgtgaatgaattgagttaagaaaaactcatagtgacttacttaatgtataggtagagaagattgttctagtgagtcaaatagtcaagtgtgcctttttgtcaagaaccaaggtgagtgtatatgtatatgatcatagttatgctatatggaggtcataggtgggtaaattcctatgacccaattgtatgttgattttgtgtaaaactagtagatgtgtagatacctactagtataaattgtgtgtgtaagactagtagatgatgagatacctactagcatatatatatatatattgtgtataagactagttaatgatgagatacctaccatcatatattatgtgtaagactagtagatgatgagatacctactagcatacatccttgcccaagtagaattagcatgatcatgatttgttttgttgttgttttgactattgaaagaatgactcaaagttgcttgtacgcttttaaaattacatagctagattatgatcatatatgtatacattcactaagcatgaagcttatgtttttagttgtttactcttttaatgggagaagcaagtaacaaagaaaatgaggtaaagcttgaagattttgaggattgccattatagagttgacaacttggataattttgggtaggaatgtccctttgcaattcatggttcaatgatactttgattttgagataaatgtgtttttgattgtctaaaatatgcaaatatgttacttgagtcttggaaatgtccatttgtatatgtttttgcaaaatagggttacatgttggatagttgacccgtgtgatcgttttaatgtatatttcaatggttaaggttttggatctatccattatattgtaataatgattttactcattttggtgttttggtttaaagaatttgaaccataaaatgttaaatatggatttttggataaaatggaaaagtgcaggtcggaccataaaattacggccctgaccataattttacggcccattgatttagatgtgacgtaaatttacggccctaggccataaatttacggccctaggccataaatttacggcccttgtaatttcgagttgttttcaaacagagaagaaaaaaatccaagagcgaattacgacccatttttacggctagttataatttaagccataattttacggtttagtttttacgatcagttgtaactaagccgtaaatttacggccatcaaccataaatttacggccagtacaaataaataaataaataaaaatcgcatttttcttaaattgagtcaagtcgtttcataagtgttgttgtgggtgatgtgatgaagggtgtccatccatgagtatttgtagggaaggattgtgaaagatgaagagagaaagtgtgtgtgagagtgattgtgtgtgtatatatataattaagggaaagtaaaggtgaaattggcacacgccctagttaagtaaaaaacctttcacatcttattttttttttctataaaatttatgaggccctatcatttattaattatacaaaaaatgtttaaaagtaaatgtgatgggttttcacctaagttaggtgtgtgacaaccccacactcacttttctcatataataattttatgtatattatttggagatttgtaaaaatgatggatattaaaatatgtttgtaagaagaatgcatggaaaacatatatgacatgttgattatgatatttataggaaaaacaaccaaaactgacacagatggtttaatacattggtgatcccaaattattgttacaacaaaaaaggagaaaaaaaatgctatgggtgagtacgattcggtttggttcggtttttgaaaactaaaaccattgggtttcggttttttcggtttcggttttttcggtttggttctatttcggttcggatttttgattttagtcggtttttaaccacttgtggtttgggtcaaataaaccttcaaaagtttataagtttataccctataattgtaccttaattaatttcaacaagttttctgaacaatattagtaacaataacactacaacaatgacaacaatttcataaaaataagttgtataaacttcaaacaaattttatatataactatttatatcttttaagcgttgtttaattatacagttattaaaacaaatttattttgttgtgtattttcacttacaagatataaatgatattattttatacacctaaaaatgcaaatannnnnnnnnnnnnnnaaaatttaataataaaatgatataaatataaaataaaaaaatatattttttgttcggttcggtttttcattagaaacaaaaatcgaaccacaattttcggtttttagaaaaccaaaaccaatggtttttggtttttttgtttggttttttcggttttcatggttttttcagttttcggttcgactttagctcactcccaaaaaattctacaaaagaatataaagttcatacattataagatgttagtaaatatttatattttattagaacttttagtcatattggagctgttataaattattatttaacatgattttaattagatttttagttgctaacattaatatttatcaaagtaaacccgtgttatctattatataaataaaaaacaattgtaattacataagattttttaaaaattgtgtactcccatgcatcattttaattaattatgacatcatcatactttatcgatttaaaatttaaaatatcttttcattttttaaatatacctctttaatataatcttttattaaatgctcacaatattatttatgtataccttaatttttcgttataatgaggcgaaaactatggtgtcttttaggatatgttttactcttttgtttttaccacccgtatgtgtttcaactatgcgtccacaactacacaagtttagttttcatttagtttcatttacataataacttatcgcaacttatgaatatattaacgttgtaattatacaatttagcatgataacatgttttaaagctacccggatagaattcggtttattgttaaagcgtgtataagttaacccgggttgattagttagttttgttaatagacaaaacaaatggataaaacacgatcgagtcggatgcgacgattgatctcagggactatgcatgacggccgtctaggactatttgtgaagttatattttgtatcataaacctgataaatgttaacaaccataacatacgtacgttattggtgtcatatattcatcaaatcattccaaaattttcattttccacacttagatgcattatttacaatgttcatcatgtagttatttcagatattaaaactttaaagtttaaaaatgtaaatagtattaggtagatttataaaaataaagtaaaatgacgtaaaattttattagcaaaatttcgtatttaactcaatttaacatgtcgtattttttattatattaaatgacagttctaataacttattaaccaattacatttatgatttcttaaaattatcaattttgatatttattgactttttattataaaaattaaaatatacccacgtataaatgtcgacctcataatgataaatattaggttattaaagattaaaaaactttaagataaatattatcttattagaaaatattacaaaatgatagctaccaatatatatcctaatgatagtaattgattctatagtataatattgtattagattagataactagttaatcaacccgagattttaaacaaaaattgctaatactatctatattattataaaattgatgcatttgcatgatgtatttatttctcaaatacacactattacatggatgcatcaaaataattgtagaaaaaataaaaattcatggattcgatgcagatgcattattggatgcataaaacaaaacgtgtgagtttttggttttgacaaatcaacgtatcgctaaaatcttatataaagaaaataattataaatttgtttaatttatagatttataatgcatcaaaataaagttttaaatgttataatcttgttcttattataaaataacgatacataaataaattaaaaaagatagtaaatacacaatttgtttttataattctataaaacaaaatttagtggcgttaaaagccaataaacaaaaatatattaatactcaaattaaaaaatgaaaaataaaaaattaattatgatgtcatcttttgtaaaacattgtgtaggaaaggatctcatgttgtcacataggaatttttaaaaaaaaaaaccttatagaaacaattttgttttattaagtataaagattatatattaacttttcaaaaattaaaagaagataattatacattataactataaatatttaatataagtatataacacaatttgaactttatattattatcctaaatcctaaccaaaatgaactttattcaatattcattttatctcttcatcaaaaaatataattttctcccttattatatattagttttgtgtattaatgtttatagttataatatattcattcaaattaaaagtcataattgttatcaaatcatatgaaaatagtgttaatatccatttattacattattattatttttatttaataacattaacaagtacaccctattgtatcaagcgaaattgatgaaatgtagatgacttaacaaacttttcatgtgatgtataaccaaaattactgaaatttgggaatgtgaattatgatgattatatactcaaagtttttattaaaaatgtttacatttttgatgtaaaatttcgcactcacaaacacaacatatgcccatgtatagttgattaaattttaccggtaatcaaaatatacttgtaacctgaatatataaatttttttgagaagccaggcaagacactagttatataaaaataattacaagatataatacatgaaaacaaacagaagctattttagacacgcatcaaaagctagcacaatctaaaactttcacaataaggataaatttatattatcggaccttaaagcggataacttgacaccgatgttgtaacttacaattgtaaaatctgaaacattaacctatctttatcctttttgtgctgcaaatgatgaaacaaccacagtgtcaaccacaatgatatttgatatccacatgacaaacaactcggggtctgttcaatttataatgaacaaacattaaaaatacaagagataaaggaatgaaaattatattgttcatctttgtttttattttcacatttgataccttttaatcttcccaatttataatatactttattatagaaaaactactttttcttcttttcaattgtatatctttaaaatactcttaatttttaacacagatctaattcacacattaaatctacccaatatattcctaaaatattttccaaccatatttattcaaaccatatttaatatacgaaaataaccttttccgaattcactaaaaatactcataaaatcgtaaaaccgcaaggaggagatgcggatcgcaagaactcattgcggatcgcaagcagtgcttgcggattgcaagtttttcttgcaattctcaagcaaggcttgcgatccgcaagtagtgcttgcgattttgactttttttttactaatccataagtcaacaaattcaagaaaatctcacaaaaaatttatgcatatgccaaaaaaagtcaaaattgcaagcattgtttgtggatcgcaagaattgcttgcggatcgtaagtcttgcttgagaatcgcaatgattccttgcgatccacaagtagtgcttgtgatccgcttctcctccttgcggtcatgctattttataggtatttttggtgaattggaaaaaaattgggtatttttgtatattgaaggtttttggttatttatgctattttctcttacatcaattacttttagattaataaccacatccttaccaccactaccaccatcatcaaccgttgcggccaccgccgccgcattgcgcggatatccatctcgttactatataaagcaaatctcttatttcttttaagttttcaacttctaaaatatgcaaaatgctcataataataaaactaccttcaaccaacctatttcaccaccacacaccgaaattatcactaccgtcatcacctattcactaccataactaatttgtacccaatttgagttaaccataatgatcacgtaacaaaaaatttctaattaaacgtaattatccatatttgaactaatgcttacaacaaaaagttatcaacacttatttagttataattacacaaattacatatcaaaatggagtaaagatcccaaaagttgtggcactattgattaatttactatcttaaaaataggttagataaaataacacattttcatttgtcttttcatatatggcgtcaccttgagtctccccctcaccaacgatcactctcatcaactaatttccaccgtacgatcacacacaaccaaaactggttaggtatatgcgtagtagatagatataatagatatagcaatattatacatttttattatatacacacatatatatatggatatatagctcaaaaataggagtgtgatagaattctgtgagacctttctctcctccttttcctcgaactacaccctaattcttcttcattcaccttttcttatccccaacgtcaatccatattttcaggtattccttttcatttatttatttatcattattgttatatatatatatatttctgtatctataggttctgtaaaaccttagttttgctatctgggtaatattttatagtttgaactggacgtgggtctgttaaatatagattagaaattggctaatattttattcgtgttatatatttctgtagctatattttgtatctatatgttagaaggtgtaaaaccctagttttggtatctgggttttgttctatagtttgagattgatgtgggtttattgaatatagattaaagtttggatctttttgatgttagtagtgattcctgatggattgtgttagtattgtttggttattatgtgtaagtgttcaattagggttcttgatttttgatttttttttcttccagtttttcgggatctgatagatttttgtgatggaaaatggtgtgagtaaagtggaagaagtgaagctgaaagtaggaaaagatgatgtcttaggagatatggcaaatggtggaggaagtggaagtgatgatgctggtgatgagagtgtatcggaaatggtcaatgtggaagttgttgatggtagaaaggatttgagtgatgagaatggtgacggtttgggtgattcgctattgttagatgggagtgtagacatagctgagaagtttaaaggtgcagcggaggcttcttctgagcttgaaacagtcaaggcaaaggctgatatgaatctggctgaggtaaccttattgtttatttttgtttgggaaatacttatgataattgtttgattaattggtgatctttgcaggtgattgatggggaaagtagtaccattgagaatgcaaccagggatcaatcgatggtggattgtgatgaacatgagggggaagtgtccattgtggaagagttaaatggggagataaatgtgtcggataatacttttagtgatcaactgattgtgttgaaagctaatgaggccgtgaatgatgatgttggtggagaaagtacttctagcaatcaatctagtggattggaagttaacgaggcttcaaatgatgataatagtgaggaaaaggtggttaagttggcacatgcgcttgatggagagagtagttctgctaatactaccatggatcaagttagtgagttggaaacggatgtgtcggtggttggtggaaaaggtaaggcggaagttgtgggtttggccgatgaacacgtgattaatttggtgcagacaagcggtaaagaaagcatttctgatagtgcggataggggtcaggcttgtgagttggactccaatatgtcagtggttggtggaaacgacgaggtagaattggtgcgtctgtctgatgaacaagttcttaatttggtgcaggggactgatagggaaagtacttttgataatgctgcaagggatcactctggtgagctggaaaccgatgtgtcagtggttggtggaaaactcgaggcggaagtggtggctgtgactgatgatcataatgcttatacatatgcaaccaaagacgagccacatctgttggagaataatgtggttatagagaatggggtaaatggggatggggaggtatccaatgtagatacattagacgatgtccatgatgttaatgagaagccagcttctgtaactttaggacattctgaaaatggagctccaaaaagtgttgctctggatgagatagtgctccaagaagatggactaaatgtagattctgcgagtcacataacacagccagatggtgagataggaggcgatgaaaacatagatgtcaatgaaaaacataacttgggggctgaatgtaaagttggtgacagtaagaatagagtggaagagtttgaaacttcaatcagtaaatcagttaatgtgcaaagcgagtcaacacttgaacaaattcaagagggggaacataaaagttttgattcttcttcagcacatcaagatgctgaaaacctggaacaagtaatagattcggccattgatgtgcctaataaccatgtcgagagccttaattcagaaaatggcattcatgtttctatggaggaaaggacggaaaatcccaaagttgaaaagaaggaactaaatgaggtaaagcaagatatacccctgaagaaagaaccagagtcgagacaggttataggtgtttcattatctgcacagaaacctgcaattcccacttctgtagctaatcccaaacaggataaaaaacctaatcaaacccccattccaaatcctaaacctatcactgcacccactccagctccatctccatctccatctccagccccttctcgccctgctggtcttggtagtggcgcaccgctactggagccggctcatcgtgtggtggcacctcaggcaaatgggaatggcccccctcttcaaaatcaagtgatcgatgaaccaacaaatggggaggccgaggaaaatgatgacactcgtgaaaaactacagatgatacgggtcaagtttttgcgtcttgctcgtaggcttggtcagactcctcataatgttgtcgtggctcaggtcttgtatagactaggattggctgaacaacttagaggcagaaacggtggccgtgttgctgcatttagctttgaacgcgctagtgccatggctgagcagttggaggcagctggacaagaaccacttgagttctcatgcaccatcatggttcttgggaaaacgggggtcgggaaaagtgcaactataaattctatatttgatgacacaaagtttggaaccgatgcgtttcaagttggaacaaagaaagttcaggatgttgttggaactgtgcagggtattaaagtacgtgttattgacacaccaggccttcttccatcgtggaccgatcaaaggaaaaatgagaaaattcttcactcagttaaacgttttattcaaaaatcacctcccgatattgttttgtatcttgacaggctggacatgcagagtagggattcaggtgacatgcctcttttgcgaaccataaccgatatctttggtcaatctatatggtttaatgccattgtggtcttgacccatgctgcatcggctcctcctgaaggtccaaatggtacagccactagttatgacatgtttgtcacccaacggtctcatgtggtccagcaatccattcggcaggctgctggtgatatgcggctcatgaatcctgtttcattagtggagaaccactcggcttgtagaacaaatcgggctggtcaacgtgttttgccaaatggtcaagtgtggaagcctcacttgttgctactttcatttgcctcaaagattttggtggaggctaatatgcttctgaagttgcaagactcaccacctggaaagccgtttgcagccagaactcgagcaccatcattgccgtttattctttcaaatcttctacaatcaagacctcagctgaagttaccgcaggagcaatttggcgatgatgatgatgatggtgatgatgatgacatggatgagtcatctgatgaagaatcgtcagaatatgatgaattaccaccgtttaaacggttgactaattctcaactgtcaaagcttagtaaggcacagaagaaatcttattatgatgaattggaatacagggagaagctcttcatgaagaaacagctgaaggaagagaagaaacgaagaaaattgatgaagaagatggcagaagctgctaagaactttccaactgatcttgttgataatagtgtagaagaagacagtaatagtgctgcgtctgtccctgttgctgttcaggatatgaatttgcctgcttcatttgatgcagataatcctactcatcggtaccgggctcttgactctgccaaccaatggctcattagacctgtacttgatccacatggttgggatcatgatgttggttatgaaggaatcaatgtggaacacatacttgcacttaaagaaaagatccccatatcattttctggtcaggttaccaaagataaaaaagatgctaatctccaaatggaggtatcaagtgcaatgaagcatggaaaatcaaaatcaaccacattagcatttgatatgcagactgttggaaaagagatgtcatatactctacgcagtgacacccgtttcattaattacagaaaaaacaaagcatcggctggtctttcggctacttacatgggtgatacgttaacaggtggtgtgaagttcgaggataacttagtgattaataaacggggacagttggtggtggcaggtggagcagttattggtcgtggtgatgttgcttatgggggcagcttggaggctacattaagagacaaggattatcctttgggtcggtttttgtcaactattggtctctcagttatggattggcatggagatcttgcacttggatggaatgcacagtctcagattcctattggcagatttactaatctgattggtcgtgttaatctaaataacaagggttctggacaagttagtatgcggctgaatagctcagaacagcttcagattgcattagttgccttggttccacttgtgagtaagttattgggttattatcaggaccgggatacaacgtattaatgtcatatttttgggttgaagaaagttctgtagtataagcttcaggagggcaatcgggctgattaccaacatgtgagtaaaactttcagccatttgttttctttttcacaaagaaatttatttatttttattttactgtgtgcacgggtctatttattgtagcttccttgctttggtaaccacttttatggcttttttaagccgttctttatttgactatgcagcatctgtaatggactagcaactgaggttgttagatgaacaaagtggttagaaccttagtagttagtagtcttgactgtagagatagtgccatttaggcggttaagaatacagaattgcatttggtaaaatgtgttcttgttattttatagtcttatgtcgagtttgttttctctttcgttacacacctagacacggtgacggagttaggaatattcccgggcttgtaataattttacacaagctagtttgacactaaattttttttaaaaaaaatatatgtatttagcggtgtcggctgactctgctcgacatgctctagctccatccttacctagactgacgattaattcacactaggtgtgtactagattaaggtggcataaaacctttttgccaagttggaaattatttgtatgaaattctccattatacctgagcgagcctggcatagctttttttacagatgattttttaattttgattcctgatagtaggaatttcattttgcatcttaatatagtatatttactgttggattttccaataggcggcctttgccggatgaacatggctttccatgatcccattatgtattgttattaaaatttagcttttaacggctgcatcccctaggttttttgtttgtaaatttagaagctaataccttggttcttttctggttttgcaaatcaatgctttttaaagctgttgttagttgttaccccgctctgataattctctagttctacatcccctgtatgaaagagaatatcattatctactgcagttctatgaaagatgccgacttctattttgagatgccttgacaaatattgcaacactctcattttgggaaaagttgtaaggctacaatgactccttgctcattatcgtcattgtaaaaatttgattatattgctttggacatctaaagactgtataaagttgtattttagatattttataaaaattcttaaatttcccttaaattggcatgctgatttttttgtgctacgtacttgttttattatctagcactgtttgatagtttgcttatatactaacatgacactgtttcttgcagatcggcccggatctttgaaataattgccaaaaggaaggcaggaatgttttgtcattctaatggaaaaagttggtaaatgcacagactgtagctagagctagatttcgagaaaatttccatgctgctggttcccttttttccgtcttcattttcatctttgctttcttcttgatatagagatgttctgattagagttgcgaccaagtttagttattgtatcatacacataatgccataatgagcatgtgactcaaggttttaatttcctttagtggacaggacttctttttgtagtttgcgaaatttgtttggcttacaacgttatggtgaattggggcctgttcgggttggggcagtggttttagctgttatttgttatatattgtattttgccaaaaaggaagtttatttgtgccatttattttcatttaatatagggatcgtgggattcgttgaatactatctcatagtaattaaaatgtctaaagagaagccttctatgtttaggctgttaaagccgtaaaggttttgtttgttggctgcccgaaagttaaattgttattaatgatttcatcttaacaagcagtaataacggggccaactacttaactagcatctcaaatttgacttttgatgtaatggcgtatcttaacttcatttaattctacaatatttcatcttgtttaggctgaggggagtgggccgaacccacccccaaatcgcctggacagggatgagaaaaaacccaaaaaaccgaaaccgaatcggtaccgaaaatcggtaccgataggaattcggtatcagtatcggtctttgatttgagttgagttcggtttcggtaatattcggttcggtacggggaaaccgaaaacgaataccgagtttttcaaaccatatagtactagtagacaatacgtagtaaaacattagagtattagacattgttgaccaaatacattgtataattttctttttcatggatattaaattggaagcataacgtaaaatttttcccatataatcgagagatacactcatacaccccctgacctttatgtcatatttatgcatccatagttccatactagttttttgtttggctgttaattagtttgttaatggatactaccagtgtaagtttttggaatgaaaatatgaaaaggaatacatacagataccgaaatttttcttccaacagcattttttccaaagttttttttaattttcggtactattcggttttgataccgaaaacccggtaccggtaccgtaccgataccaacccgatgtactcggttctcattttgggttattttcggtttcgggattagttggtatcggtacagtttggtacggttccataccgaaaaccatccctacgcctgaaacactgccccaggcggcaatccaggcaaaaatccaaaaatggcgacttgtatgtatcgtccaaaagcctctctaccaactttatctccccctgttactatttcacttcccaaccaattacctagagctatttgtggaaattccacttacccaagtagatagccctactcccccatttttaaggggctacccacttggtgacatagcgccacatggcacaagtcgtcgcccccaatttgggtagccacactcctcttttgccttatttgatcaatgcattttgtttccctgagttgtaacatgcacatgcctgataagcgattcaagtgttttaattaataaaccttgctaaactggataagtgtgctgactattatattgcttctaatgccaaatatatacgagtaatatataaatgcaacactaacacaaagatctgtaaatatgggttattcaaatacaacgaaagcgacttaataatgaacaaccatgacattatattcaacaactgcatcaccagttgtaaggttgaaataagaagtttttgcagtggcgataccttttgccatcctaaaaaccccagagccaccaacaattggcatctcacgatacggatgaaacactgcattccgccccaaaaggcttagagtactaccattgtaatccgctcccgtaaaaaccaagttcatggtcatgagtaagccggcctcacttaaacacgcagagccatagataccttgtgcctgacccacaactgtagagttgggttcgggtcctgaggtgagcttgtcgtcagccatagcaatgaatccaaaatttgttggagaggtgtcagtaatgttggattgggcgactctcatggcagtcgggctggagccacttagtaagtcgtgtagatagaagtgaaggtgtgtggtttttggggtcatgttgggtaggcttttaaaccattcttctatggctagaggatcttgatcagttccatggaccaaaggtattcctaggagtattattgagcttagtgttaaggctatgcaaaggttcaccatctctcttagtatgtttgtgtgcgcagtgtatgccttgtttctcctcttatgtatggattttatgttatgtgcatataaatatagagtggtgggtgtgacattcttttcattcgtttagctaaaacactatcttccttattttagcaatttatagtatatgaatctcccttctctttctttagcttgaaatttcttttataataatgtttgttgggaaattgaaaatgatgcatcattaaatataggcgcacacacataagtaagtattatacaaggagaggttggtttcatcttgtctttgttagttcaaccaaacaacaatgctcttttttaacaggtttatatgaaaatctctctctttgttctatctatcactcaacgtgagatgattgataagaacaagtggcaccccatcggattaaatcagtgtttttgggcaaaaaaataagtgtaaaaaaggatcaaaatattcaatatagtgtcagttgactttatataaatccaatagcttacactaaattagacagaaacaaaaggttgaagtgaatatacggctcaaaatatctgatttttgttactttgtaagctattgagtttcaagaacacagatggtatgatgacattctcgcgtgtatatcaaatttgttaatcgttttgttgttaattgatgtttgataatagtttaaagctttgaagatttaatagttaaaatgtttttttataggcttttaatttgggctgacatttgatagaaatgcaggctattcatttgtttaagtggatatataattagtagcccaaagtgttatgctaaagagtgtgtaaaaagcgtgaaatgttaacggtcgggtcaagcctgtagcctaaaccctgaccatggttatgtttgataaagtggttgtcggttgtagtggtaacttttagttggcattgtaagttgtagatcgtaggtaaaattgttacctagaacttttattttctaaaggtgctttctaaatataatatttaatcatgtacaaaagttttttcattatgataatttatttatcgatctaatttgtttatgtagtataataagactagtattttagttatttatatgagtttgatttaacattttcttttagctacaagtttaaattatgctttatacttaatgcttttttatatacatatatactgtttgattaaatgtaaattaggtatgaaacactcacatattgtttttttaatccataaaaatcatggtggccaatgcatttattcattaaacaagaaataataaaatattagtatgtgaagggtttcacacctaatcatgggggcccatgcatttatatatttaccaaatttttttatattattcattgattatattttgtttgatttttttttataatgttttttaataacaagtaatatttttttcatcattgtatgttgatattgaatatttttaaacatgctattatataattgtttatatcttatcagtttatttagctaagtgaagttctataatttatcataaatcacagaacatatataaacgaaatatataagacatatgttttgaatccatttgttcatcatgcgggactgaaaaactagaagtgaaaatataatgttgtcatggccggtgtagagtgtggccaaagtagccgacgggccgagactggttttttaggggcttattttttctagtttttattgttatgtttatacatgtgtaacaattaagtctattgtaaactctaaccattatctaaaactaaaagatataatttaacctataaaaaaactcacatatagccttttattggataaaaaaaagagttattctcatctatcggaaactcggaattgatgaagcggcgcctgctatctttttcaatctttcattgttccacttttcatgtacagcacttagttatttttgtttgttatttattgtaaataatatatatatatatatagggtgacattcaaatgagaatgaaattaaaataagaacacttaaaaactatatttatatatgtatatatatatatagaaataatatagtattatcaaatgatatataaattattattataatattattacttaaaaaacattaacatggcataacagtttgttgtttatcatttctttaggtctttttatgttggtttaaacctatcgaaattctatttgtctttaggttttagattttatttattaatatttattgtcatttttagagattagtttataatttattataataattagttgcatttagcttatggactcttatttttacgctcgcttggatctataaatcttcaaagacggcccagaatgttgtgacttcgaatgcacgcattttattaatcacatcttatggtgctttaagaattattggattagaagaaacacaattggttggtttgacatttttgtttatcagtttaacttaatttaacattttgtttataaaccaaagtttttcaggaagttaggaatttaattaagattattgtataaagatttgaagtgtcaaacttacatcaagtgtacgttcttggcttttacttaatttgggctgtgattgctaaaaaagatagaaacgcaggctgaatcgtttaagtgggctaattaatatgtattccaaaatgatgtttttaaaaattacgttaaatatacttaaagtagttgctactttttcacccgaaccatagtcaatcttgcatgaagacgaagacccttacatttttacatggggaaaatgttgcgtacaacttcatgaagaaaaaaatttcattttaccccatgaattttaataaatgtatatactgatcgagtacttgggatgtgagtgcagtagtacctaacatacgtagtacgggcagtatgtatgctttcccctacaattattgatttgtttcttcttataaattttaaatttgaatttataatatttttttatttgcatttaaataataatttgatttattttaaaagtgttattaaccttatgtgtatttgacacctaattaaatttagttgttaaccaacaataaagatataccgcgtaatcattataaggtaaattataaggtaagtgatcaaaccttaattaaccaatcaaaacactcaatttctttaaattaagttattcaacatgtgactaaattaaattatttgttgataataataataacaacaacaataataattaatagatttatagatatgtaaacttacgaaacttttttttagaaaatataagtcttatctaaacaagttaataattatctcgaaacaaatgagaaatgttaaggagtttgcaaattacaatggataaacactaaaagtataacaatacatatacttaataaaattttgtgtatatagataaatagatggatgcgacgatgagcaagatttcttatcactcttgagataatcatttaaattaacttcaacgtatgtctcatccctccagttaacaaaaaaaaaaaaaaaaaattaaaccaaaaaagtagaaaagatataatcaagagatcagagggttaggctcgtcattgtggtggttgttagtgggataagtttcaagatctttccgagttcgctttaaattgttacggaatttgtgtttgtttgtgtgcagaggtatttctcgatcaagtcattcaaatatcaatcttccgattgttttgctaaaagattctgcttaactgaaacacataaaaatttgtattcacatcttaaaaaatatcaggttgttcaaaattacattatttgacttttatgtacattgtttacatttaaatatcagtttgtctttttatatatattttaatttgagtttataagattttttatttctatatatttaataatttatattaaataattgatcgaaaacacatataacattgttatattataattgaaatatttagaatatgttcatctaaaaataagatatagtctgtaaagtgtaaaataagaatgtaaatcactttgtaaagtgtaaaataacattggtggttggatcaaagaccttaccaataggccactaaccccatgggtcaaattaacatattttttttttataatcttaaaaactatatatatttagcaaaattcaaatcataatccccctacggctctacgtacagtacaaattaaatttgaagatgatttctagaaaatgatattgagagagactattaactattaagtgtacgtaactcattatatttgaggccggcaatatttgatacttgatagacaattaaaacatatatactgatttgtacgagtagtaactaagctaacttcccctatatatatgtgtatgtaaatatcacaagctagctagctagctatatttgtatatatatacaattgagaactaattaacaatgataaaaattatactagttatctttgcatgcttggttctgcttttgagctcttgctcccccgcggcggtgaagggcaaatattactccaagagcgtaacagtcgatgctccaaccaccgtaaagaaaaccaatctccatttcttcatgcacgacatcctttcaggcaacaaccctacggctgtcctcgtggcagcaccaaacggaacagttgtccaagaaggcaacgtaggcccgtttggagcagtttacgtgtttgatgacccactcacggtgacctccgacccaaagtcagaggttattggtactggacgtgggttgtacgcttcagtaagtcgtcaagtaccgacggagtggaccttgctgttcaatgccgatttggagtttacgagtggggagtttaatgggagttccatatgcctgttttcaagagatcttttggtgttggaaaagaaagagttatctatagttggtggcagaggcaagtttaggatggcaaatgggtttatcatggctaatgtcatatcctttaatgctacaagtggtgatgtcattcttgaatttcatgtaaccgtttttcaccaatgaaaaagtgctatggataattggatatatatatacagggtacgttgtggaagagtaggaataatactctctaattatatcctttaattagcttctatgtttttatcaatgaataatgggttggattattagaaacttaatttgtgctttctagttgtttctgtatagctactactaattaattactgtttaattaaagtgtatatataatatatgtaagctttgttaagaattctagcttgctacaaattaatatgcatgtttatccgaaatgtcatatgtgtagttgatttaatctagacaggcagagacggaaccagataatctattgagagggggcaaattttgtagtcatacatgctaattttgagtagtgttttgatgctaaagacaagttcgtcaaaagatgtcttactaaactaccgtctcacagatttttcaatagcaaaacgcaaagtttgattaccatattcatgatttcgaatttatcaaaacaaacatatataatgtgataagatagtgagtaacgatttaattaaataaaatattaaaaaggttaaaagccacaaatagatagattatcaagtaaaggggaaaaaagtgtattaatgattaaataatagggatgaattgtaaataaagtgcaacaagacaaaatagagtattttatcttcttcattctctcctgtaaaaactctctgctttgttttatgattacctttaatcaaggttgcggaactcggaaatcgagatcgaatcggagagggaggagtcaggatttttaaaaaatcggaatcggatcgataaatagtgagtttttttatgtataaataatagtttttcaaattatatgtaaaatacatcttaattatgacattaacatattaagtttttatgttaagttcatgtaaataaatgtttaattatgacattaacatattaagtttttatgttaagttcatgtaaataaatgttaggaggactcctattgaactaaaaataaagaaagttaaaagatcaaaagaggggttaatgatgtacaaaacaaaagaagaaggttttaaagtaaacatgttatccatttgataattgaaaaggcaaatttgggtgtaccacaaattagatacaagtcatacaaccgtcgctcagtatcttctttctctttttatttttttttcttattcttcatttttgaaaagtcccagaccactccttgtctggcatctgccacgtcagtattgtgtatcctttccttttcaatcttattgtttatatatatatatatgtattttgaatatggatatagatattatacgtatgtgtaaatatatatatatacatcgctaataatagt

SEQ ID NO: 533 - DNA, 4040 bp, Cyperus esculentus
acaagtggaggctgataatgtgagtgaaattattgataggggccactttgatgagtctcctgtggttgaggatgcatctgactcaaactcctctgataatgacgaaaatcatgctgatactctgccacaggcagcagcagcagaaccagcagcagtggcaaccgcaccagttccacaagcagcacctgcactgcccaaagcatctggttcacctgcaccatccaagcccgctggtcttgggtctgcttccttaccggacccttcttcaactcgcccgtcgcagcatgtgccaaatgggcgttccggggcacaacaaaggcagtcccagccatcagatgaagcaattactgatgaagtgggggagcatgatgggattagagagaaacttcaaaatattagggttaagtttttgagactagtgcatcgacttggccaaacacctcacaacaccgttgttgcacaggttcttctcgtttatttttgttaatgattgaacttgcaaacaaattaccactcatgcattgtaccagtaagaactctttgcttgtgttgggcttcttttctctgctgcagcaccaattgagattcttcaagttatatctttaaagatattgtgcctttttttaaaaaaaagggaagatatctttaaagatattgtgtgcctttgtgcttttggttgtgtctgcacctaattgtgtgcatggctgcatgctcatgtcaagtgggtatattatggtagagatagggattagtaagacatatgtgaccactatcattattattgaaatagcacatcaccagtgtgtacagctaacctgaaaaaatattttaggatatgtacgtctgccaataatgtgtaacatagctaaatttgataactgctgtggttaatttgacaggtgttgtaccgtattggtttagcggagcagctacggagaaattcgaaccgacctgtaagtgtcggctttgaccgagccagtatcttagctgagcaactagaactctctggggatgagccactcgacttctcatgcaccattatgcttcttggcaaggctggtgttggcaagagctccactcttaattcactctttaacgagtcattagtccccgtccacacttttggacctggtacccggtctgtacaagagatatcaggtgtgattcagggaatcaatgtcaaaattattgatacccctggtttatccacctcctcttcagatatgcagaaaaatgaaaagatcctccactcagttaaaaagtttgtaaaaaacaatccacctgatattgttctttactttgaccggttagatgtacaaaacagggactacggtgatgtggggctcttacggaccattaccaatgtgttcggttctccaatctggttcaatgcaataattgttctaacacatgctgcgtcagccccaccggatgggccaaatggcataccgctaacctatgacatgttcgtgacacaacgaacccacattgtgcaacagaatattcgccaggcagctggagatgtgcggttaatgaaccctgtatctttagttgagaaccactcggcttgccgcatgaaccgggcaggtaaacgggtattaccaaatggtacagtttgggaaccgcaacttttgttgctttccttcgcctctaaaatccttggtgaggcaaatgcattgcttaaactggaggacagttcaccctataatcggacatttagtcggaggtctccaccattgccatattttctatccagtcttctccagtcaagggctccagttaagcttcctgaagaggaacagtttggtgaggaggaagagttgctaaatgaattggatgaagaatcagattctgacgatggttctgattatgatgacctacctccattccggaggctaacgaaggcgcaactttctaagctgagcaagcaacaaagaaaggcgtattatgatgagattgaatacagagagaaactctttttcaagaagcagttgaaggaggagaggaagaggcgaaaaatggccaaaaaatttgctcaggcacaacaggagtcaaactttgatactggtgagaaactggaagaagatgaaatgggtggacctgcttcagttccagtgcccatgcctgacatggcccttcctgcatcttttgattctgatgcaccagtgcacaggtaccgctaccttgactcatcaaaccagtggttggtgcgtcctgtcttggatctccatggatgggatcatgacattggttacgagggtttaaacctagagcgactgttcatcatcaaggataaactaccaatttctctgtctgggcagcttacaaaggacaagaaggaatcctccttgcagcttgatgtgtccagttcactcaagcatggggaaggtaagtcgagctctctaggatttgacctccagtctgttggtaaggacatgtcatacacagtacgaggtgaaacgaggtttcgcaacttcaagcgaaacgacacatcagctggtatctcagtcaatatgttaggtgactcggtgtcagcgggtgtgaaaatagaagacaggctagttgtaaacaagcaactcaagatgcttgtaagtggaggtgttatgaccgggcgtggtgagatggcatctgggggccgtgttgaggtgaccttgaaggacaaggactacccaattggacgaatgctatctactcttgctctttctgttgtggattggcatggtgagttggcactggggctgaattgtcagtctcaagtgccaattggtagaggaacgaacatggtgttgcatgggaatgtcagtaacaagggatcgggtcaggttgggatcaggttgaatagctcagagcaattccagattgcattagtagcacttatacctttattggggcatattaagagggtgttgctgggaacagcttttgagtagtggcttcagtggcatatcagttttttttttttcccctcctatgctttagaagaaggttgtttatccctttcagattcacagagagctttgcctttgttgttttgattttttttttcgtttcattttaccttagcgtatggatggtggatttagaggtcttctaatatttttgcatgtgtaggaataaaatgttgaatgattagcaacatccttttgccttgcattcgatgccccatcttcttttcttgtttttttttttctcccttctttttttgtttttgtttttgttcttgtatttgttttctttttgtttagtttgtagataatggggcataagagtttggcctagaaatatagacttgataatcaatatatcaaattttttggtttgttgaatgttgatacctccttgctggacactatttagtgtatgatttatgttgttattatttgccagtgcagtcagcctattatattcttgatcaaaataggataaagtagtagttaattttagagctgaaagcaacttggttgtatgtttttagtagccttgtgctaggtttaagttcttccatggaaatttcttttctaaaccatcacttgagacgtagtgtaccggcaatttaaaacattgttttagtagttaattttgctgctcctttgcaaacaatttaaaacattgtttcttagattgaaaactggcggattcaattgaattcttacacacattgacacaactatctcactcattcattcactcagctttgctgcttgtataattttcttcctagataatcaaattacaaaatttcccataaaataatgctaaatttatatcagactggtatgcaactgtaccattatgattgaaggttatgacatcagttgtaacaaactaattaagcatttcaaatctggtatatatctgtacaactatcgcctatcggcttgatcttcatgcaattgataaagataattgccagataacatgctatctgttacagctgctgccgatccattgcttaattcacatgatgaactgacaacataaattctacaaacacatatacatcaaaatatttcctttatattgttatttgattcaaaatc

SEQ ID NO: 534 - DNA, 945 bp, Digitaria sanguinalis
aactgataataatgtagaagaagacagtaacggtgctgcaacagttcctgttgctgctcaagatatgaatttacctgctacatttgatgcagataacccgacccatcggtaccgggctcttgagtctgctaaccaatggctcattagacctgtgcttgacccgcatggctgggaccatgatgttggttatgaaggaatcaacgtggaacacttgcttgcactcaaagaaaagatacctgtatcgttttcaggtcagattaccaaagacaaaaaagatgctaatctccaaatggaggtatcaactgcattaaaacatggaaaatcaaagtcaacaactttagcattagatacgcagactgttggaaaagaaatgtcctatactttaagaagtgaaacacagttcattaattacaaaaagaacaaagcatcagctggtctttcagctacatacatgggtgactcgttaaccggtggtcttaagtttgaggacaaattaatgattaataaacgagggcagttagtggtggcaggaggagcggttattggtcgtggtgatgtggcttatggcggcagtttggaggctacattaagagacagagattatcctttgggtcgatttttgtctacaattggtctctcggttatggattggcgtggtgatctggcgcttggttggaacgcacagtctcagattcctattggtcggtttactaatttgattggtcgtgttaatttaaataataagggttcaggtcaagttagtgttcgtttaaatagctcagaacagcttcaaattgcattagctgccttagttccacttgtcagtaagctattggggtattatcaggatcgtgattctgcatattaatcacatatttttggacttgagaatgaagaaagttattttggttttaatgctgctcgagtgcaatcttttgaccaaca

SEQ ID NO: 535 - DNA, 580 bp, Digitaria sanguinalis
ctgcatcggctccacccgaaggcccaaatggtacagctactagttatgacgtttttgtgacccaacggtctcatgtggtccagcaagccattcggcaggctgcgggtgatatgcgtctcatgaaccctgtttcattagtagaaaaccattcagcgtgtagaacaaatcgggctggtcaaagggttttgccaaatgggcaagtgtggaagcctcatttgttactgctttcatttgcttcaaagattctggttgaagctaacatgcttttaaagttgcaagactcgccacctggcaagccatttgcaacaagaactagagcactgccgttaccatatattctttcaaatcttttacaatcgagacctcagctgaagttacctcaggagcagtttggcgatgacggtgatgacatggatgagtcatctgatgaagaatcatcagaatacgatgaattaccaccgtttaagcggttgactacttcccaattgtcaaagcttagcaaggcacagaagaaatcctattatgatgaattggaatacagagaaaagactcttcatgaagaaacaagttgcaggaagaa

SEQ ID NO: 536 - DNA, 553 bp, Echinochloa colona
caatcatcctctttgcagacgtaacaccaaaggtgaaagagttttaccaaatgggcaggtatgggtatcagaactgctgctgctgtgtggggcaactaaattgctggcagaagcaaattccttgcttaagttccaagatagcttcctactgtcacaggcgaataacaggctaccttcactgcctcatcttctttcttcgctccttaagcctaatccttcatcaagttcagatggtattgacagtgaattgacagaaatgtcagatgaggaggatgaatatgatcaactacccccttccgcattctaaagaaatctgaatatgaaaagttgacaaatgaacagaagtctgcatatcttgatgaactggactaccgtgagactttgtacctaaagaaacagtggaaggagggaatcagaaggcaaaagcttactgaagctcaaaatgatgaagtcgcagatgattatgaagagagtgtgtccccagaggttgtgcacatgtcagatatggaaattccactaaattttgactctgattatcctgtacatcgctacc

SEQ ID NO: 537 - DNA, 4445 bp, Echinochloa crus-galli
tcaccttatctcctcatcgcctccctccccaccccccttctcctcgaatcctactgccgctgtttcccttgcttccttgcgtgctggcggagcaagaggcggccatggccaccaccactgctgacgccgccgccccagtcgcgcccgtggaggaagagaaccccgctccggcggcggcgggggcggaggccgaggaggagccgccaagaaagtcgaggcgccggtggccatcaccaccgacgccgccccagtcgcgccgcccctggaggacgagaaatcgaccccagcggcggccgaggaggagcctcgggaatcttattttgaggagaagaaggtcgaggagggtcgggggagaaagatggggacgaggatgaggggagattggagaagagaggtgagggctttgggggtccggaggcggagaacggcgaggcagaggataccggagggggtggtgacggcggggaggtgggagaggcggaggaggatggtgaaggtggaagctcgggagctgcggaggccgagaaggacgttggcagcggggaagctgtggcggcacccgcgccagccgcggagtccaagccggagaccagcgagttggggaaggacgatgcttctttgccttcccctgatgagccggaaggtggtgaggagaagagtgaattgccggaggagcagcaggaggaagaaggtgcctcggtggaggccaaggttgcggatgatgtggaatcggcagtggccgaggaggttaagccagaaccagaagatgagaagggtgaggaggtagattctgagagcagagacggcgccgaatttggtgatgagaaggaggttggggtctctgctgggagcatggaggtgacccaaccagaggataaggttgcccctgttgctgaagctaatggtgaattaggggccgagaaggaagccagtgatgacgccgcggctctgggagatggagaagccctggaagagtcatctaacaaggatgctgatcttgaagatgaggctgtcaagcctgagcctgccagtgaagcgagtccagtggttgtggatgatgggagcgtggaggtggccgaaccagaggataaggttgcccctgctcctgaggctaatggtgaattaggtgatgagaaggaagccagtgacgacgtggtggctctgggaggtgaagaagccctggaagaatcaactaacaaggatgctgatgttgaagatgaggctaccaagcctgagtcagctaatgaggcaagtcccatggttctgggtgatgtgagtgtggaggagcctgctcctgcaagtgcagaaagtgtgattgaggatagcactgagatgagcagaatgctgaagatcaggctgctgccagtgaaggtgtggaagatgttggtgccgagaatcccagtgaggttggaaatgttgctgctgctagtgctgatggcatcttgactcgagagttggatccagaaccaagcaatgaaaacaatggtgctgattttactgaaggtgctactgtggttgctgatcgtaaagaggaagaagctggtgacagtggcataattgaggttgaggctgtggctgtggcagatgatgatgatggagttggtactgaggctgatggcgacgatgatggggtgaactctgacacgagtcctgcacgggttgcaatattagagagctctgaagctgcgaagcagatcatgaaggagcttgcggaaggatcctccggtggtagtgtgtctggctcaagagacttcactaatagcatggatgggcagattatgcttgatgattctgaggatgatgatggggatgagatgaggatgaggatgagaagggatttgattctgctaccctggcagcccttctgaaagcggcggctggtggatcgtcagaggggaatatcacagttgcttcccaagatggttctagaatattcaccatggaccgacctgctggtttgggttcatcagccccttctctgaggcctactgctcctcgccagcctgcccggtcaaacttattcaacccctcggagctagcagttaccgctgatcctactgaagagatgactgaggaagagaagaagttgcatgacaaggttgagttgattcgggtgaagtttctgcgtctggtttacaggttgggagctactcctgaagaaacagtagcagcacaagttttgtaccgtttgagccttgctgagggtatccgacatggaaggcagaccaacagagctttcagccttgataatgcacggaggaaagccttaattcttgaagcagagggaaaagaggatctgaacttctcatgcaacatacttgttctagggaagaccggagttggcaaaagtgcaactatcaattctatttttggtgaagagaagaccagaaccgatgcctttagctcagcaaccagcagcgtgcgggaaattgttggtgacgtggatggtgtcaagattagaatcattgatacaccaggccttcgacccaatgtcatggaccaaggatcaaacagaaagattctttctgctgtcaagaaatataccaagaaatgccctccagatattgttctatatgtggatcgtctggatagtctgagccgtgatctcaatgatttgcctctgctgaaaacaattaccgctgttcttggttcatccatatggttcaatgccattgttgcgctcacacatgctgcttctgctcctcctgaaggcctcaatggtgctgccatgacatatgaggtcttgatggctcagagatcacatatcatccagcaatccatcaggcaggccgcaggagatatgcgcttgatgaacccagtagcccttgtcgagaaccatccttcttgcaggagaaatcgtgagggccagaaagtgcttccaaatggacaaagctggaggcatcagttgctgcttttatgctactcctcaaagatattatctgaagccaactcacttctgaagcttcaggaccctaatcctggaaagctttttgggttccgtttccgctccccgccccttcccttcttgctgtcctcactcctgcagtcaagagcccaccccaaactttctgctgagcagggtggcaatgaaggtgattctgatattgaattggatgactattctgatgtggagcaagatgatgacgaagaagaatatgatcagcttccacccttcaagcccttgacaaaagctcagcttgcgaggctcacaaaggagcagaagaatgcttactttgatgagtatgactacagggtcaagcttctccagaagaaacaatggaaggatgagatccgtaggttaaaggagatgaagaagaggggaaaatctgatctggatgattatggttatgctaatatgattggtgacaacgatcaggaccctcctcctgagaatgtatcagttcctttacctgacatggtgctgcctccttcatttgattgtgacaatcccacatatcggtaccgctttctggaaccaacttcaactgtcctagcaaggcctgttttagatgcgcatgggtgggatcatgactgtggttatgatggagtaagtgtagaagagacactagctcttcttaacaggttcccagcaaatgtagcagttcaggtcactaaggacaagaaggaattcagcatccatttagactcttccatcgcagcaaagcatggggataatgcctcgtcacttgctggttttgacatccagacagttgggcggcaacttgcatatattctccgtggtgagaccaaaattaagaatatcaagaagaacaagaccaccggaggattctcagtaactttcctgggtgacattgtggcaactggactgaaggtcgaggaccagctctcccttgggaagaggctgtcgctagttgccagcactggtgcgatgagagcccaaggggacactgcatatggagctaacttggaggcacgcctgaaagataaagactacccaattggccagtccctgtcaaccttgggtctttctctgatgaagtggcgtcgggaccttgctctgggtgctaacttacagtcacaattctccatcggaaggggctcaaagatggcggttcgacttggcctcaacaacaagctgagtgggcagatcacagtcaggacaagcacatcagagcaggttcagattgcacttctgggtctcgtgccagttgcagcttccatctaccggagcttccggcccagtgaaccgtcatttgcttattagcctgtcaggaagagtcactagtctacttatttgatcaccatatcgtttctcttggcaattttcctttccatatgaaccatatttccttccatttcagtttactcttttagtcggcagatcgttcctatcataattttgtctgaagaaaggttgtgagatttatctggaactatagctgaataatgtcaagggatctatattatccttgtggttattaatc

SEQ ID NO: 538 - DNA, 941 bp, Euphorbia heterophylla
atagacatcgttagcccataggctcgagcaaactcctcacaatgttgtagtggctcaggttttgtaccggcttgggttagccgagcagcttcgtggcagaaatggcggtcgaatcggtgccttcagtttcgatcgagcaagtgccatggccgaacagcttgagtcagccgggcagtcgcctctcgatttctcctgtacgattatggttcttggtaaaactggggtcggtaaaagcgcgacgattaactcgattttcgatgaggttaaattcggaaccgacgcatttcaactgggcacgaaaaaagtccaggatgtggttggaacggttcaagggatcaaggttcgggttatcgacacaccaggtttactcccttctgggtccgaccaacgccagaacgaaaagatactccactcgattaaccgattcattaagaaaaccccacccgatattgttctatatctcgataggttggatatgcagagtagggatttttgcgatatgcccctcttaaggaccataaccgatatttttggtccttcgatttggtttaatgctattgtggtgctaactcatgcagcttctgctccccctgatggtccgaatggcacagcttcgagttacgatatgtttgttactcaacgatctcatgtggttcaacaagctattcgtcaggcagctggcgatatgaggttaatgaatccagtttcattggtagagaaccactcggcttgtagaaccaatagggccggccagagagtgttgccaaatggtcaagtttggaagcctcatttgttactgctctctttcgcgtcgaagattctcgccgaagcgaacgcccttttgaagttgcaggatagtccacctggcaagccctttgcgcctcggtcaagggccccccctctgcccttcctgctctcatcactcctccagtctagaccgc

SEQ ID NO: 539 - DNA, 609 bp, Euphorbia heterophylla
tcgttcgctgtcgacacttgggctttctgtaatggattggcatggagatcttgctattggatgtaatatacaatctcaaatccctataggacggtctacaaatttaattgctcggggaaatttgaataatagaggcgctggacaggtaagtatccgggttaatagctcggaacagctgcagatagccttgatcggtctccttcctctatttaaaaaggtaatatcttattatgaacaaatgcagttgggacaatgatgaaagattagataaactatttatttagtagcagtcctaggaacaggtggcaccctaagaagacactatgaaaagcccagttgaaaaggctgctcagctttatttaagttagacccccaaatagttcccttatttttgtgaaaaggctggaaatttgagaatatgttagcttcttaagattgaatgtatttcgtttgttgaaaagacagctttttgatatggtggtttgcaattagcattaaggtgctgaacagaagttaaaccaggctcttaattttgtcttgtatgggtgtagatattcactgattttgtagaatgtacagtttattttatatcataccatgcttttgttg

SEQ ID NO: 540 - DNA, 1215 bp, Euphorbia heterophylla
agcttcagggcggtgatgatgttgatttagatgtcgaattgctagatttatcgggttttgatgaagatgaagaggatgaattcgagcgacttccaccgttcaagccattgaagaaatcggaggttgataagctaagcaaagagcataagagagcttatttcgaagagtatgattaccgagtcaatctccttcaaagaaaacagttgaaagaggaagttaggaggttgaaggagctcaagaacaaaccgaaagacagttcggagaacacaatccttaaagaggaagaagaagaaggtccagcaagtgtaccagttgtgatgcctgattttccgattcctctttcatttgactctggcatttcgtcatacaggtaccgtgcattggagaatatcccgaatctccttgtacgtccagttctcgatttgcactgttgggaccacgtatttaggctatgatggcgtcaatatcgaagggaatctcaccattgccgaatctttcccgtggggagttatcaattcaaatcacgaaggacaagaaagagttcaaccttcaattggattcatcaatttgtgcgaaacacggagaaaaccgatcgacaatggcaggactcgacattcaaaggattggaagaaatcttgcttataccctccgaaccgaaacccagatcaagaatttcaatttcagacaaaacaaagcatctggtggtttgtgggttactctggccggagaaaacgtagccactgggctcaaaatcgaagatgagatgactttcggaaagcaattggcagtgactgggagtgctggtgctgtgagatcgaaaggggaaatggcattgggggcaatttcgaaattagggtaaagagggaagattatcctttgaatcaagatcaatcgacgttagggttttgcggtgatgaaatggagaggggatttaggcgtgatggcgaatttggagtctcgattttcggttgggaggaattcgagaatggcgattggggttgggatgaacaacaagcaaagtgggcagattagtgtaaagagtagtagcagtgaattgcaaattgctgcaatttggatttttccagttttagcttccattgttaggagtttatgttgtggttctgctgcaaaagactcgaacttgctcgattgattcgggtttttagttgtaataaagctagatgattgccgatttggtattgtttattaagctgc

SEQ ID NO: 541 - DNA, 682 bp, Euphorbia heterophylla
acgcgattgtggtgctgactcacgccgcctcggccccccctgacggccctaacggttcggcctcgagctacgatatgtttgtgactcagcggtcccacgtcgttcagcaagcgattcggcaggcggccggcgacatgaggctcatgaatcccgtctcactggtggagaatcactcggcttgtcgaaccaatagagccggtcaaagggttttgccgaatggtcaagtttggaagcctcatttgttgttgctttctttcgcgtcgaagattctagctgaagcgaatgctcttttgaagttgcaggatagtccacctggcaagccttttgcccctagggccagggccccccctttgcccttcctattgtcgtcgcttctccagtcaagggcccaagtcaaactgcccgaggaccaatatggcgatgacgagaatctcgacgatgattctgacgagtcgtccgattccgaggatgactcggaatatgacgatttaccgccttttcggagtttaaccaaaggccagctggcgaagctctcgaaagctcagagaaaggcgtactttgacgagttggagtatagggagaaacttcttatgaagaaacaattgagagacgagaaaaaaagaacggaaaatgatgaagaaaatggctaaagagttgccaaccgatatcgatgaaaacccgg

SEQ ID NO: 542 - DNA, 5329 bp, Euphorbia heterophylla
atttaaatatgaaattttagataataaagacaaacaccatcatatctatttatttgacagttgttttttcaagttttttgtttcgtattatttgattatgaattattgaatgattaggtttacatgttctgttttaaactaaaagctacataaactgcattactgcaacattataaccaaacaatgaacccaaaacctattgagcttggaaaaaataaaaacgtttttaccaaaaagaggacctaaaagaatggagaaaatttgggaaaaaaaaaagatcacaaagacaataatatagcatgtctaaaattcagctgacaatggtccccaatccgagcacgtgacacacaacatgtacatgtgttaggttcattatttacgacgatatcgatgcaactcttcatcaaacaccgttggattaaaagcatcacaaccgtccatcacactcttatcctcattttcgccactgtagatttacgaactacccgtcccgtctatatacgccccacttcaaagatttgctcttttcccttctctctctttccccatccgattttattgctacccaaaagctcgctctctctctctaagattatccacgaaatctggtaaagcttttcctcttttattgattatttatcgctttcatttcatcctgcttgcttttgatttcatataaatgccttcctaggatctgtgactttgtttttgtgtttcttttctacccattttatccgattagggatcggtcgttgttcaatttcaatttcaaagttatgctagggttgttttgaattgggaatttgttgctgctggtgattggttatttatcgcaaatgtttgtgtgttgactaaatattatctgtttgggtatttgttcaaactaggatttaatggaaaattgggctgagaaaacttctgggcatgattcgagggaggaggaaaaccattccgaatctcaggttaagtccgatggaatggtagacaatgaagaggaggtttttgaagaggcagttgaagcccccgagctacttgtgaatgaggatgagaattctgaatctggtggggtggttgaggcactagaggattccgcctcggctgtggcggatgagattttgaagggggagaatgaggtggaggcttttgaagaggccatggatgtgattcctgctgctaatggaacctctgaggagaaagctgatgtggttggggaggaaaagggtgcgattttgttggatggcgcaagtgttgataagattgatgagggtgggactggcaaggaagtgctcactggcgaaccgagtggaggaaaggaggtgcctgagattggttccaatggaggcactgaggtgttgagtgctgacatccaggtgatttccgatcatgaaaatgctgagcctactcaatttgatggtgggaaggaggtttctgagattggtagcaaggtaggcatcgaggttttgcaggctgaggttgagttgaatggtagtcatgaaaatgaaccatctacagagtatttgcctgaatcgaaaggtgaaaaggaggttcctgagattgtgcacaatggggctgctgaggttttgaaggccgtggttgaggtgaatccagaaaaggaggttactgagatttttcccaatggaggcactgaaattttgaaggctgatttgaaggagaatcctggtcaagaaagcgaagcttctattgggtttctgcctgaagtggatgaagaaaagaaggttccggaagatgatagcaatggggttttgaaggctgaggtcgaggtgaatcccagtcaccagactgaaccatctgcagagcttctttgtgaaaatgtcgaggaggaactgaaggaggatgacttgggtactgattatcagggaactcagcgatctgtcgagttctcaaaagagctccaagaagacaaggttgaagatctgaatgagaatcttaacaaaatcgattcagacggtcttgttattgaagaaagcagggaatcaaaacatgagacagttactcatgaaagtgaacaactgaaggatagctcagcaagcttggagttagagcgccatagtgataaaaatggagatgtgaaagctaacactctgggttctgagcttggtggagagctttcagctggtttacatacagaaaaacttgatcttccagcagtgggtaacaaggagtctgatgactctgatccaacatgccctgatgaaaaagttattagtgtcgacaaggacagtattgtgattgaggagcatgaaaaaaaggtagaaaatatccagcaagagaaacaaagtcctccagcaaatggcgatcagaaaattccgccccctgcaaagcttgttccatctcctgaaaaatccaccgattctgcaccaccggctcgtccagctggccttggacgcgccgcccctctaccggcccctagagccgtgcaacagcagcagcgtgtcaatggaacctcggctcacgtgccatcccaacagatcgaagaccctgctagtggagagaacgaggagtacgatgaaactcgcgagaaactccagatgatcagggtaaaatttttgaggctggcccatcgactcggccagactcctcacaatgttgttgtagcacaggttttatacaggctagggttagctgagcagctacgtgggagaaatggaggtcgtgttggcgccttcagtttcgatcgtgcaagtgccatggccgaacagctcgaggcagccggtcaggaacccctcgatttctcctgtacaattatggttcttggaaagacaggagttggtaaaagtgctaccattaattcgatatttgatgaagttaagtttgggaccgatgcttttcaactgggtacgaaaaaagtccaggatgtggttggtactgttcaagggattaaggttcgggttatcgacacacctggcctacttccttctgggtctgaccagcgccagaatgaaaagatacttcactcggttaagcgattcatcaacaaaacccctccagatattgttttatatctcgataggttggatatgcagagcagggatttttgcgatatgcccctcttaaggaccataaccgatatttttggtccttcgatttggtttaatgctattgtggtgctaactcatgcagcttctgctccccctgatggtccgaatggcacagcttcgagttacgatatgtttgttactcaacgatctcatgtggttcaacaagctattcgtcaggcagctggcgatatgaggttaatgaatccagtttcattggtagagaaccactcggcttgtagaaccaatagggccggccagagagtgttgccaaatggtcaagtttggaagcctcatttgttactgctctctttcgcgtcgaagattctcgccgaagcgaacgcccttttgaagttgcaggatagtccacctggcaagccctttgcgcctcggtcaagggccccccctctgcccttcctgctctcatcactcctccagtctagaccacaagttaagctccccgaggaacaatatggcgatgacgatagtctcgatgatgatttagacgagtcttcagattccgaggatgagtcagaatatgatgagttacctcctttcaaaagtttgaccaaagaccagctggccaagcttactaaagctcagagaaaggcgtactttgatgagctggaataccgggaaaaacttcttatgaagaaacagttgaaagaggagaaaaggcgacggaaaattatgaagaaaatggcagcagcacccaaggagttgcctgctgagtacaatgaaaatcccgaagaagaaagtggcggtgcttcatctgtaccggttgctatgcccgatttatcattgcctgcttcctttgattctgataatcccactcataggtaccggtatctcgatacttcaaaccagtggttggttagaccagttttagaaactcatgggtgggatcatgatgtgggttatgaaggtattaatgtggaaagactctttgttgttaaggaaaaagttcctttgtctttttccggccaggtgacaaaggataagaaagatgccaatgttcaaatggaagttgcgagttctataaagcatggagaagggaaatcgacttccgtaggttttgatatgcaaacagttgggaaggacttggcttatacgttacgtagcgagacaaagttctgtaattttaggaagaataaagcgtcggctggtctctcgttgactctccttggtgatgctttatcggctgggttgaaagttgaggataaattgatagctaataagcggttccagatggtggtgtccgggggtgcgatgactgggcgtggtgatgtggcttatggtggcagtttggaggctcagttgagagatgaagattatcctttgggtcgttcgctgtcgacacttgggctttctgtaatggattggcatggagatcttgctattggatgtaatatacaatctcaaatccctataggacggtctacaaatttaattgctcggggaaatttgaataatagaggcgctggacaggtaagtatccgggttaatagctcggaacagctgcagatagccttgatcggtctccttcctctatttaaaaaggtaatatcttattatgaacaaatgcagttgggacaatgatgaaagattagataaactatttatttagtagcagtcctaggaacaggtggcaccctaagaagacactatgaaaagcccagttgaaaaggctgctcagctttatttaagttagacccccaaatagttcccttatttttgtgaaaaggctggaaatttgagaatatgttagcttcttaagattgaatgtatttcgtttgttgaaaagacagctttttgatatggtggtttgcaattagcattaaggtgctgaacagaagttaaaccaggctcttaattttgtcttgtatgggtgtagatattcactgattttgtagaatgtacagtttattttatatcataccatgcttttgttgatttccgctaggattgcttcattcctctgtttctttctcctttttgcaatggttgtggtggtagtttatctgtgggtgtgggtcttagatatgcttttgtttttcatttttcttcttcggattggttttatgtaaccattaaaatgttataccagaatatatggcagaattcacatcaaacattagtgttggcattctgtctttaaattgtttgaattgtttgaaggttgaagtcattttagttgcttatttggtgtggagttgtattaacctttttgggaatggggaagagggaagtgttaatgtggaaatgatgataat

SEQ ID NO: 543 - DNA, 6132 bp, Euphorbia heterophylla
  unsure (1)..(6132): unsure at all n locations
ttgaaactaggatcttacagcaacaatggaaaattcggctgagagaactgctgagcatgatttaatggagaaaaacctccacgaatctcgggtttcggagtctgatcgaatggttgacaatgaagatgaggttttcgaagaggcagttgaagcccctgagatattaatcaatcaggatgcaaattccgaatctcgtgagcctgctacagctatggaggatgagaatttgaaggtggaaaatgagttggaggatttcgaggaggcaatggatgttactcctcttgctcccggaatttctgaggagataaccaatgtggttggtgacgaaaagggtatgaatttctcggatagttctagtgtcgatgagattgacgaggagaattctggagatgaaaccgagccattttcaatgcttagctcttcattgaatagtatcaagaaggttttagggatcggtaaggatgaggttgaagtggatcctagtcatgaaaaggaaccttctttagggttttcgcctgaactaaacggagaaaaaaaggagaattcggagattgttgagtcgtctactagtgatgaaactaagccatctactgagtttctccctgaagttaacgaagaaaaggaggttgttgaggttaatgatgggactgtggttttaaatcctggtcgtgaaatcaaaaaatcttgtgattttctgcctgaagtgaatcgagaaaaggaggtttcggagggtgatcgtaatgaaggcacagaggttgaggtgaatcctagtcatgaaaacgaaacacctaccgatattctccctgaagttaatgaagaaaaggaggtttcggaggttgatcgtaatggggtttcgaaggtttcagagattctttctgcagaaattgaggagaaactgaaggagaatggttcgggtaatcaatacgagggagctgttgaaaaccgagatgacaaggtcggaactttgaatgaaaatccgacaaaaatctataccgaaagtcaggttatggaaaaaacccgagaaaccgaacccaagacagctgtctctgactacgaaaatagggttctcgacagtgaacagtcgaaggatgactcagcaagttcggataacaaggattccgatccaaattcccctgacgaaaaagtcatcagtgtcgacaaggacagtattatggtcgaggagctcgaaaagaaagtcgaaaacgacccgaaagaaaaacaaaccactaattcaccgcctataaaactcgttccttctcccgaaaaatcaaaatccaccgctcctcgtccagctggcctaggacgagccgcccctctactggaccccacaccacgaccagcccaccaacctcgagccaacggaaccactgccaactctcaatcgcagcaaattgaagaccctgccaatgttgagagcgaggaatacgacgaaactcgagaaaaactccagatgatcagggtgaaatttctgaggttagcccataggctcgggcaaactcctcacaatgtcgtagtggctcaggttttgtaccggcttgggttagccgagcagcttcgtggcagaaatggcggtcgagtcggtgccttcagtttcgatcgagcaagtgccatggccgaacagcttgagtcagccgggcagtcgcctctcgatttctcctgtacgattatggttctcggtaaaactggggtcggtaaaagcgccacgattaactcgattttcgatgaggttaaattcggaaccgacgcttttcaactgggcacgaaaaaagtccaggatgtggttggaacggttcaagggatcaaggttcgggttatcgacacaccgggtttactcccttctgggtctgaccaacgccagaacgaaaagatactccactcgattaaccgattcattaagaaaaccccacccgatattgttctatatctcgataggttggatatgcagagtagggatttcggcgatatgcctctattgcgaacaattaccgagatttttggcccctcgatttggttcaacgcgattgtggtgctgactcacgccgcctcggccccccctgacggccctaacggttcggcctcgagctacgatatgtttgtgactcagcggtcccacgtcgttcagcaagcgattcggcaggcggccggcgacatgaggctcatgaatcccgtctcactggtggagaatcactcggcttgtcgaaccaatagagccggtcaaagggttttgccgaatggtcaagtttggaagcctcatttgttgttgctttctttcgcgtcgaagattctagctgaagcgaatgctcttttgaagttgcaggatagtccacctggcaagccttttgcccctagggccagggccccccctttgcccttcctattgtcgtcgcttctccagtcaagggcccaagtcaaactgcccgaggaccaatatggcgatgacgagaatctcgacgatgattctgacgagtcgtccgattccgaggatgactcggaatatgacgatttaccgccttttcggagtttaaccaaaggccagctggcgaagctctcgaaagctcagagaaaggcgtactttgacgagttggagtatagggagaaacttcttatgaagaaacaattgagagacgagaaaaaaagacggaaaatgatgaagaaaatggctaaagagttgccaaccgatatcgatgaaaacccggaagaggaaactggcggggcctcttctgtgccagttcctatgcccgatttagccctgcccgcttcgtttgattcggataatccgacccataggtaccggtatcttgatgggtcgaaccaatggctggttagaccagttttggaaacccatgggtgggaccacgacgtgggttatgagggtattaatgttgagaggttgttcgtcgtcaaggaggaagttcccctgtcgttttccggccaggtaacaaaggacaaaaaagacgcaaatgtccaaatggaactagcgagttctttaaaccacggaaaaggaaaatcgacttccctaggtttcgatatgcaatcggttggaaaggatttggcttatactttacgtagcgagacgaaattctgtaatttccgaaaaaacaaagcatcggccggtctgtctttgactcttttgggcgacgctttatcgggtggattaaaagtagaaaataaattgattgcgaataagaggttccaaatggtggtttcggggggtgcgatgactgggcgtggtgacgtggcgtacggtgggagtttggaggctcagttgagagacgaagattaccctttgggtcgatcgctatcgacgctcgggctatctgtgatggattggcatggggatcttgctattggctgcaatgttcagtcccaaatccctataggtcggtccacgaatttaattgctcgggggaatttgaataatcgaggggcggggcaaataagtattagagtaaatagctcggaacagctgcaaattgccttggtcgggttgcttccactattgaagaaggtgattggttactatgaacaaattcagttgggataatgctaaattaccgaatcgaattctatgtttcgtgagcatccccttttttttgtcgaaagccggaaatattaagaatatgttaggtttttttagtagtaaatgtagtttctttgttaaaaagaatggtgttgatgtggttttttgctgaatagaagttgcttattgttcaaccaagctcttgattttcgtgttgtatggatgtaaatatttgttgattttgtgaaaagtacgaaacacgttatcgcgttttatattttaataataaagtgtcgattcgtcaattagtggataaggtacatagatgctagaaaaagtaggaaatgtgtgtattgggggaaaacatgttttattgaactgaactgaatcatttgacatggaaacatgattgaaatttacccagtttgggctctgtatgcatatatggagttcatgtggaatgttcgttttctatttgtcaaaagactcggtctttcgtataatttattgaaacgaaaggagcattatatggataagatcaatccaatcccattattttcgagtactttttttctacaaagatgattgattgatgagtccttttcaattgaggtagattgctgataagaacacaccactcgtactctgtttttataacttataattcataatgttcggtatatattagtacttatcagcactgcataaaatcaatatttgttagtactatcagttcaatattctctgaatacgttgaaaagaacagagcctgatatgctctcctgtctctttcgattcaattattaaacattgcaataacaatgtcttttattcaatattattttgtctagagttttcatgtcaaaaataaagacttatttttaaagtttgtatagaaagattgctttacttttcggtaaagtagacaaaaaacaggagacaacaatctcgaaccattaaattaaacaaaattgctgacttacgctgacacgactcgtccagaattattaaatattaatttttcaatttttcacaataaaccactactggatttcattattttcacattagttatagtaaatacccattcaaccattctaagtcaaaaattgactattattgatcccttcaaaatctatcatcaaaggacttgaaaatccatggccaagattctaaaagcgagtttagggttcatattctccggctttccgccctttttcacattaagtataaaaaacacgttattatgaaaaaacagacagaaaacagttttaaactttcggaaaacacctcaaggcttaaacataggaggcttcctaaccctagtcgcctgctcaaagccataagcaatctcaataagtttagcctcggaacccttaattcctccgaaacatatcccaaaaggcactcctttgctatcataaccgcccggtacactaatcccgggataccctccaatcgcaagaaccctaaaaattttagaactcctaaccaaatcgaaagggctcacaattgcatctagcttatgtttcttcactaacttctcgaacccatttctcgaaagttcattcaaatttccaacggctagtttaagtatgttcttgtgagttgcattcgtagcttcggctgcttccagtttgtcctgtccatactccttcgtcttctcctgcataaaaccgctcgaattcaacgtaatttcggatcgaaaacacgttataattcttacgaagttttaaaatttattaccaagtcggagaatttcttgttgaaggcaataatatcggctagcgtatgaaccggggttttcgccaatttgcttaaatatctgtttattgccggcttgaagtcggttgttagaacaaaaccttccccactttccgagtaatcgaggatctcctcgatgtgggatattttcaaattgtcgattagaatcgcccctctttctctataccgttaaagttagtttatactagtactattacattaaggatacagataagagggtttggtacaatggtatagttacctcatagttttgaagtgttgctcgaaagttcgagctagtaccgcgccttcgtcgttactaaaattgaagaacgggtttcggacgattcctattcgcttgcctttaagcccatcggctttaaggaactgcttgtatccaccacgtgggatgaactttgaagcgagtttagtagccggatcgttcgagattgcatcaagaacgtacaccgcatctctaactgtcctgcacattggcctgtcaacacaaatcctcggttagttttagtgactcggggccatttcggaagttaaaaaatagtcgtaatacatcacaagccccctaagttgtcccagattgctccttgtccccctgaacttttgaaagttcctcttgccagccctcaatttgtctaaattgaacctcatgactagggatgagcaaatgtcagttcggttcggaaatcgaaccgaaccaaattgagaaccgaatagacaaaagggaggaaccgaattatttcggttcggtnnngaaccaaataaatttttttattagttttgtattttttaaataagaatttaacataaaataaatttaaaaacccaattcg

SEQ ID NO: 544 - DNA, 8543 bp, Euphorbia heterophylla
aaaaacgacagttaataagaaatggagagagtaccatttaatcgttttatttttcatatttattttttttagagaatttttgttctacttaaaaaaattttatggttcaaaaattgaatagggaatatttgtgatgaagcttgaatgaacaagctcttggcgtagggcggctattcgtgttgcttatatcaactcatagaactacacattaacaaccacaattccttaaatagagacaaaacatttatctcctcacgatccaaaccaagtgtttgatttcctagaacactccaaaatagggaaatccgaacctcaataaaacacaaaaataaaaacctaatctttttatccctacttcagtgtcctatctatcttcttcttcttcactaaccctaaaaccccaaatccaatctccacaaaaacaccaaccacaattgataatcacacgaatttacaatacccagataaaaaaaatctcacctttttagctttttttcaattgtatcgtctccactttttctctttctgtagaaagattcgaccttttatccatggcgtcaaattccctttcaactacaaaagtgtcctcttcactttccagttcgacccctagagctcctatcactgctgatgatgattcaaccgattttgagtctctaactgaaagcggttacagtgaaacttctggaagcatctataatgggtccgagtttgatgagtatgctagtggcggtgaagagtttgaaacggcgtcggagaagcaatttgctgacgaggaaaaccgcccttctgtgaagtatgaactctctaggccttttgtggttgatccagatgaagaagaaagcctgggaaattcagaagagagtggtgttaatggtgattatgggcttgaatttcaatttgacggtccaaatttgcagccaggtatgcccattgcccaattgtcaattgaagaagatgaatttgatgggttaattagtgatgagggtatggtgagtgaagaagatgaagatggtagctttagggctattgctagagtggatagtgcccctagggttatagtggaaaataaagatgatgaatttgtcttcccaagtgataaattggaactcaataattctgttgttgatgattcgattcctgttgctgggttgagagagaagaaagagggtgttttgattgaaaattcgggtggtttgaagcatgttttcgatgatttggtttcggttaatgttgttaaaccgaaggtgtttattgagtctttggtggagaagaagaaagatgatgtgttggaacagaatcttaatgaagattccaagcctattgtagaagagagagatttggggctggaagtaactgaactaattaatggagacgagtttgatccgaagagtatggagattgatagtgtaggaaaggaacaagttgatgtttttgtcgaaagtgagttgactcaggtacataacattctagaagagctacaggaattgaatgttgatagctctaacaatgtctctgaaaccctaattgaccctattgatgactatgaagccgaagaagaagcaacgagtttcgttgatggaagtgttgttcttgaggaagaagataatgacaccgagaatctagaagattcgacagctcagcaaaccagtacgatacatgaatctgttggaatcacagatgctatttatgttgattccgtggagaatcttgatttgctcgaagattccaaagaagaaacatcggtgaagggaagttttctttctgatgcagaaatcgagaatataatatatggaggctccgaaccggatttcatgaatgaattggagaaaagttcttcgatttcttctattgccgatgatagagagatagtttcgggtttgggttccgatgaagagatggagatgaataaggagcatgaaggaaatgacttatttgaccctccgattcaacccgatacagttaaggatggtccaagtgaagagcttatcgggaagattcaacacatcagggtgaagttcttgaggctagttcatcggctaggtcttttgcctgaagattctattgtctcccaagtgttgtatagaatagccctatcggcaaaaggacatgtcagcaaggaatatagcgttgaatctgcgaagaaatcggctttggaacttgaagctgaggtggacaaaaaactcgatttggacttctctttgaacattttggttatagggaaaaccggagtaggcaaaagtgcaacgatcaattcgattttcggtgaaaagagagtagcaattgatgcgtttgaacattccacaagtaccattaaggagattgtagggatagttaatggagttcggattcgagtttttgatactccgggtcttagatcccctaaggaagaagcttcgaatcggaaaatattgggtttgataaaaagggtatcgaaaaagttccctcctgatgttgtcctctacgttgatcggcttgacacatatgcgacaaatttcagtgatttgccactgttaagttccatcactaattccctgactgcctcgatatggcgaaatgccattgtcactttgactcatgctgcttctgtgactcccgatggaccttttgggtcacctacgagtttcgagacatttgttgctcgacaatcccatgttgttcagcaatcgattagtcgagctgtgggcgattttcgcctaatggactcgagtatgatgcacccagtagcccttatcgagaatcaccctatccttagcgacggtcaaaattggagaccccaattgttgctcttgtgctactcattgaagatactatcagaggcaaattctatcgattctataaccaatcctataaccaagcctcgaaagcaattagggttagggttaaagcttcggtctttgcctttggctcacttgttgtcttctatgctaaagtctcggcctcatttgaagcttcagggcggtgatgatgttgatttagatgtcgaattgctagatttatcgggttttgatgaagatgaagaggatgaattcgagcgacttccaccgttcaagccattgaagaaatcggaggttgataagctaagcaaagagcataagagagcttatttcgaagagtatgattaccgagtcaatctccttcaaagaaaacagttgaaagaggaagttaggaggttgaaggagctcaagaacaaaccgaaagacagttcggagaacacaatccttaaagaggaagaagaagaaggtccagcaagtgtaccagttgtgatgcctgattttccgattcctctttcatttgactctggcatttcgtcatacaggtaccgtgcattggagaatatcccgaatctccttgtacgtccagttctcgatttgcactgttgggaccacgatttaggctatgatggcgtcaatatcgaagggaatctcaccattgccgaatctttccctggggagttatcaattcaaatcacgaaggacaagaaagagttcaaccttcaattggattcatcaatttgtgcgaaacacggagaaaaccgatcgacaatggcaggactcgacattcaaaggattggaagaaatcttgcttataccctccgaaccgaaacccagatcaagaatttcaatttcagacaaaacaaagcatctggtggtttgtgggttactctggccggagaaaacgtagccactgggctcaaaatcgaagatgagatgactttcggaaagcaattggcagtgactgggagtgctggtgctgtgagatcgaaaggggaaatggcattgggggcgaatttcgaaattagggtaaagagggaagattatcctttgaatcaagatcaatcgacgttagggttttcggtgatgaaatggagaggggatttaggggtgatggcgaatttggagtctcgattttcggttgggaggaattcgagaatggcgattggggttgggatgaacaacaagcaaagtgggcagattagtgtaaagagtagtagcagtgaattgcaaattgctgcaatttggatttttccagttttagcttccattgttaggagtttatgttgtggttctgctgcaaaagactcgaacttgctcgattgattcgggtttttagttgtaataaagctagatgattgccgatttggtattgtttattaagctgcaatgaaaataattttcaaaaccaaaattctctttgcttttggcactaatgttttgtcgtcttattgatgaatcaaaaagatttttgcttacttgatacaaatgattaagttcgaatttagtatatttattccacaatatggtaactaaacctatagaatatatttggtgcagttagaaaaaagtagaattttttccatgtaagatggaagtcttttaagaaaatgtgtagtcacaatatgattatggtagtgtagaaaaattaatactaaattttattttcttgtttgaaatttatttttttaatagggaccttcctttttttacattttttagtttgtttttgaatttattttgcaaatcgtttgattttttatatgtcagtttatagttttgtgttcattttgtttttgcctttgaaactaattatatgatgatatactttttttttttgagtttttattttcatagatgtgtaatagatgatatatcaatttgtactatcattatactaacactatatcatgtgggatatgcaaatattttctaaaagaaaccaaataaaactcacattatattaatattaatataattataccaagattttataccatgtggttaaacaaaactttagtttgctatcttataaataattaaacaagaataaaagtataccactataccaaaattatagtatttgtgaagaactaaaatctaacataagcatatattaatgaaaaacattaaataaaaattatatttatacgaacattatattaaatttatactattgcgagtaaacagaattttaagtttgcattttatgacaaaaaaaaatcaaataaaaaatatggttatactgacattgtatcatatttatattaagtgtaattaaacaaaaccttaaacatatatttataaaaaaaattaaataaaaaataaaattatacaaatattatattagatttatacaatgtatgattaaacaaaaccttaagcatatattttatgaaaggaataaaaaaatatatttataccaacattacataatatttatatcaagtgtgattaaacaaaacactaaacatatattttatgaaagaagcaaacacaaaataattttatacgagtaatgaaataagtataattaaaaatattaagcaaataaaaatatacttatataaacgtaatattagatttataccaggcatgataaaataaaattttaacgaaacaaaaacaatatttatatcatattataccaggtgggattaatcaaaaccttaagcctctattttacgaaagaattcaaacaaaaaatacatttatacaataactataccaagttcctaccatgtgtgattaaaccaaatctttaaacatctatttgttgaaagaaaccaaacaaatacaatttatgccgacaaaatatacttagtttatgtcatatgtgattaaacaaaatattaatcgataacttattaaatataagttacctgtcttgctataagaccaggtcaatgaaaagaaacttatccaatcaaaccttgtatgactcattgagccggctagattcatctagacggcctcgaaacctagctcgcgagacgcccttagctcaaccttgagatagctcggtgtaaacttcgtgtcctatcaggagtaggagtatgggtcacattaaaaccttatcttctcatgtcgtacttatactaatcgaacttgagattcaaggaagaggtaaaagcccagtttggcaaagctgttgtggttactgttactgttgcgatttgttgttacggttttctattatttcttattaggtttattgttattgtttctaactaatttatatttaatgtttgataaaaaaaaatattaaacacggttactactacggatataaattactaaatgaacatattttaaataaattaatataataataatgaataaaattttaacacaaaataaataacaattgtaaattaactaatttcagattaaattgtttaattgaattatataaaagaattataacaaagtaaatgaaactaatttaattattttataataaaactaacataattaatcaaatttcaaattattataaacattatttaaagagttattgcataattatacgtcaaatcacaaaaagagtcgtgtaaaagtagtattttgatataagttgaaaaagtaggtaaaacatgaattaaaaatatctccatatgaattttaaatttcaccaaatacttattaatctccttttactttttgaaactgaaaaaaagacctaattttatatctacgaaacatggttaaagtctagagagtcctattactatcctaataaggactttatacctcattcttattcactcaatacctacataactttaatctcttgaaacctctatctcaagttgctattctgttttccgattattccaacaaagattcaagatagttaggatatgattatccatgaaatatcgaatctaggtaagatattttcgttaattaaacaaaaaatatgtttatattaaaattgtaatagaattatataacgtgcacttaaacaaaatactatgtaaaaatgttacgggttgaagttttgcttgaaatttctctacgagatggtgaccctgaaaataaaaggctggcctgctttccttcactttatccactgaatttcgcttcaatggctttcacttagttctactgctttcctactctactcttctcaactaacatcatcatgtcccttcttaaatctttggcctgctctccaactgaagccaccattgctatgtttcactcttcctcttcttctagggtacatttctgccgcctttttacatcacaatcatcgctttctatacctccaaatgggcaatttcaattgggtttaagctagtcactgatgattggtgaccaatttataagttcatgagtctttcattgatgcacgcaacctgtttgatgaaatgccaatgagaaagttggaatgttctttcggttatggagtttatgctttgtcctttttggtccgtgagggctgaatttaattcaattgctatgaatattaatggcggttttttaaattggcgctaatagactaatttataaattttaggtgtttgggcgaagaacttgtacaccttttaggaatgcgacttcaatacgcttattttactacagaggatgtgcttctgttaaagtcttttctttttttagtacaaagtgctactgtacacattctggtgaatactttggttcttcaaaacgaagatctagaggtccagttatggctgcgaaaaaaggtgtgtatttctgttttttttttttcgtttgaaacttagctctgttcttatggactacaatttggccccatttggttcatagttaattaaaagttcttgtttggatagatggtatggtattatatggtttctatagtttgtagtttaatttgaaggagaaccattgttctatttccgtggttatttgaaccatgaaataatcatgaagaaccatattttaaaaaagaaccatgcaaccaaacaagagattatttattagaaccatatttaaaaaaagaaccatgcaaccaaacaagagattttttattagaactatatagtaccatggaaaaatcatgagccaaacaaggccttcaattcagttcagttcattctactatgctagttataaatttacactaaaattagttcatttcagctcacttcatttcagttcagttcagccaacttcacttcatttcatttcagatttcaaaagttgaaaagaaacatcgccttattatgtattatcaaaagatattcggcttattatgtagccatctttgcttgcttatggatgtttgcttgaaataatttaggggataaacaggaagaagggaagtacaagcacacagttgatttaccgaagacggcattttcgatgagagcaaattctttgacaagggagcccgagattcaaaaattatgggatgacaatcaagtgtataagagagctgtcaaccaaagtactggggtgcgtttgttaccattatatggtgcattaggttcatgaaaattaaatttagtggctgatcttgttagccttttcacaggggagcttcattcttcatgatggtcctccttacgccaatggtgatctgcacattggacatgccttgaataagattttgaaagatataattaaccgttacaaggtattttcctcgttaatatacttaaaatattgatatatgatgtacactgaagattatagtaatttaaacgtcaattatcaaagatggtttgaggttcagttcaataaactgtcaaaaacaataatgcaaaaggaaggagaaag

SEQ ID NO: 545 - DNA, 357 bp, Festuca arundinacea
tctctgttggtaagaggctggcattggtggcaagcacaggagcaatgcgagctcaaggggataccgcgtatggagctaatttggaaatgcgcttgaaggacaaagattatccgattggccagtccctgtcaaccttgggcttgtccctcatgaagtggcgccgtgatcttgccctgggggctaacctgcagtcccagttctcggttggaaggggttcaaagatggcggttcgccttgggctgaacaacaagctgagcgggcagatcaccgtcaggacaagcacctcggagcaggtccagatcgcgctactgggtcttgtcccagtgctagcatccatctaccggagcatctggccca

SEQ ID NO: 546 - DNA, 541 bp, Festuca arundinacea
tcaattgtttgttctgtagtccattatgtagagacatttcttgccttcattggatttgagaaagtaacactgtaattctatcctcctgctaaatgtatcggatttcctgtttcaggtataacacaaaatgagtttgttgacacagtgtctgccaacagattttcttccaatgatagccgtgtatcagaggtcacatccagcccacaggatgcttctggtcatcttcagctagatcatgatagcaagaacccagatccactaaagcaagttgaggcacttcagattaagtttttgcggctggtacacaggactggagtgcctcccagtaccaatgtagtggcacaggtactgtacaggctgcagcttgccaacctgatcaaggctggtgaatcagatgccaagagaactaacctcgctatcaacaaagccagagttgtagcagcagaacaagaagcacccggtggaccagatttggacctccccctgcgaatccttcttctgggaaagactggtgtggggaagagtgccacaattaactcca

SEQ ID NO: 547 - DNA, 831 bp, Festuca arundinacea
tatcagatgaggaggatgactatgatcagctaccaccatttcgccttctcaagaaatctgaattcgaaaaattgaccaaggaacagagaactgcatatcttgatgaactggactatcgtgagacttcatacctaaaacagcagtggaaggaaggaatcagaaggcaaaagcttgctgaagctcaaaacagtgatgtgtcacctgcggttgctgatgattatgaagagagcacatccccagaggttgtgcacatgtcagacatggaaatcccgttaagttttgactctgattatccagcgtaccgctaccgtcaccttataactaatgatcagttgtttagaccagttttggacccccaaggatgggaccatgatattgggtttgacgggatcaattttgaatcatgtcatgattataaaaagaacatatccgcatcaatcgcgggacagatgagaaaggataaagaagacatgtatatccaatcagaatgttcagtaagctatgctgatcagagtggctactccttgatggggggcatggatatgcaaacagcgagtaaggatttggtttgtactgttcatggggatgccaagttccgaaatttggcttggaacaccactggaggaggcatttctgttactaaatttgggacaaggtatttttctggagccaaattagaggactcggtcatcattggtaagcgagttcagttggtagccaatgccgggaggatggttggtggtggacaagtggcagatggaggtggcctggaagtcacagtaaggggaaaagactaccctgtgagagaagggagcaccaccatcgcagcca

SEQ ID NO: 548 - DNA, 448 bp, Festuca arundinacea
gttcttggttcttccatatggttcaacgctattgttgctctcacccatgctgcttctgctcctcctgaaggtcctagcggtgcccctatgacatatgaggtattaatggcacagcgatcccacattatccagcaatccatcaggcaggctgcaggggatatgcgactgatgaacccagtagcccttgttgagaaccacccttcttgccggaagaaccgtgagggtcagaaagtgcttccaaatggccaaagttggaggcatcagatgctgctcttgtgctactcttcaaagatattatcagaagccaactcacttttgaagcttcaggatccttctcctgggaagctttttgggttccgcttccgctccccgccgcttcctttcctgctatcctccctgttgcagtcaagagctcacccgaagctttcccctgaccagggtggtaatg

SEQ ID NO: 549 - DNA, 713 bp, Festuca arundinacea
gtactgtacagattgcagctcgccaacctgatcaaggccggtgaatcagatgccaagagaaccaacctcgccatcaacaaagccagagttatagcggcacaacaggaagcgcccggtgggccagatctggacctccccctgcggatccttcttctggggaagactggtgtggggaagagcgccacgattaactccatcttcgatgaagcaaaggttgctactaacgcgcttgctcccggtactagtaggataaagagggttgatggaaccatcaaaggagtgagagttacagttatcgatacgcctggtctgacgcctcactaccatagccagcggaggaacaggaagattttgcatgctgtcaggcgtttcgttagaaggtccccgcccgatatcatcttgtactttgagcggcttgatcatgttaacagtaaatacagcgactaccctctgctgaagcttgtgaccgacattttgggctcgtcaatgtggttcaacactgtccttgtaatgactcactgttcctcgtctcctcctgaaggaccggatggttatcctttggaatacgatgcgtacacccgttactgtaagaacatcgtgcagcggcatatccaggtagcagcttctaacacgcagctggagaaccctaatgttctggttgacaaccatccaatgtgcagacggaacgccagaggtgaaagagttctgccaaa

SEQ ID NO: 550 - DNA, 1067 bp, Festuca arundinacea; identical to SEQ ID NO: 138

SEQ ID NO: 551 - DNA, 2082 bp, Ipomoea hederacea
ggggatcagggtccgggtaattgacacgccaggacttttatcttcatggtcagatcagcgccaaaatgagaagatactccattctgtcaaaaactttatcaagaaaacacctccagatattgttctgtatcttgataggttggatatgcagagcagagattatggtgacatgccattattacggacaataacaaatgtatttggatcgtcaatatggtttaatgctattgttgttttgacacatgctgcgtctgctccacccgaagacacgaatggtactgccacaagctatgatgtttttgtaactcagcgttcacttgttgtgcagcaagctattcgtcaagcagctggagatatgcgccttatgaatcctgtttctttggtggaaaatcactcagcatgcaggactaatagagctgggcaaagagtattgcctaacggtcaggtttggaaacctcacctgttgcttctgtcctttgcctcaaaaattttggctgaagcaaataaacttttgaagttgcaagatagtcctcctggaagggcttttgcccatcaagcacaatcacctcccttaccctttcttctatcatcctttctgcaaccaagaccacaggttaaattgccaatggagcaatttggtgaggatgatgaggctttagatgatgaattggatgaatcctcagattcggaagatgagtcagagtatgatcaactgcctccatttaaatgtttgaccaaagcccagctagcaaagctcacaaaagagcaaaggaaggcatattatgatgaactagaatacagggaaaagctttttatgttgaagcagttgaaagaggagagaaggcggcggaagacattgaagcaaaggcaagctgctgctaaagatttgcctgctaattctgaagaaagtacagaagaggatattaatggtgcagcttctgttcctgtgcccattccagacatggccttacctgcttcatttgattctgataacccaactcatagatatcgtcgtctggattcttctaatcagtggtttgtgaggcctgtcctagattcacatggttgggaccatgatgttggttatgagggcataaatgtggaaagattgtttgtggtcaaagagaagctccctatatctttctctggttcattatcaaaggataaaaaggacagcagcctacaaatggaaatagcaagttcagtgaatcatggtgatgggaaagcaacctctttaggctttgatatgcagtcactaggtaaggatattgcttatacccttcgcagtgagacaaagtttcttaatttcagaaaaaataaggcaactgctggtctttcggctactctcctgggtgatgccataactggggggtttaaagttgaagacaaatttattgttagcaaacgcggccaggttgtcatttcaggtggtgccatgtttggtcgtggggatgttgcttatgctggtagcttggaagccacattgagagataaagatcatccccttggccgttttctgtctactcttggactctctttcatggattggcatggagatatttcttttggatgcaattctcagacgcaaatacctgttgggcgacacacaaacttgattgcccgtgttaacattaatgataagggttctggacaagtcagtcttcgcctggccagctctgaacagcttcagatagccttaatttgcctggttcctgttgccagaaagatactaggttattgtcagcaagttcaatacacttaatgtgatgaaatcaggtcatacaagattgagcagtatagtcattaagtgtgacttctgcattgttctttagttcatgcttatcattaaaaactcactcaatattgtgttggagaaagttcggatgtggagagccattgtcagagtcttgttcagctttctgaaggatcacctgtgtctggaaaacgttttgttctattctatcttaagaagagatgtaatagaatagtttattttcacgcatttagaatatccggttttgtcactttccatagccttttttcttgagccttgtatctagacttgatgctggaacattattg

SEQ ID NO: 552 - DNA, 1828 bp, Kochia scoparia
  unsure (1)..(1828): unsure at all n locations
tggtaatgagtggcggtgctatggcaggtcgtggtgatgttgcttatggtggaagtttggaggccactttcagggataaagactatcctgtgggccgtttcctttcaactcttggcctctcagtaatggattggcatggggaacttgctctggggtgcaatatacagtctcacatcccgatagggaggtctacaaatttagttgccagggcaaatttgaacaaccgtggatctggacaaatcagttttcgtttgaacagcgcagagcacatccagttagctcttattgctttccttccactgctcagaaagattgtgggccagtgtcaagagcatccaaatggatattgatgaaaaagtaattgattcattcagcactatagtaggaagtaagttcgacatagtcttatcaacagaatttagccgagtgagtaatctttcctttacgttttgtttttcatagccattgtaatattttttttagatatttgcattaaatctcttcttagtacattaaaaaactcaatgtttttgatccaagtattggttgtaaattttggttcactgtgaaaatagtcatttatcttccatgagcacgaaatcagttaccctatatgtgtatcgagcagtttgcttgctcaacctgttatttgcctcagtttttatgccggtaaatttacaagggcataacacataagtgtgagctgctagctggttcatacaatccttttacatgcttgtctgtgtggattcccttctaagattttagattcagtattaaacaaattgaagcagtaacatccaatatagacattgtcaagcttggtaaactgattcgggttgagttccttttattttgccccccttttcttggtttatagagagttgttatatcacatatcagtttatgcatattatctgcatatgtctaggcattatacccggcgttcaggaatgcttgtatacttggatatagcaggtgatgctcgtaggttaattgatgagagagccggtataatgagcaattgggtactaaactcgctacccatttgccacttggatacaaatatacaattgggtacataacttagcaagttagtacttaatagtgagctaatgttgatgtacactcgtggacctcgtggggatttttttttttttgtgtgatgaatgttacagttgaaaacttgaaaggtagttattattttggcttttgatgctgagagggacctggttggtttcgggctttgggagtagggctgtcgatttggttatgaagttgattactgaattgaaatgaactataatcgaatttaactgaactgtattaaattgaaattgaattgaactgataatataaaattgaaccgtaactgaactgaacaaactgaaattgaaattaatcgtttgaaaaccgaaactgaaattaactgaattgagatgaactgaaagtaattgaattgagattaactgaaactaaactgtaagcaactgaaactgcaatcaantgaaccaaaataaaccgaacccaaacgtaactgaaatgcaatcaactgaattgaaataaacttaaccgaaataaattgaaactaaaattaattgaaacaaaattgaaataaactgaaataaactttgatgacatgacattagctttccctccaactttttaaaggcatttgcataagtaggcatggattaatgacatgatattagcttttgtcattggctcattgattagttaggcatggattggtgacatgacattagtttttgccattgattagttaggcatggattggtgacatgacattagtttttgccattgatta

SEQ ID NO: 553 - DNA, 4793 bp, Kochia scoparia
cccacaaaattcgagcacgacccagaaagtttcgcataaatcaagatccaaaattagtgaaataatgtgaggaatttgagtgaattgtgagatttttttatgggtttgagtgagtagagaaggatgattgagaggattagcaggttatgataatgagtgaattgtcttgggaagatggggtatcgaattgagattattttggaaataaattgaataggcggggattattatgagcggacggcaaaaagttcagattattaaaatcaatatttcttaaaatgaaaataataatctcaaatacacatgtttttcatgcaaatctcaaaaacctaaaactccttaaattgtacaaaatgcaagagagaactatgctacccacccccatatattgtactctacctcacacaagaaatgaaaaaaaaaacctaaattaggggttagaatgatagatttattcaacccttaaaaattctgaatgatataaaccaataaggtaaaaggcaaacgtcacataattggcatttttcacgatagttgctaccattagatgcctccctcctttagcaaatagcaaccctctcacaccctcgttaacttcttatcctcatcacatctaacctttttcgtttttcactttcgaagactcttccgagccattatactgctgtcttctgttgcgtcgattgccttcaacggtccctttcttcttccttcgtttttcccaggtttactttttctctcatctctcgttatttttttctttatatatatatatatatatttatatattctaaataattgtttcgtgtttagtgctcgctttgataatattcgagcccttggtgtttgattgggataatgggattgattggttgtaagatctgttgttgtttttggtttttgattgaatgatctgctttaaagttttgttcttgaatgcttatatgcccgttcgttaattggggtttgtttttaattcgtttcattttcgtttggggtttggttgtttgcatttttttaatttgattgagtaaattttaattggtttggtgtgaaatgcaattttttaatacatgggtttttctgggtttttgatgaattttaggatagagtgttgaagagagcttttgtgggatggagaatggggtgaatgttgttgaggaagttcctgtagaagaggtaaaggatgttgaggaagttcctgtaggggaggtgaaggtggttgatgatgggttacaagagtcaaaaggtgatgagagggttggtggtggtggtgctgttcacgggcacaaggattctggtgggtctgaggttttcgaggaggcagttgaatctgctatagatgacgaaaatgatgaattaaagcctgattcagatgatgtccctgttagtgtgagtgcaaatgatgaaagtgatgtagttttttctccagctgtggggactccaagattgctagatgaagtggagagttctgatgttgctgttgaggggtcaaatgaaggaaaaggtgacaatggagatggtattgagattagggaagaattgtcagcggaaaatggtgatgagggtactgttaatcatgtgcatgatggtaataatgggactaatgaggaactttcaactgtggatgagagagtaattggccaagacagaattgttgatgagagagtcatcagccaagacacaggggttcctagtgctgttagagattctgcaatggaagattctcaaggcgaggggttggaagttgctcctttggatggtaatgaggtggaacgtatagaaggtgacgacgacactgttgagaaatctgtagtatcagagatgtctgaaagcagagatgttggaacagtggaggaaaataatctagatactagtgtagcggagaatgttaaagatgtaataactaatgaaggtgttaatcatgcggatgaggtggtgatggaaccaggggttgctttaactggcatctcttctgagagtcaaaacgaggagcttgaagaaagtaagaaaattataagaggaaatctaaagaatgacgaaagagaatctatttcatcaagcgttagccctggccttaaggacagtgttgaagttgtaaccgagaaagttttgggtgagaccaatacagagattcatgatggtaataaggaacctgaaaatggggttttgctccctgaacaacaaaatgaaggttcgaaggttgaaagcaagtcctcagatattagttcttcagttgatggtggagtgttaacttcagcgccacaaaattctgctgcttctttaaaagagaatgttaaatctgagattcctgatcctgatttgggatcaatgactgatgccaatgctcagattcagtctccaggtactgttgctcgtgatagccatgctttggctgagggaaaggttactgaaggaaaaaagattgaggagaggcaagccaatcaagcaaggaaggaaccaactgttaggactgcagaaatgtcttctgttgcatctggaaagtctgcaaattctgttgccccccctactcatccggctggacttggacgtgctgccccactgttagaatctgccccgagagcagtccaccaatcacgagcaaatgggcaagcttctcaggcacaaaaccatgttgccgaagacggtgcaaatggtgagatggaggaaggagacgagatccgtgagaaacttcagatgataagagtcaagttcttacgtcttgctcataggcttgggcaaactcctcataatgttgttgttgctcaagtcttgtacaggttgggtttagcagaacagcttagagcaagaaatggagggcgtgttggtgccttcagctatgatcgagcaagtgccatggcagagcagcttgaggctgcagggcaagagccccttgatttttcttgtacaattatggttcttgggaagacaggagttggcaaaagtgcaacgattaattccatatttgacgaggtgaagtttggtactgatgcctttcaaatgggcactatgaaggttcaggatgttgttggtactgtgcaagggattaaggtgcgggtcattgatacacccggactcctatcatcctgcgctgatcagcataaaaatgaaaagatccttcactctgtgaagcgtttcatcaaaaagtctcccccagatattgtgttgtatcttgataggctggatatgccaaccagggactttggggacatgccgctgttgaggacaattactgatatctttggcccttcaatctggtttaatgctatagttgtcttgactcatgctgcatcagctcctcctgacggtcccaatggcactccgtcaacttatgatatgtttgtcacacaacgatcacatgctgtacagcaagctattcgccaagctgctggagacatgcggcttatgaaccctgtttcattggttgaaaaccattcagcttgcagaacaaatagagctggtcagagagttttgccaaatggtcaggtttggaagcctcacttgttgttactctcatttgcctccaagatattggcagaggcaaacatacttctaaagctgcaagataccccatcagggaaaccatttactgctcgtgcacgaccaccacctctgcctttcctcctctcttcacttctgcaatcaagacctcaattgaaacttcctgaggagcaatttggtgatgatgacaccatggatgatgatctggacgaatcctctgagtctgatgaagaatcagaatatgatgaattgcctccatttaagcctttgactaaagcccagctggctaatctgcctaaagctcagaagaaagcttactatgatgagttagaatatagagagaaacttcttatgaagaaacagctgaaggaagacaaaagacggcggaagctgatgaagaaaatggcagcctcagccaaggacattaccagtgagtacaatgaaaatgttgaagaagaatctggtggtgctgcatcactacctgtaccaatgcctgatcttgcattacccgcatcatttgattcagataatcctactcacatatatcgttatcttgaatcatctaatcaatggcttgttaggccagtgcttgataatcatggctgggatcatgatgttggttatgaaggaataaatgttgaacgtatgtttgcggtcaaagacaaaattccattgtctgtttcaggtcaggtctccaaagacaagaaagaagctaatcttcagatggaagtagccagttccattaaacacggggaaggaaaagctaccactttgggctttgacatgcagagtgttgggaaagatttaacctacacattacgcagtgagacgagattttgcaactacagccggaataaggcaactgcaggtctctctgctactctaatgggtgatgtagtgtcagctggactgaagctagaagacaagttgattattaacaaacaattaaggatggtaatgagtggcggtgctatggttcactgtgaaaatagtcatttatcttccatgagcacgaaatcagttaccctatatgtgtatcgagcagtttgcttgctcaacctgttatttgcctcggtttttatgccggtaaatttacaagggcataacacataagtgtgagctgctagctggttcatacaatccttttacatgcttgtctgtgtggattcccttctaagattttagattcagtattaaacaaattgaagcagtaacatccaatatagacattgtcaagcttggtaaactgattgtcattgcaggtttggaaaggaaagtgagaacgaaaaaaa

SEQ ID NO: 554 - DNA, 704 bp, Lolium arundinaceum
cctgctggccttggatcatcgacttccttgttgcaacctcccgcccgacctgttcagcaggtccgtgctaatggtccagtcgctgtggacagggatgctcggcaggatactgaatctgctggggatgatggagatgagaatgatgaaatccgtgagaagctccagatgatccgggtcaagtttttgcgtcttgcaaacaggtttgggcaaacgcctcacaatatggtggtctcacaggtcctttaccggctcgggctggcagaacagattagaagaaatggtcgtggtgtttttagctatgaccgagcacaagatatggcagaacgccttgaagctgctaatgagccccttgatttgtcttgcactatcttggttcttggtaaatctggggttggcaagagtgctactatcaattcgatttttgatgatgtcaagctagagactgatgcttttgattcgagcactagaaaagttcaagaagtagttggtacggttgagggaatcaaagtaaaagtgattgatacacctggcctttcgagctcatcttcagaccagcactacaaccagaaggttctcaattccgtgaagaaacttgtcagcaaaaaccctcctgatattgttctttattttgaccgactggatatgcagagtagggactacggtgatgtccctctgctgcagagcatcagcaaaatgtttggagc

SEQ ID NO: 555 - DNA, 1843 bp, Lolium arundinaceum
tacatgaagaaatgcccgcctgacgtcgttttgtatgtcgatcggatcgatacggaacggcagggtgcaaatgacctatccctaatgcgatgtatgaccagtgtgctaggcccatcaatatggcagaaagtcattatcactcttactcactccgcagcagatcctcctgaaggacccagtggctccccaatgaactatgagatggccgtgaaccatcggactcgtgcgctgcagcaaagcatccggcagactactaatgacgcacggacggagaatccagtggctcttgtggagaaccatcacctttgtgagaggaacatggagggtgaaaaggtgcttcctgatggccttatttggaggcgtctgctcctgctcctatgttactcactgaagacggttgctgagattgatagtctttcaacccgccgtgctgcttctgcaagcctctttggtgtccgtcttcagattcctccacttccttactttttatcatctttgttgccatctagagagcaccccaggcatgcaagcgaacagaagcttgaaagcgtggactcaaatgttgatattgatgaattgcttgatgaggatcaagaggatgaagaatatgactatgatcaacttcctccctttaagccattaagtaaatcacaggttgcaaaactctccaaagagcaacagaaattgtattttgatgagtatgactaccgaaccaagcttcttcagaagaaacagttgaaggaacaacgcagaagattaaaagaaatgaagaagagcgagggcaataatcatgatgtacctgagaacaatgatcatcctgatgatgagtatgacaacgatagatctcctatgccagactgggccttgccatcctcatttgattccgatgatccagtataccgttatcggtgtcttgagcctacagcgaaccttctcgtacgtgctgttaccaaccctgaaggatgggatcatgattgtgggtttgacggtgtcagcctccagtacagccatgatattgccaattcatttccaggtttgctgtgggtccaagtcaacaaggacaagagagaattcagcattaatttggagtcctcaatatcagctaagcatagcgagtatgcttcaacccttgcaggctttgacatacaagccatgatggaccagcatgcttacactctcagaggggaaaccaaattcaagaatgccaagaaaaatgccactactggaggtttgtccatgacttcagtgggtaacaccatggtgactggagcgaagtttgaagacaagttttcagttggtaattggttaacactgatagcaaacgctggtgctgtgtccatgaaaggtgatactgcatacggactgaatatggaagcgaacctgcttgaaaaagactatcccatgggtcaaggtcttgcaactctgggtgcatccctggtaaggtggcataaagaatggactatggctgcaaacatggattcccagttctctgtcggaaggacttcaaacatggcagttcatgttgatatgaacaacaaactaactggacgagtgagcatcaaggccaacagttcagaacatccgaagattgctctactaggtatcttttcggtggcaatgtatctgtggaagaggatgcatcctggtgcagattctgattatgagtagcaccggttagtagttagcactgtagttttgatttcctaacatttttattctgttacttgtccctcttgttccagtttgtagttctattaaactacagcttcttctgttccttgtatgtctatttgttttcacctagctgtaaaatttatgcacatgtatgtgctaaataacactg

SEQ ID NO: 556 - DNA, 2585 bp, Lolium rigidum
tgccccctctttgctggctcgtcctgctggccttggatcatcgacttccttgctgcaacctcccgcccggcctgttcagcaggtccgtgctaatggtcctgtcgctgtggacagggatgctcggcaggatactgaatctgctggggatgagggagatgagaatgatgaaatccgtgagaagctccagatgatccgggttaagtttttgcgtcttgcaaacaggtttgggcaaacgcctcacaatatggtggtctcgcaggttctttaccggctcgggctggcagaacagattagaagaaatggtcgtggtgtttttagctatgaccgggcacaggatatggcagaacgtcttgaagctgctaatgagccccttgatttgtcttgcactatcttggttcttggtaaatctggggttggtaagagtgctactatcaattcgatttttgatgatgtcaacctagagactgatgcttttgaatccagcactagaaaagttcaagaagtagttggtacggttgagggaatcaaagtaaaagtgattgatacacctggcctttcaagctcatcttcagaccagcactacaatcagaaggttctcaattctgtgaagaaacttgtcagcaaaaaccctcctgatattgttctttattttgaccgactggatatgcagagtagggactatggtgatgtccctctgctgcagtccatcagcaaagtgtttggagcctcggtctggttcaatgcgatagtcgtgttaactcatgctgcatctgcaccaccagatgggccaaatggaattcctcttagctatgagatgtttgtcacccagaggtcccatgtagtccagcaagcaataaggcaagcagctagtgatgttcgtctcatgaatccagtcgctctggtggaaaatcactcagcttgcaggacaaatagggcaggccagagagtgttgccaaatggacaagtctggaagccacagctgctattactctgctttgcttcaaaggtcttagcagaggccaattcgtttctgaagttgcaggatagtcccactggtaaaccttctagtacgaggattcctccacttcctttcctcctctcttcacttcttcagtcccgagccccgctgaagttgccagaggagcagtatggagacgatgacgatattgaagatgatttagtagatggttatggttcagatgatggctcagactatgacgacttgcctccctttaagcgcctcacgaaggctcaactttcaaagctcaaccatgcacagaggaaggcatatcttgaggagctagactatagagagaagctattctacaaaaaacagctgaaagaggaaagtatgcgtcgtaaaataatgaagaagatggcagcagaggccaaggatcgagtagatgatttcagtaacaacaatgttgaggatgatggcagtactccgaccaatgttgctgtgcctatgcctgacatggtattgccctcaacttttgattctgactatcctagccatcgctatcgttttctggatacaccaagtgaatggcttgtcaggcccgtcttggagacgcagggctgggatcatgatgttggttatgaaggtctgaatgttgaaaggctatttgctgtcaaaggtaaagtccctttatctgtatctggccagctgacaaaagacaagaaggagagctccctccaaatggaggttgcgagttctattaagcatggcgagggtaaaactacttcagtcggacttgatatgcagtccgttggtaaggacatggcgtacactgttcgtggtgagtcgagatttaagaacttcaggcgcaataacacggctgctgggatatctgcaacactcctgggagactctgtctcagctggtgtgaagattgaggacaaactgatagtgaacaagcagctgaggcttctggtaagtggcggtgctatgagcgggagaggtgatgcagcttatggtggccgtctcgaagcaatactaagagacaaagattacccaatagggcgcatgctttctactctcgcgatttcggtcgtggattggcatggagatctggcagttgggtgcaacgcccagtcccagattcctgctggaagatctagcaacttgattggcagtgtgaatctgagcaataaggggaccgggcaagtcagtatccgcctgaacagctcggaacatctacagatcgcgcttctcgccctggtgcctatatataagaacgtcaggaagttactggatagctactatgaatctatctagtatagtaggaagagacagcgagaagatccttagggttaatggaatcataaaatggaactctccatatctttatttatttttctaatctttgtcagctttgtaacaaaattatattttcccgagctctgctcggtgaggttaaattttgggatgcatccatgtcatatgtttgaatggccattaagctggcaacctgatgcggttgcctactacacctgttccaaaaataagggtgcaactttatctaagtatggatgtttgtagacacattttagtatgtagatatacccctatctagatgaagtgg

SEQ ID NO: 557 - DNA, 2277 bp, Portulaca oleracea
gaagtcagattcagttgatgatgccatttttgccgatgctaatggcgatggtgatcccgttgtggaggggaattctggagtagatgaccaggagaagacaacccagcaggacgaggttgaggttgagggttctactgaggcagtaaatgatgaggaagagagtacaaaggagaaggatgttttattgagcgcagagaatgaagatagctcagtaggtcatttgaatgacaatgatagggcggttagtggtgatgaggaggttgcaactcatgaggatgggcattctaccatcagcgatgacagcacagcagaggagtctcccagtaaggtgttagaagttgatcctgtcccagttgaggacattaaaccagtagtctgtgatgaagaggtggttgagaagtctgttattacatctgaaaatgggggtactgacaaaacagaagtagatgattcaggtgctagtgtatctgaggacacacaagtaacagctaccaatgggggcgttaatcatgtgagtgagacgatggcagaacatgaggattcttcagctgccatttcttccaaggatcaactggagaagcctagtgacagtggcattgcagaagcggaaggtacttcagaaactaccaataccgaacatgagctgaacaatggagttgcatctgaggagtcagagattcaagatgttcctagaatgcctgatgataatgagacaacatcacttgtagaacctcaggatggagatgttccagctgaagaaaaaccattagatactagtgtttcagttgataacgtatcagagactgcagagaaagaatcaccaactcctttggccccaactccagtagagaaccatgcgaaagatgaacctgaggcctcttcttcagggacaaaggatagctcgtctgatcagttaaaatctcctagtatagctgttgctgacaggcaagcttcaactgaggggcgtggtgttgatgaaggaaaaagagaggaggagaagcaaagcagtcaagaaagcaaggaagcaaccaagccagctcaatctggtgcttcatctgaaagatctgtgaagcctgcggttcctcctgcacgtcctgctggtcttgggacagctgctcctcttttagggcctgccccacgagcaacccctcaaccacgggcaaatggtcaactatctcaagtacaatcaaacgttgctgaggatgcaactaatggggagggtgaagaaggcgatgagatccgggagaaactgcagatgattagggtgaagttcctgcgtcttgctcacaggcttgggcagactccccacaatgtcgttgttgctcaagttttgtacagattagggttagcagagcagcttagagctagtagtggagggcgtgttggtgccttcagctttgatcgtgctagtgcaatggcagaacagctggaagctacaggccaggagccccttgatttttcttgtaccattatggttcttgggaagaccggagttggcaaaagtgcgacaatcaactccatatttgatgaagtcaagttcagcacagatgcttttcagatggggacgaggaaagttcaggacgttgtgggtactgtgcaagggattaaggtgcgggtcattgatactcctggactcttatcatcttgtgctgatcagcgtcagaatgaaaggatcttaaactctgtgaagcgtttcatcaagaagtctcctccggatattgttttataccttgataggctggatatgcctagcagggattttgcagacatgccattgttgaggacgataacagagatatttggacccccaatatggtttaatgcaattgtggtcttgactcacgctgcatcagctcctcctgaggggccgaatggaactgcttcaacttacgatatgtttgtcactcaacgctctcatgctgttcagcaagctattcgtcaagctgctggtgacatgcggctcatgaaccctgtgtcgttggttgagaaccattcggcttgtagaacaaatagggctggccagagagttttgccaaatggtcaggtttggaaacctcatttgttgttgctttcttttgcttccaaaatactggctgaagcaaacactcttctgaagctgcaagacactccacctgggaggccattcagtggccgttcacgtgcacccccattacctttcctcctctcttcgctcttgcaatcgagacctcaactgaaactccctgcagagcagtttggagaagaggatgcgttggacgatgatttagatgaatcgtc

SEQ ID NO: 558 - DNA, 1116 bp, Portulaca oleracea
gtacctgtgccaatgccagatctagccttaccttcatcctttgactctgacaatcctacacatcggtaccgttatctcgatacatccaaccaatggctggtgaggcctgtactagacagtcatggttgggatcatgacgtgggttatgaaggcataaatgtggaaaggatgtttgtggtgaaaaacaagatccccctgtccttctctggtcaggtctctaaagacaagaaagaatctaaccttcagatggaagttgcaagttccctaaaacacggggaaggcaaagctacgaccctgggttttgacatgcagagcattgggaaagacatggcttacacattgcgcagtgagacaaggttctgcaattacaggcacaacaaggcaacagcaggcctgtctgccactgtgttgggcgatgcagtatcagctggggtgaagatcgaggacaagcttatcgttagtaagcagttcaaaatggtaatgagtgggggtgccatggccagccgtggtgatgttgcttatggagggagtttagaggctaccttgagggacaaagactacccactgggtcggttcctctcatctctcgggttgtcaatcatggattggcacggtgaactcgctattggttgcaacatccaatcccagattcctgttggacggttcactaatcttgttgctcgtgcaaatttgaataatcgtgggtctggacaagtcagtctgcggctcaacagctccgaacaggttcagttggctcttattggtctgttacctttgatcagaaagctgatgggtggaggatatcaagatcttccttatggacaatgatgaaaatttggttttgtgcccttgcatgatatccagtttaagcttttaggtaacttcatgtcatcagaaagcaggtaatcaacttagtgagtatgtcatctccttttgctttgaataactaccataatatttttgttagaaatttttgtcctcgagatgtgtactcaatctggaacgccaagttattgatcttagtgttattgctttgttaaattttcctttcgtatgagaatttctttttttaaacttgtattacttctgagtttgtgacaaccccccccccccccc

SEQ ID NO: 559 - DNA, 11055 bp, Portulaca oleracea
  unsure (1)..(11055): unsure at all n locations
ttgatgactcaatcccaagcttcctccttgggaaggagcttaacttgcgcgtcttatgaattatgttttcagtgtttgtgtctggcgcgtcttatgaatggttactttgatgaataagatcacccaatttatgtcattttttgatattgagcaagtaactaaagtaaataaacaccaactaaaatattgaatttttcatacttcaattgattttaatagttattttagtcttgactcgccaagattagcgatttagatagaaatattaaaatgcgttcaataaatttagtaatttaattaattgattatgtaatttttactaaaaaaaatatgaaatgatacgtcaaatattaactaataactttattaatgtttcagaaaaatgtgtttgtaactctaaatgccacatgaaatgctagttgatcaaacaataatgttactcaaactagaattttgactgagttaaaacgttaaacatcatatcaaacgtcattacacaatataacgttattaatatttacatgaattataatcctatcttcttttagataggcttctttttagcatcgtaaagtactataattgtaaagtttgcatggcaaggtaaaattgtgtagtgttggtgaacttatttatgctaaatgactatacaaatacaacatactaacgtcatcacctagagtaattatcattatgagtatctagataacgtaagtgttgagatggacaatgtaagcaaaaggaatttgttagtagcatttcgaaaagggatgagacatagaacaatattgttttagagttgatatagagaaattatatacaatgtgaagctcgtataaggaatctaatatatgtgtcaatgcaatagtcttgttaaatgctccactacatatcttgatttccctcgccaactcaagttcgtcctagggagctagatgtgcttgttagtatgataacatacgactctacaagcttaccagtacaattgttgttatatatgctactcaacacatactttacctctacctcccaagcttccgctgatatgaatctcatttgtcaatgctatagataaggagtcacgtgcaatgtcaagcttatctaaaaaaagtctgccactaatataaatcttatttgtcaaggaatcaggtgcaatattaagttgatctaagaagttcgccactaatataaattttatttaccaataccatagataaagagtagggtgcaatgtcaaacttgtctaagaacatttatgcatgggtcaatactataacatcctatatgggatatggctgcatgatacactctccaccacttcccaccactaggaatctcacttgtcaatttctaacattttccccttttccataaaacagaacatttaaaaaaaaaataaattgttctggaatttaaaaaaaaaggaaaagaagaacaacaaaaagatctgaaaaaactcgaattgcagaacagaagatcaaaatcaccancttcatcttcttcttcatcgttctcttcttccccacccatccctttcaaattctctctacacattctgcattcctgttctttgaaatcgattcatttaatcctaacccttttcagttctttcgttctcaaatccccccatcagtaagtctgatcttcacacacagatcttcagatgaatcatccccatcatcatccccttcttcctgaattcgcaatcttgatcagctgaatgcctgttgaattgctcgattccgccatttctagggtttctgttccaatcaaagcagcaaaagaagaagaagaagaagaagagtttgtgatgcgattgcgatttcgatgtcgaagatcagaagcatttcactcccgcagccatgcccgcacctgtcggagttccgatccaggcacggggcccaccccttccgtgccctccaagactgcgtccgtgccgggccgatgggccgggccttcatccgccgcggcgacagcttcgtcccccggtgctcgtcggcgaactgccccacgcgccaccgcctgtacgcgtgcgtggcatgcgccgccgtgaactgccacgcgcacgctgccgcgcactccgtcgccgagggggacggccacgacatcgccgtcgacgtcgacagggccgagctcttctgctgccggtgccgcgaccaggtctacgatcccgacttcgacgccgccgtgctcgctgccgcctccgccgacttcccctcccctccgccgcccccgccggagaacctccgcaagcgccgccgcgtcgactaccgcccatgggagcccggccccaccgagcgccacctcatcgcccaaaacgccaccgttttgaccgggtgttcgaattcggggccgtcggagattccatgggggttgagagggttgaataatctggggagcagttgtttcatgaactcagtgttgcaggcattgcttcatacgccgccattgaggaactacttcctcagtgatcgccataacaggtacttttgccaaagaagacgcaacactgttacgaggagaaagaatgggagttctaataccaacgcaatttcgaaggagaatttgaagaatagtttgtgtttggcttgtgatttggatgctctgttctctgctgttttctctggtgatcgcacccctttcagccctgctaaattgctctacaggtgagctcctatggatgtttcttttcgcctgttgacaaattttgattctttttgattctgatctttgtgttgggtgatgggttttttcaaggagggattaataaatacagggtctttgagttttagatgattaaaaatgtcattttcagttagtatacatttcaaagtattggactttcagtgagtatgagagagatatgtctttgagtttcaaactttccttgtttttatttgaaattttacccttttggtgtatagatgtaaaattatggtaatttaatagaaatgggaaaaggatgtgatccatgaagctgcccttgctgtgtctgtttcttggctgctggaatgtctgttgaaattcgggtgattgtaatttgtagcgaactcaaaaatggaagcttgaagttataccgggctttgggatccttatatgttttattctttttctcgaattcttttggtacaagtaaattaaaatctatgctacgattgtccttgtcctcacagaaatgaaaaagggatagggaatttctatacgcgcatttcatttatagtggagaactgttttgtgtcccactgaaagaatgtctcaattgttgatgtgtacgtggttgtgtagttggtggcaacatgctgcgaatttggcaacgtatgagcagcaggatgcacatgaatttttcatttctatgcttgatgggattcatgagaaagtggagaaggatcggaccaagctgcaaagtcaaggtagattattcctcaatgctaatatatgtttagttttagtgcggttattgattgttatttgttgataaatgtaatgcatcagtgatatcaaattcatagtttccagaaaacagtttgggagattctgtggctctttcattttcattctttgcttggttggctttgacactcaaggaacaacatgctttgttggagccttttcactttcatgtctcgcaagtttaacttttcttggggacaatattatggtctctcagtttcagaaagctttttccattgtccttagatgtacaaactgtttactgcatactacttttcatgaccgaaaattgtattaaaaaacaaacagctactccaagctgatttgattatgtttcttgaagcttaattattattagtatacagtagttttgcaaactgtgaaatgggaattataagtgttgaaaactgtatggatttccaaggagcatgttcgtcatctagaccatctggtaaatattgtaaatgaaccttgtcttgaccacagtgcatctatttgaaataatatttcttgggtactggaatccacaacgatatgaggatacaaagacgtcttcatatgggggaaatattttctcaggaggtctcgggctgcctaccttcttttcaactgttgtaactgagaagctatgtctattgcttttatccaaagaagacatagagttctttcaggaatgctaggtgattcctgaaaggaagggtaacgctcgagtgacgtaagttgacatatataaggaccggtcccattaaattttatgataaggaaacgggtcctgttgcaacacaattcgtaagtattttggtttgtctgatccagggtacttttataggagatgagaaacagaaatttcaatgcgatttgtggctttagtagttcttgtatacctcccttaggcattgactggtgtcagattattttaaggccttcctgaaaacttcatccttgatggcatggagtgaccttcctttcctcctgtaagttatttttagttatcctcgtctacttggtttgatcttaggattttcctgtgtcacgctgattctgattttggctccgtctcttttgtctctaggcttgtattacctcaaatggatggtctcaagctcgggtgaaaaggggtctcccctaagttggctgctctttgtagacaattttaaagaagctcatacagccttttaatgcttacccaagccttcacccataagattgagtcaaagcttcttgatccagtgatggtatatctttggagttgcctgtttgagttctaaggtgcgaactggctctcttaccatgaagtactatgacttctatgtttgttctccttacctagttcggtctgaccaggaaaaaccgagtatggtcatagatttttcgtctgcattttgtcattgaccgaattttctgggtacagacgctatttttcctatttttgctgtccgagtccgaatttaggcttgtccaaattttatctgacccggaatacttgacatcagcttttgtctgatgtacaattcgtcgggacccaaaatggcttaaacccaggttttgacggccctactctgaacctcaaactaccatgttgtcatacttttacataattcagggaacctcaaactgtcatgtatttgcactgctccatacttgaataatgtttagtttgcttttgcataatattctgacccgggtgttttttgctgcagtaagcggggactgctgcattgcccacaaagtcttttccggagtcctaagatccgatgtcatgtgtatggcctgtggtttcacttccaccacatatgacccgtgcgtggacatctccctcgatttagaacccactcatcaaccaaaaaccgggcccataaagtcccacaactcctccaacggcgagctgcgtcatatgcatccaagccccagttccagaacatccaccctaaccggatgcttggaccgtttcactcggcccgagaaactcggggccgaccagaagttcttctgccagcaatgccaggtcagacaggagtccctgaagcagatgtccataaggaagctccccttagtttcttgcttccacatcaagagattcgaacactcttcgttacgcaacacagcaaagaaggtggaccggtatcttcagttcccattctccctcgacatggcaccttacttatcctcctccatcctgaggagcaggctcgggaaccgggttttctccttcgagtgggagaatcatcaggataatagtcctcccgacgacgaactgtcatccgagtttgagctgtttgcagtgatcacccactccgggaagctaaatgcagggcactacgtaacgtacttgagactgagcaaccagtggtacaaatgtgatgatgcctggatcacccgggtcagcgagagcaatgtgagagcagctcagggttacatgatgttttacgtgcagaagactttttattacaaggcaagcgaaacatctcaggggtaactgcgtactgttttgtatagatcgatctggggccatcaacattggttgttgtatcaagccgaagtaattcagtttggaggttcgagttgggcatggttttggagaagtgaatggttatttttacccttcattcatctgggatggtggctggagattttacattttgagcagtcaaatattaggcctgttaactgttaacatcttcccaatgttgtcttttttgtttctaggtacattcttttttaattgccttcaagtgttcttgggtgaattgggataatgaaaggcagcaaacacttgaaggtgcattttgcccatttgtacacattttaagtagccaatcattgtcatgttggcaatctaattgaaaaggatgctgaaaatttgcactttgtagttcctctctaaacccctccaaacatccccaaatggttgctttatcctaatctctttttggaagtgttactaacatgattgtaagtgtataaatccatggaacttttgtcaaagttcaaactttgaataactggtcatctctaattaagttaacattgacgtgtaatcttcaacaatcaatttgtttgctcacagaaaatttgagagattggacaatcacgttttatgcatgatatagtattaccgtccaaggaatttcaacttattgagtttagacgtgaagggttcatgtctaaatcttgtttatacatgataacaatagtcaaaatctcaactaaactaaaataataatcttgaaaaatcaggttcaaacttctacaatttatgctcaaattattatgatccaatgaccaacagattttagtctataatataaactcatcaaattatctatttttcacattttcactgttaaactttttcacttgtacttgaacttattataaaatccttactttactcaaatttctcatgtcttaaacagaaacattcactcaagtgcgtttttacactaggcatgttccaacttttacttatattaacataacttaaatttaacaaattctttttattaatttatcaaaaatttagataatgtaccaataagatccaaattcatcaaattttacctaatgaccccttactctattgtaaattataacacaccctaaagtctaggtatgatatccaagggttcgcttgacctaacacagggtgccacatgtcctgatccccaatacaccgaaatctcaacatcatcggcaatttgttgtctttgtgttgaattctcaaccttctaggtcgcagtgtatctgaattctcaatacaatcgccaaacaacacaacaaccctcctcgtttattcccccctcttcctctactccacacccatcaatccgcttttcatttctttcggtctttctttcttttttgcttgcttgtttttgtcttctcaataaactgtgttctcatccgcgacaaagatttgtcttcttgctatggagttatgatcgaacgattccatttggtggatttcaattgtcaaaattcaatcttagatgaggggaaatgattcagtgggtgttgattggtagtgggtcggtggtgttctgatcctattttggtggggcgacatttggataaggtatttctcttgttcttatctgttctttaatgattatgaaccgagattttctgtattgggtatttgaatcagtgcagtttgattgtagttttagccgcaaattttcgattttggaggtttatctgaagtgggtatgtctggaatgcagagaagtttgaagtttggtttctgggtatgtgagaattgatgatgtttaacttgtttcagattgccatgggtgtgtaatcttcctaatcttggagaaatggagggatttgtgtgacagttttgcttcggttgagagtagtattgtactgaaatatgttgaactagagtatgatttctgatttactatgttttggatgaaataaacctttgcccaattagaaactttgaggatttttagattcatgattcatggttgaactttggaggaggctttgttttaccgaggaactcgattggaagtaattttgtgctgcagcattggggatgtgtgtgagcttcgctaggatctagatacttgttttgaggatgcttgatttctaagctttcaatttaatgatgaattggaagagtttggaatctgcattgtgcagttaatctaagtttacccctattcgcgttgatcattttggtggttttgttacgatgccagtgccacccttttttctgttttaattagaatcgaatcatatcaaggaggtgatgtgtttgtttattggtttaggttccccttgaaacgagattttgggtgtgattttcatcccatcgctattttattgacatcctcttcatgtctggttgaagatgaagagcatcagagattgggttttcgctcagctagaatctggttcgttggtcttgccgaggctgttgttgagcagcagtagttttttggaggaggaatctgagaacaaggagcttccctcctcaggtactggtcatgaatgcgcacatattttattatcggacacatgtcatttatcttttatggttagtttttgttctgctttgacaagaacattgttttgcgtgttattttgttgacatgccaattgctagtagcattgaaagatttagtttagtttggtgaacctgggtcaatccattcagaccatgtctattagacaaactcttagatttctttgcttcatttgggtctaatgcttagtgtgacacctgttataggtcgtgatttgtggcgtattgtagaaaaacatagagaaatcaaggggggttgaattctaataatctgaacctttgggactttgggagcgagtaacccgaacattagaaatccttgccaatgtggtgaactttcaaagttgtcactttcaagaatccatactaaagaaagaacacatttcaatgctccaatttcagctaatgggcagtttttcaaagtatggattattggtagtaatgatacccgaagttagtgtctatagtaactatgaaagtgaggcttattttccttggatgagaaccttgcttactgttgtcaggttctcctgagagtgggcatatggaagtatcacagtcacgcgctaacgcgtctcctaattcagacagcaatcaagagagccaaacagttataccgtcccaacaagcatctcttgttgaaaatcctcccacttctcataatcctactgaccgaaagaaatctgatccattatcaaaagttgaggctctacaaatcaagtttttccgcattctacaccgtcttgggcaatcacctgaagatatcctcgtggctaaggtcctgtatcggattcatctcgcaaccctaataagagcaaaggattccgatctgaaaagaatcaatcttaggaccgataaagccagatcattagctgcagaacaggaggcagctggccatcctgtgttggacttttctttgagaatacttgtcttggggaagacgggagttggcaaaagcgctacaataaattctattttcaatcagaaaaaagtagtgactaatgcattcggtccagccactgaaaaactcgaagaagttactggagttgttaatggcatcaaaataactgccatcgatacacccggtttctggccttcctctccaagcaacatgcgaagaaaccggaaaatcatgcgctccatcaaaagacacattcggaaatccccaccggatgtcgttttgtacctagaacgcctcgataacttgcacaagggctatgccgatttccctctcctgaggctcttaactgaagttttcacccccgcaatgtggttcaacacaatccttgtcacgacacactcggcgggccctcctcccgaggggcccaatgggtatcccattggctatgattcgtacgtggcccattgttcggacatgctgcaacgatacataaagttggctgtttctgatgcaaagcttgaaagccctgttgttttggccgaaaaccaccccaagtgcaaaaccgacatgttcggtgagaaaatcctcccaaacggggtggtttggaagcgacagttactgtttctgtgcttgtgcacgaaagtattgggggacgcaaacgctcttttgggacttcaaaacagcatcgagcttggaccgtctggcaactcccggatgccttctcttcctcatctgctctcatcttttctgaggcaacacccggtgatgaaccctgacgaatcagcagttgagttggatgacatttctgtttttgacgacgaagatgaggaagaatatgatcagttgccccccattcggatcctgacaaaatcccagtttcggaaactgagcaagactcagaaggcggcttatctcgacgagctggattaccgagaaaccctgtttctgaagaaacagctcaaggaggagctactcaagatgagggagaggaaattgcaggaaaactcaagatcggacaacaatgaggaggaggatcttcctgatgcaccagagcctacttcaatgcctgatatggctgtgcctcaaagtttcgactcggatcatcccttgtacaggtaaattattaggtagtaccatcaactgcaatttctttttttatttattttcgttcctaactcctatttttcctttatactccatacattcctactttgagatataattgtgttgggaatgatgaaagtaagaggtaaatttggtaacaaattcactaatgttgtattggaattgtaaagtgttagatattgaggaatggatggagtatgaaacaacatgtgagagggactaccttgctagattagatagaccgggaaatacttaataacaacccccttgtacaggtatcgaggtgtcatgacaagcgatcagtggctatggcggcccgtgttggacccgcacgggtgggaccatgatgtgggttttgatggagtcaacttggaatcatccacccaggtgaaaaggaacctaaccctagcaatctcaggacaaatgagcaaagacaagcgtgatttcagcatccactcgcagagcgctctaaccttcgctgatccccggggccccacatactcagccggcctagacttgcaatctgcttccggtcagaagg

SEQ ID NO: 560 - DNA, 3937 bp, Senna obtusifolia
aacttaggccttttgaactgaagaaaagggagaaatgaagaaggaaggaaacgaaagtggaaccacaaagacataaagaacatgaaaaagaataaagagtgcataattcataaggttcaatgagccacaataaatgactctaactctagtactgggagttgagatagaagtataatccagcaagagctacaattcccaccaccactgcaataggaagtacattcccaacagcttcatctttcttaagttgggcttttcgtgcctttcgaacttctgtgctattggcatctttcgtcacagctggtgcatatgccttaaatcttcgttttggagcaccacacacaggacagaagtaattatcaggcaatttgtcaaagggagttctgtcgttgtaaatatagccgcaatcacgacagatataggcttgctttgaagcgacacgcatggaaattctgggagcagcagaaagaagatggagatgatgaggatgaagcaagagattaagagaaccatagaaggaagatgatttgagagcaaaaggattgaagggtggtggaagggcaacattaatgacagaaggggataatgaagaaggagacttgagagtgtgaaggatgaggaagttgtcaaagagcatgatagagagcaagcaattccagtggaagctgacagtggtgctcaagtggtcgcagcaggagactctgttgttgacgccgtacaggtaaatgtgttgccatctggagtggctgttgttggtgacaaggaggacattgatacctctgaaattcaagggatggaagctccagttggtgttagcttggaaaatgggtttgaagcaattgaaggggatactgaagaacctttagataaggttgagactttggatgctaagtctgattctaatgtagatgatgacgatactaaacatgcagataaggggatgcatactgcttctcaggaaaatgctgattttgaaagtcacagtgttgagacagaggtaaaggctcttcaagatgacataaacgtagaagatcttgctaacgagggggacactaggagccatgtcgaggcttctggtgattcacctgcatctgaatatgtggatcctaattcttcctcaagccgagaaatgagacaagaggaggatgatgaagtaaagtttcattctggtagcagagagattgatggttcagtttcagatgaggatgccgaaggtatgatctttggaagctccgaagctgcccggcggttcatggaggagttggaacagcagtcaggtgctgacggttcacaggatccttcacagagaattgacggtcagattgtgaccgactcagatgaagaagtagacactgatgaagaaggggatggcaaggagctatttgattctgcggccttggcagctcttttgaaagcagcaactggtgctggacaagatggtggcaatatcacaataacctctcaagatggatcaagactgttctctgttgagcgcccagctggtttgggaccatcactccagtctgtcaaacctaccgctcgaccaaatcgtgtcagtcttttctctccttccaatcctagagctggtgctgaatctgatagtaacttgagtgaagaagagaagaagaaacttgagaaagtgcagcaaattaggattaaatttttaagattggttcggagactgggttttactccagaagaatcaatggtagctcagattctataccggttgacacttgttgcggggaggcaaagcagcccactatttagcttggaagatgcaaagaggagtgcttcccagcttgaagctgagggaagagatgatttggaattctccttgaatatattagttattggaaaacaggtgtgggtaagagtgctacaataaattccatttttggtgaaacaaagaccagtatcaatgcatatggacctgccacaactgctgtgacagaagttgttgggatggtagatggagtgaagataagagtttttgacacaccaggattaaaatcttctgcagtggaacaaaatttcaacagaaaagtcttgtctacggtgaagaagttcacaaaaaaatctcctcctgatattgtactctatgtggatcgtctggacacacaaacaaggaatctcaatgatctgccattattaaaatcaatcactaatgtccttggttcttcaatatggcaaaatgccatagtcactctgacccatgctgcctctgctcctcctgatggaccttcaggttccccacttggttatgatgtattcgttgctcaacgatctcatatagttcaacaaaccataggacaagctgtcggtgacctacgtcttatgaatccaagtctaatgaatcccgtttctcttgtggaaaaccatccttcttgccggaaaaatagagatggtgaaaagatccttcctaatggtcaaagttggagatctcaattgttgatcttgtgctactcaatgaagattctctctgaagctggtaatctttcaaaaactcaagataaacttgaccagcggaagctgtttggttttcgtgttcgctcgcctccacttccatacttgttgtcatggctgttgcaatcacgcacccatccaaaactctctgccgatcaaggtggtgacaacggtgattctgatattgagttggctgacttgtctgattctgatatagatgaagatgaagatgaatatgaccagctcccgccatttaaacctctcaagaaatctcagattgctaagcttagtaaagagcagtgtaatgcctactttgaggagtacgaatatcgagtgaaacttctccaaaagaagcaatggagagaggaattaaaaagaatgagagacatgaagaaaaatggtaaaactacggtaaatgattacagtcagatcgagcaagatgatcaggaaaatgaaggtccagctactgtgcctgttccattgcctgatatggccttgccaccatcttttgatagtgacaatccagcttacagataccgcttcttagagccaacttcccagctcctaacaaggccagtgttagacacccatggttgggaccatgattgtggctatgatggtgtaaaccttgaacacagtctagccattatcaatcaatttccagccacagtcactgtccagatcaataaggataagaaagacttcagtatccatttggattcctcggtcgccgcaaaacacggggagaacggatcaagcatggcaggatttgacatacaaaacgttggaaagcagctagcatacatattcagaggagagacaaaattcaacaactacaaaagaaacaaaactactgctgggatgtctgtgacatttctgggcgaaaacatatccaccggactaaaaattgaggaccaaatagctctgggaagacgatttgtcttagtgggaagcactggaactgtgagatgtaagggtgattctgcttatggagccaatgttgaagtgaggctgagagaggaagattttccaattggtcaagaccaatcttcattgggtctttctctagtgaagtggagaggagacttggctttaggagctaattttcagtcccaattttcaatgggacgaagttataagatggcgatccgcgccggattgaacaacaagctcagtggacagatcaatgtgagaacaagtagctcagatcaacttcaaattgctctagttgctattcttccaattgtcaaggctatctataagaacttctggtgtggggcaggtgagaattatcccatctattaaattttgttccttttagatctcaaattaagcatagtctgttcattcagttgcttctttttatcattttcctaagtgttgagttagctattattgatctttcatatttattcttggtatattggttgttggtggattttgttgtcttagactttgtactgaaattgag

SEQ ID NO: 561 - DNA, 1811 bp, Senna obtusifolia
tctgaattaacactgatgtagttgacagagagaatatatccctggcagataacaactctattttaatgagtgagaggactgaaatagaggattctgagtatgtgactccgagaataaatggtggtatggtcttggaaaatggaagtgcagaaaaggtggataatgatgttcctgaatcccatccagaatctgaacccgaaaaggaaattctgaatgaggatgctggttctaaggttgaggatttggatgtgggtgacttggatcctgaatctggggatggcaagaccatggagaagttgaatgcatcaggtgaacctcgctttgaaattgaagatgatataggtgaagaagtcaatggaaactcaggtcataggaatggagaaaatcaggttgaaataagtgagagtttgaagcacgaggcccatggcactgatatatgtcttgacaataataacagtgatggaatgcacttttctgggggtaacagtactgaaagcacagattattgcaatggtgataaaaacgatattaaatctaaatcagaatcagagcataatgaagcaaaatttgaactagatagtgcttctcctgacttaattgaatctgtgggggaaagagcagtaactcctggtgctgggagctcatcctttttggaaaattcttcatctgataatatagtaagtgttcaagctaattcatctgacttgattgaagcgggtaatgaggattttctatctcagaaggatgaaaaagttattcatgaagcccatgacaaaccatctgtggttgtggaacctgaaaagatacaggacaagattgttaaagaaaagctaacaactcaaaccaacagggaacaaaatattcagcctgctttagagcttagttcttcatctggaaaatcagctgttactggcccgcctcctgttcgtccagcaggccttggacgggcagcaccattggaacctgcgcctcgcgtagtgcaacaacttcctcatgtgaatggttctgtaccaggtactcaatcccaacaaattgaggatgctgaggctgaggagtatgatgagacacgtgagaaacttcagatgattagagtaaagtttttacggctcgctcataggcttgggcagacaccacacaatgttgttgtagcgcaagttttgtatagactaggactggctgagcagcttagagggaggaatggtggccgcgttggtggttttagttttgatcgtgctagtgctatggctgagcagcttgaagcagcaggtcaggaaccacttgatttctcttgtactataatggttcttggaaagactggagttggcaaaagtgcaaccatcaattctatttttgatgaggttaagttcgatactgacgcttttcatacggggacaaaaaaagttcaggatattgtgggaactgtgcagggcataaaggtacgagtcattgatacaccagggcttctacctccctggtcagaccaacgatataatgagaagatcctgcagtctgtcaagcgcttcatcaaaaaaacaccaccagatattgtgttgtatcttgatagattagacatgcagagcagggattttagtgatatgccactgttacgaacaattactgagatttttggaccatcaatatggttcaatgctattgtggttctgactcatgcggcgtctgctcctcctgatggtcctaatggtactgcttcaagttatgacatgttcgtcactcaacgctcccatgttgtgcagcaagccattcgtcaagcagcaggagacatgcgactcatgaatcctgtgtcattggtg

SEQ ID NO: 562 - DNA, 2307 bp, Sorghum halepense
aataccgccacctctgctccccctgcacaatcctcagctggtagttctacacctgcacaatcaagcagtggtgcttctgctcggtctactaatggtccctctttgctatctcgtcctgctggccttggatcatcgtcttccctgtcgcagcctcctgtgcgttctgttcaacaggtccgtgccaacaggccatccgctgtggataggggaacccaggaggccactgaatctgctgaggacaatagagatgagaatgatgaaatccaacgaaaagcttcaaatgatccgggttaagtttcttcgtctcgctgacaggtttgggcaaacttctcataatatggtcgtttcacaggttctgtatcggcttgggctggcagaacaacttagaagaactactgctaatgggacgtttagcattgaccgtgcaagagagatggcagaacgtcttgaagctgctggaaatgagccccttgatttttcatgcaccatcttggttcttggtaaaactggggtcggtaagagtgctaccattaattcaatctttgatgataccaggttggatacaaatgcttttgattctagtactaggaaggttcaagaagtagttggtatggttgagggaatcaaagtaaaagtgattgatacacctggactttcctgctcatctttagaacaacaccacaaccagaaggttctcaattctgtcaagagaattattagcaaaaaccctccggatattgttctttattttgataggttggatatgcagagcagggacaatggtgatgtccctcttttgcaaaccatcacaaaagtgtttggagcatcagtttggtttaatgccattgttgtgttaactcatgctgcatctgcgccaccagatgggcagaatggaattcctctgagctatgagatgtttgtcacccagagatctcatgtagtgcagcaagctataaggcaagctgctggtgatgtccgtcttatgaacccagtatccctggtggaaaaccactcagcatgcaggacaaatagggctggccagagggtattgccaaatggacaagtctggaagccacagctactgctgctttgttttgcttcaaaggtgttagcagaagccaatgtgctcctcaagttgcaggatagtcccatgagtaaactttctcgtacaaggattcctccactgcctttcctcctttcttcccttcttcagtctcgtgccccattgaagttaccagaggagcaatttggtggtgatgatgatgatcttgaagatgattcggcagatgattctgattcagatgatggttcagattatgatgatttacctccatttaagcgtctcacaaaagctcagcttgccaagctgaacaaggagcagaggaaggcctatcttgaggagctagattacagagagaagttgttctaccgaaaacagctgaaagaggaaagcaagcgtcgtaaattgatgaagaaaatggcagcagaagccagtgctcgagcaaatgatttcggtaacagcaacttagaagatgattctaatactccaactaatgtttcagtgcctatgcctgacatggtactgccctcatcttttgattctggctatcctagccatcgctatcgttttttggatacaccaagtgaatggcttgtcagacctgtattggaaacccagggctgggaccatgatgttggttatgagggacttaatgttgaaaggttgtttgctgtaaaaggtaaagttcctctatccgtgtctggccagcttacaaaagacaagaaggattgctccctgcaaatggaggctgcaagttcaattaagcatgctgagggtaagactacttcacttgggcttgatttgcagtctgttggcaaggatatggcatacacaattcgtggtgaatcgagatttaagaacttcaggcgcaacaatacagctgctgggatatctgccacgctccttggggattcagtatcagctggtgtgaagattgaggacaaactgatagtgaacaagcagctcagggtcctgattagcggtggggccatgagtgggaggggagatgtggcgtatggaggccgcctcgaagcaacaatgagggacaaagattacccgattgggcggatgctttccactatcgcgttatctgttgtggattggcatggggatctggcaattggctgcaacatccagtctcagatccctgctggaagagctagcaacttggttggccatgcgaatctaagcaacaaggggactggccaattcgggattcgcctgaacagctcggagcatcttgagat

SEQ ID NO: 563 - DNA, 5096 bp, Spirodela polyrrhiza
tgacgatagcggaaaggtgggcgagggcaacggaaaaattggctcgacccatgaggctgagaagattgatgagcaacgagaaagctctgacgacgcaggtgattgccagattgatgatgaactccccgatccaacaacagcggggggaggagaatctgggctttctggtggaaaggacgcgtcttcgggtgatccagcccgtgtgcaggaggaagaacacggagatggagcgactgcaaggagctcaaatggtgtggagatcaatggcgttgtagctggtggcttagccacggaagaaagttcctcatcttctgtgaatgatggagaaaaaaaatcacaaggcgcagaccttgaaatgaacaattcacctgttgagaatcatgaaaatggtacttccggtgaggaaactgccgaagggacagatactcctgagttgaacccatcgccatattttcatgatgcgatgaatcaaacacaagagtctatgatcaaggatgttgctttgcttgatgaggaaacgtcagcccctttcaattccacacaagacattgctaaacaggaatccccctctgctcctgtgaatggtggaaaaatgaagcccgaaattgattgtgatgaagaatcggagaatgtagacatcggcacaaatcttgcagcagtttatgttcaagaaagggaggatttcagtgaggtatctggagaagacaagcatacctctgagtcgaatgggttggcatcttgccacagtgagatgaatcgaacagatgagggcatgattgaagacgatcgtttagctgatggggaagctggcggcctgccggatgaacatgttgacctcacaaaagctattccggaagaagatgatgcagcccagactgcctcacgtcatttagatgtggaagcaagtgaagctcaacaatctcagcttgctggtccttctgaagaactgaagccaccagctcagggagaaaaacgggatgcaaattcctcagagcaggaagagattaagagagattctgtaacggcaggagggtcggatgcaacttcttctggtgttgacaggaatgcaacttccaggcagcctccaccagctacttcaggtccctcgctgcctgcccagccagctggcctgggatcctctgctcccttgctggagcctgcctcaaggtcggttcagccaccgagggcaaatggatccatgcctctgcgccagactcaagtcttagacgaccttgccaatggggaagccgaggagaacgacgaaacccgtgagaaacttcagatgatacgggtgaagtttctacgccttgcccacaggcttggccagaccccccataatgtcgtcgttgcccaggtgttgtacagactcgggctagctgaacagctgaggggcagcagaaacacaaacagagctggtgccttcagctttgaccgggcaagtgccatggcagaaaatctcgaggcagcggggcaggagcccctagacttctcctgcaccatcatggtcattgggaagacgggagttggaaaaagtgcgaccatcaactcgatctttgatgaggtcaagttcagtacgaatgccttccagcaaggcacgaagaaggtccaggatatagtggggacagtccagggcatcaaggttagagttattgacactcccgggctgtcatcgtcgtcctcagatcagcagaaaaacgagaagattctccactctgtcaagcacttcatcaagaagtccccacctgatatcgttctgtatcttgatcggctggacatgcagagcagagactatggagatgtgcctctgttgcgcaccataactgagatttttggggcctccatttggttcaatgccatcatagttctaactcatgctggttctgctcctcctgacgggaacaatggcacctccatgagttatgaaatgtttgtgacgcagagatctcatgtcgtacagcaggcgattcgtcaggctgctggtgacatgcgtcttatgaaccccgtttccttggtggagaaccactcggcttgtaggatgaacagggctgggcagcgagtcctgccaaacggccaagtttggaagcctcagctgctgctactctcatttgcatcaaaaattttggccgaagccaatgaactcctgaagttgcaagacagcccgccaggcaaaccgtttggtcaagttagagtgcctcccttgcccttccttctctcttcccttcttcagtcaaggccgcagctgaagctgccagaggagcagtttggtgaggatgattcaatggaagatgatctggatgatgcgtctgattcggatgatgagtctgagtacgacagtcttccgccattcaagtgcttgacgagggcgcagctggccaagttgagcagggcacagaagaaggcatattatgaagaactggactacagagagaagctcttttacaagaaacagctgaaggaggaaagaaggcgcaggaggcttctgaaaaaaatgggggcgtcggccaaggacgtgccagatgatcacatcaacgacaaccttgaagatgagaatggtggcccagcttctgtgccagttccaatggcggacctggcgttgcctgcctccttcgactcggacactcccagccaccgctaccggtttctcgatacctccagcccgtggatcgtcagacccgtgctggaaacgcagggctgggaccacgatgttgggtacgaaggtctgaacattgagaggatgttcgtggtcaaggatagggtccctctttctatttctggccagcttacaaaggacaagaaggaatgcaatctccagatggagacggcgggctcgatcaagcatggagaagggaaggccacctctttggggtttgacctgcagaccgtcggcaaggacatggcgtacacagtgcgtggggagacgaggttcgacaatttcaggtgcaacagcactgcggctggcatttcggccaccctcctcggcgatgctctctccgccgggctcaagattgaagacaagctcatcctcaacaagaggctcaggatagtcatgagcggaggggctatgacgggtcgaggcgatgttgcttatgggggccgtgtggaggccgttctgagagacaaggactatccgctcgggcggacgctgacaactcttgcagcgtcggtcgtggattggcatggcgatcttgccgtgggttgcaatttccagtcacaggtccccatcgggcggcataccaacctggtcggccatgccaatttgaacaacagaggttctgggcaagttggcatccgcgtgaacagctcggagcagctccagatagctttgattgctgttgttcctatactgaaggggatccagaggatgctctcttttgggtcctctctctcttcgtagccggccagcgagggcgtggaatcgaggatttcttagctggaagaaggctttctgtgctacccaccttttggttctaagtgactggtacgagcacttctttgttgagagtgttttctgaaataagctgatttcttagttgacgattgaatgattttaattgatattattatagagcatggcaaggagagggggggggttcgccgttgagtaatttgtgcccttagaggtttttttttccccaatttgatcaccaagtttgcagaatgtactcttaacttcaaggatgctccacatcaagggccttcatccaagtgttctcctgtaaatcttttggaattcaattactgtctgaatatttcccgaaacaagccgatttcttagtagaggattgaataattttgattgaaatatagttaatggaatgggtggggatccgctgacgagtgatttatggccgcctacgctttccttttccccgtttcatcatcaataatcttgagctttctccattgcgtcgttttcttgtcctggacgcgtcaaggtgaagattattcgccttctattctgtgatttgccacctctaccatgccgtcaaatggggaattattcttcttttaacactccagtggctgatgaacatggttgcaactatgtatgaacaccatctgtgctcgctgtttctctcagaatgtaatacttccagtgggtatcattcttggatcaaatcggggcctctagcagtgcaaattgagccttttatttgttatttggccattctcatcgtttcttacatgacgctattcgattacagttgaataaaatcagaatattcagagtgggcggttcattctattttatttcttctcagttcttttatcaggcgttcgtttcacgatggcaacatgaatcttgttcttggcggtacccgtgattctgatcgcggggattatcatttagaatcaggaatgggtcattactaaagaaggggtggttcattttgttgattttttttttctcaggtcttctattcggtttccatctcactatgattaatctgagcctcgtccttggtgagacccatgaattaggtttcataaactaaatcggtaatttattgatgattttgagacaaatctattaatttatggtctaccgggttcctgtagacatcaagctttatttagatatatcctgaaaaaattccattccttgaatccgctgttaatgggaatcataaggtgtgcttgcttaggttgactgaatcgcgacctgatctgtacacagttcttgttcttgggttgaccatcatacccagctctctctctctctctctctctctccctcgttctctctcggcctcccacggagtcttcaatcggtcaactcggtaccgttaatcaagaatgagcacacagcaaacaggacgacgaactggaagatacagagctcaggaaaaatggacaagaagacacataacaccactggagaggagacagacgacgacggagaagaccaaaccccggcgagcgcccgggggaatcagaagaggaagagggccaggggcagagccagagccacggaggaggggccccccatggccgccctaaggccggcgctgtcgaaatgggtgttgtctaccagaggctggttctcgccggcgccgggctgctgcggctggtcgccctccgccggctggccgaag

SEQ ID NO: 564 - DNA, 1154 bp, Taraxacum officinale
ggggatcttgcgattggatggaacgggcagtcgcagattccgattgggcggtttactaatttaatcggacgtgttaatttgaataataaagggtcgggacaagtaagcgtcagattgaacagctcggaacagcttcaaatagcattggttgcttttgttcctgttatctgtaagcttatcgggtattatcagccaagagatacatcatattagcattttacaacattcaaagttcacgtgagtaaccttttttttgtttatattgattggtttacgtgtattgacatgatgtgatttaaatttggttgcagattgggttgatagatggaataattgctaaaaaggtggaaaatgttttgggaatatgggaaaagagtagtaggtaagtgcacaaagactggtagcggtagaagctagatttatggtgctgtttttttttttttttttgtttttaaaattttaatatttgatgttttggatgttctacttgatatagaggtggtctggttaggattgggaccgagtttagttattattgtattatacgtgactcgtgaaggtcttaattgattaagtggacaggacttgttttttgtagtatgcgaatttgtttatggtgaattagggtagtggttgtggttgttttttttcatcttttattcctatatgctaatatagatttaagatagttaccttgtaattatccttttatttaaacaaacaaaccctttgaactttataaagattgatgattaatttattgttgtttatacatttatgaaatggatcaatccaaatgcaataatgcatcataggcttcgtctttatgcataaccaccaacggtatacataatcgtagggtgtttacacgtgtattgcgggggataataattgagtgcattgatttcaaattgatggagaaagtataataaacaatttttattgtaaacaataaaaaattagcgataacgatggttttgaattactcatggatttgatgatatttatataactatatcatgaatctaatactaggaatataaacattaagtacacattataaattcttcttgtgtaatgaaattcatggttttcatagtgataataagaccaagcggaataccgctaacggcggtatcgtggaggtgacatga

SEQ ID NO: 565 - DNA, 3625 bp, Taraxacum officinale
  unsure (1)..(3625): unsure at all n locations
tgtcatctgtttgtttcgtaaaacactagtttgtatacaattcatgtttaagtaataagtatatgtggatttgttgaatatagatctctttggtgtctggattgattgcttgagctcatttgattgttttactcttgttgcataattgaaaatctgtttgcggttgtttcattccactaatttagggtttttcgtctacgggtttttagggatccaggttttcaggatagacttttggggttttcgatggaaaatggcgtgaccaaggtggaagaagtaaagttaaaagtagaggaattcgatgaagatgttttgggggatcggatgaaaggtatcggaattgatgatgctgttgaggaggcaaatggtggtgttgaaagcgtatctgcgacagtcgaggcagaagaaactctttcaaacgatggaatcgatgaaaatggtggggattcaagtgtttctctacagttagatgcgagcgtggatgccgtgcaaaggatagaagctacgtttgaagattcaatcgagcctccttctgaaacacaaacggttctggaaaacgctcatattgatcctgttgaggaggttacgcttacatcaactcaggtaaaccttacttgaactatttgtttactaaaacctaagaacgattaagttatacgtcttcaataaattgacgatgcatgcaggtgatagaaaatgatgatcctgtagatagtgatgaacacgagggaacaggggttaatttggcagagattactgatgagataattacatctgctagtactttcatcgatcacccacgtgaattggaagctaatgaagctgtgaataatggtaatagtgaggaagaagtgggagaaagcacttctgatattgctgcaatggatcaagctagtgacatggaatctgaggtgtcagtggttgatgaaaatcacgaggtggaagtagtggatgtaactgatgtaagcagagacgatccagatgtgttggaaaataacgggattgtagataatggagtaaatgagttcccaaaggtattatctgatgcagatgaaaatgaaagccacatggcaatatccgaagatattcataacaaaaagccaattgctgtagcttttgaaaattctgaaaatggagtttcagacaatggtaatggagattcaacgactcacattacacagccagatggcgagataggagttgaagcaaatggagatgttcatgaagccatgaatgagaaagaaacaatggaagaagttgaagatgatcacagtattactcacaaagagaaactcgaaagttcaacaaacaatgtcccaaataagcaaaccgatctaaaacttcaagaacctcaagaggaacaacaggaaacttctactccttcttcattacatcaggatgataaaaaccagcaacaagaaagtacttcagccattaatgagcccgataacaaaccaaagagccctaaaattgaaaaaatcaatctcaaagattatgatgtgaaacaaagtatgccattgaagaaagaaccagaggtgagtaggcctattataggcgtctctttacctacagaaaaacccacaaccccacccactcccatacctaatccaaaacctaatcaacccaccatacctaactccaccccaccccggacccagacccgcccagcgggtctgggcagcggtgcaccgctgctggaacccgctcaccgcatggctcaatcccaaccgaatggtaccggcactggcaccagtaccacacccccgccacaaaaccaagtcatcgatgaaccaacaaccgaaccggaagaaaacgatgacacccgagaaaagctccaaatgatccgggtcaagttcctacgccttgcccgaagactcgggcagacaccccacaatgttgtagttgcccaagtcttatacagactaggcctagccgaacaactccggggccgaaacggaggccgtgttgcagccttcagcttcgaacgcgcaagtgccatggccgaacagctcgagtcaaccggtcaagaaccgctcgagttctcatgcaccatcatggtcttaggaaaaaccggggtcggaaaaagcgcgactattaattccattttcgatgaagtaaaattcaacactgacgcttttcaattagggacgaagaaagtacaagatgtggtggggaccgtacaagggattaaagttcgggtaattgacactcccgggttgcttccttcttggaatgaccaacgaaaaaacgagaagattttacagtcggttaaaaagtttattcagaaatcgcctccggatattgtgttgtatttggatagattagatatgcaaagtcgggatttcggtgatatgccgcttttgaggacgataacggatatattcgggcagtcgatttggttcaacgcgattgtggtactgacccacgcggcttccgccccgcctgaaggcccaaacgggaccacaaccagctacgacatgtttgtgacccagcggtcccacgttgtccagcaagccatccgtcaagctgcgggcgacatgcggttaatgaacccggtctcgttagtcgagaaccactccgcgtgtagaacgaaccgcgccgggcagcgggttttgccaaacgggcaggtctggaagcctcacctattattactgtcctttgcttccaagatcttggtggaggcgaatatgttgttgaagttgcaagactcgccacctggcaaaccatttgggcaacgggcgcgggccccgcctttgccgtttattctctcgagccttttgcagtcgagnccgcagttgaagctcccgaacgagcagtttggggaggacgacgatgacgtggatgatgacgacgatgacatggacgattcggatgatgagtcatcggagtacgattcactaccgccgtttaaacggttgagtaacgcacagctggcgaaacttagtaagtcacaaaagaaggcgtattacgacgagttggagtaccgcgagaagcttttcatgaaaaaacagttgaaagaagagaagaaaagacggaaaatgatgaagaaaatggcggaagaagccaagaacgttccggaagtagaagaagacgatgctaacaatgctgcaaccgtaccggttgccgtgcaggacatgaacctaccggtgtccttcgacgcggacaatccaacccaccggtaccgcgctctcgactccgcgaaccaatggctgatccgacccgtactcgacccgcacgggtgggaccacgacgtcggatacgaaggcatcaacatcgaacacttacttgccgtacaagaaaagatccccgtctcgttttccggccaagtcacaaaagacaaaaaagacgcgaatctccaaatggaagtctcgacgggagtcaaacacgggaagtcaaagtcaaagtcaaccacaatggccctcgatgtacaaaccgtcggaaaagacatgtcgtacactctccgcagcgaaactcggttcctaaactacaaaaaaaacaaagcctccgcgggtttttcagtcacccatttcggcgactccgtgacagctggcatgaagttcgaggacaaattagtcatcaacaagcggggtcagttggtggtggcgggaggggcggtggtcgggcg

SEQ ID NO: 566 - DNA, 2876 bp, Trifolium repens
aggaggcaatagacccactaagtcatttccatgatcagaggggggatgatgctgcttctactgttagtgaattgccttcaactttggccgatgaaatcccccctgataacgtagaagaacttgataactttcaagaggcgattggggttgctgatcagtgtgtcaaaaatttgaaggaggttgaagtgattgctactcaggaggtgcctgaggatcagcaggggcaacttaatagctcttgtctagatggagttgggaccgaggagactgagggtggactatcttgcaatgaatcccacagtatcagggatcattgtttggaaagtagtagtagtgattttattggtggaaaggaaatagctgatttaaacacggatggaaaaatggtatttcaggaggctagtgacttggtgaatggaaactctggtttatcaagtcacaagtctgaaaatgaggatctagagtacgttactcccaaacaaaatggcagcgtgcttttggaaaatggaagcacagacaaggttgattacactgttgctaagcttcatacagaatctaaatctgatgaggagatgataaaccagggttctgatgatgggtatttgaaagaggatggcctggatcccgatctcagagatgataaattagaggaacagtgtaatgcttcagttcaagatgatacatgtgaaaaagcatgcggacattcagctcacggggatttagaacctcctcatgaaatattcatagaaatggatgatgagaccaatggcaccgatataatctgcgagtttagaaatgacaaagaaatgggaatatctgatagtcagaggactgaatgcaaacattttggtaataatgaaactaatgatgatgacgttggatcaaattccgagcatctggaaaccgttggtgaaacaggagaattttctacggctgtggacgatagaaaagtgaatggaactgctggacggttatccctaccagaaaattcttttgctactgagatgccggctgttcaggctactgcaactaatttagaagaagggaggatgaatgcttaccggtctaagatttctaatgaagaaaatcaaggaaattatgaaaactcatctattgttagggaacctgaaaagaaactagtgaataatgcaaaagagaaactaacacctcagatcactgaagaacagaatagtgaatctgtttcctcatctggaaaatctgttgctactagcacccctcttgttcgtcctgctggccttgggtctgcagctccattattaaaacctgctccccgggcagtgcagcagcagtcacgggtgaattatactgtatctaatacgcagtcccaaaaaacggaagactcctcaactggggagtctgaggagtatgatgaaactcgagagaaacttcaaatgattagggtgaagttcttgcggctagctagtaggtttgggcagactccccacaatgttgttgtagcacaggttctttatagattaggactggctgagcaactcagagggaggaatgggggtcgtgttggtgcttttagctttgaccgtgcaagtgctatggccgagcaactcgaatcagcgggtcaagaaccacttgatttctcttgtacaattatggttcttggaaagacgggagtcggaaaaagtgcaactatcaattctatctttgatgaggttaaatttaataccgatgcttttaatatgggaacaaaaaaggttcaggatgtcgtgggaacagtacaaggcattaaagtccgggtcattgatacaccaggacttctaccttcctggtcagaccaacggcacaatgagaggatcctgcactctgtcaagcgctttattaagaaatcaccacctgacattgtgctgtatcttgataggttagatacgcagagccgggattttagtgatatgccgctcttacgcacaattactgacatttttggaccatccatatggttcaatgctattgtaggtttgactcatgcagcatctgctccacctgatggccccaatggcactccttccagttatgacatgtttgtcacacagcgctctcatgttgtgcagcaagccattcgtcaagcagctggtgatatgcgtctcatgaatcctatatcgttggtggagaaccactctgcatgcagaattgatacgtccggccaaagagtgttgccaaatggacaggtttggaaaccacatctgttactcttatcttttgcgtcaaaaattctggctgaagcaaatgctcttcttaagttacaagacagtccaccggaaaagcattacacagctcgcacaagagcgccaccattaccatatcttctgtcaacccttctgcagtcaagaccacaattaaaattgccagaggagcaattcagtgatgaggacagttatgacactcttgatgagccatcagattctggtgatgaaacggaccctgatgacttaccaccatttaaacctttgacaaaggcccaaatcagaaacctttctagagctcagaagaaagcatatctggatgaggttgactaccgagaaaaactttttatgaagaaacaactgaaggatgaaaaaaagcaacgaaagatgatgaagaaaatggcagaatcattaaaagatctgccaagtgattatagtgaaaacatggaggaagaaagtggcggtgcagctgctgttcctgttcccatgccagatatgtccttgcctgcttcctttgattctgatacccccactcaccggtatcgttttcttgattcatccaaccagtggcttgtaagacctgtcctagaaactcatggatgggatcatgacgtgggttatgaaggcttaaacgtggaaaggttgtttgttcttaaaaac

SEQ ID NO: 567 - DNA, 4007 bp, Trifolium repens
taggtatcacaatgattagacctgattcgtggaagggatataaaaatcatattttaaaattagaaaaagagtgtcaaaattaacacatttactttcttaccacggtgcttacatttacttgtgatcgtgaattttcaattaagttttaggttaatagtgttgtgattttgttgttatttttcttacctatgttattttttatctgtgtgtatatacacatgtatagtataacttaggtgaccaattatgagttgtattgggttttagattaatgttgtaatctggagtttttttttcttatttgtgttattttttatctatgtgctggtatattttagtattttaggtaggatcatacagtccatgtttctgatcccccatgttaatctttcaccctctcacaattctaagtactaagtaggtatgcaaaactccccataaagagtgtttgtttgaaggcatgcaaaaatattcccagaaaagtgatcctgggaatataaataatgtttgtttggtacaaattctgaaacaatatttctaggtattatcaatttgtagtaatgtatttgtaaagaacctatattttccctagcttcccaggggaatataagttatttatttcaaaagccaactataacttccaacttccatcttattctaccacattttttctatttttgtatatttgaactaaataaagtttaatagcattcccagaaataggatcctatacatttaaacaaatgcccccaaagtaaaaagttgttttctgctgttgatccaagttttctgtttattgctaaagcaagtgttgatagtttccatacggaagaatcaattctaaaccaatgtttgcatcaatattatttgtgtgattaaaatgtctctcatctctacagtatagacataactcatatgtgtgctttttgttatgtttagctcccgcagctaactctgtagcattgccggttccgtccggcacatcaaactcttctaccaatcagagtagttccaccttgcagcaagcttcagacacggataattttcaacctcaacttagcggtaatggaaggcggaaggatactttggcaaaagtcgaggatctacaagttaaatttttccgcctgctccagcgcctcggccagtcaaaagaaaacctcttggtgacaaaggttctttatcgcatgcatcttgcaactttgattcgtgctgaggaatcggatctgaaaagagttaacattagtagcagcagagcccgagcaatagcaaaccaacaggaggaagctggcatgccccaattgggcttctcctgcagaatacttgtccttggtaaaactggagttggtaaaagtgctaccataaactctatatttggtcaagaaaaagccacgactaatgcttttcaacctgctactaattgcatccaagaaattgtgggaactgtcaacggacttaaaataacgtttattgatacccctggtttcctgccttcctctactaaaaatgtgaagagaaataagaggattatgctttctattaagaaattcattagaaaatcccctccagacatcgttttgtactttgaacggcttgatcttatcaattctggttatagtgacttcccacttttgaaactcataaccgatgtatttggtgcatcaatctggttcaacactatcctagtcatgactcattcatcctcagctattccagaaggacctgaaggatatactgttaattatgattcttatatttctcaatgtactaacctaatacagcagtatatacatcaggcaatgttagattcaaggctagaaaaccctgcactttttgttgagaatcatcctcagtgcccaagaaataatatgggggagaaaattcttcctaatggacaggtttggaaatctcaactcttgttattttgcatttgtaccaaagttctgggtgatgtaaattccctctttaagtttccaaacggcatagaactaggaccagcaaataatgctagagttccttctctgccccatctcctttcgtccctgttacgccatcgccctgtatccaatcaaagtggaattgatgatgaaatcgagtacattttactttcagacaaggaagaagatgagtatgatcaacttccatccatacgaatcttgacaaaatcacagtttgaaaagttgtccaaggcgcaaaaagaagattatctggatgaattggaatacagggagaccctttacttaaagaaacaaatgaaagaagactatcgcaggcgcagggagaagttactcttacaagagcaagaattttctaatattgataattctgatgatcaagaagctcctccagaacctgttcagttaccggatatggctgttcctcttagttttgactcagattgctctatacatagatatcgctgtcttgttgataatgacaaattacttgtaagacctgttcttgatccccaaggatgggatcacgatgtgggttttgatggtataaacttggagacagctaccgaaataaagaagaatgtatatgcctcggttgtgggacaaatgcataagaccaagcatgatttcaatatccaatctgagtgtgctgcagcttatgttaatccgttgggtcctacttattcgatcggcgttgatgttcaatctgcaggtaaagatatggtttgcactgttcatagcaacacaaaattgaaaaacataaagcacaatattgctgattgcggtgtttctttgacatctttcggaaagaaatactatgtgggtgcaaaacttgaggatactttgctaattggaaaaagattaaaatttgtggttaatgctggccgtatggaaggtcatggacaaatggcatatggtggaagttttgaagctagtttacgaggggaagattatcctgttagaaatgacaatttaagcctgacaatgacagtcctctccttcaataaagagatggtgttgagtggaagcttagaatctgagttaaggttgagtcgaagcctgaaagcatctgttagtgctaatctaaatagtcgcaaaatggggaaaatatgtatgaagaccagtacttctgagcatttacaaattgccttggttgcagttttcacaattttgaagattctgttacatagaaagggaatttagaacatggtgaagaaattcatggaaagatattaggttctgtttgtttagtgatactcatctattttgatcagggaaaaagtgacaagtgaagcattctgcagggaagcatagatatgaaccattttccctttaagagggaaaacgaaattagaattggatttttttgaaattttgttttattttcactatacttcatattccagtttttgaatgtttctttaggttaggcctgcatcttgaagttgtaaccttttatggattgttgttcaacaatcagtatttgggtgcttccccaattatagatgtttatttgtagtaaataaaatcataactgtacattgaagcatagaaactggttcgttttcttctgtgatttgttcgaataagttaccagtaaatgaattatctcgaataagttactagtatatgaattatcggttcaacagtggttattgcaatgctgaaagtgttaaggaggctcaggatatatcatatattgtaaatgaaagtacaaatggttgctgattatgccgttttagtctgaggttttgcacttactatattccaatatgctgctagatttgaattaattgtggggtgccagtaacatcaattatttaaaatgaagaggggtaatcattttatttaatttagaattaagttttgttagtaaggaaaaaggtaggctagtaaggaccacatgtgtttcttcaattaatctcaaatctctaaaaaaaaatatataactaagggtcgtataatttgcagtaagctcattgatccatttcttgaatctcaaccaatttatactattgaaattatataaaaaaaatcccaaattttaaaccataa

SEQ ID NO: 568 - DNA, 1163 bp, Xanthium strumarium
gaattgaattgggggcatcaaatagtgcccggctaccgtctttgcctcatcttctttcatcttttcttcgccatcgtatttcaaaccctaatgtaactgaaagtgaaatcgactatatttctctttcagatttggaagaagaagaagatgaagagtatgatcagttgcctcctatacgaatcttgacaaaatcccagttcaagaagttgacaaattctcagaaaaacgcctaccttgatgagctggattatcgagagaccctttatttaaagaaacaactgaaggaagagttacgtgcacgtaaagagaaaaagatttcagaaaatggaaatttagatggtgacagggaatcttgatcctcaagagcccatgctattaccagatatggcagttcctcctagttttgattctgataatccattgcactagacctatcggtgccttgttactagtgaccagtggctagctagaccggttcttgacccccatggttgggaccatgatgtggggtttgatggaataaacctagagtcagctaccaaagtaagcaaaaacttatatgcatcggttacaggacagatcagcaaggacaagcaggatttgaatgtacaatcagagtgttgtgcagcttttctggatccacgagggcccacttacagcgctgcgttggatgttcaatcctcaggtaaagagctaatttacactcttcatggtagcaccaaaatgcgtgttttagaacggaatatcgcagaatgtggagtatcactattgtcttttgggaataattactatgcgggtgcgaaactggaagatagttttttagtggggaagagagtgaagtttgtggtcaatggtggtcaaatgaggggccgggaacacgctgcttatggtgggagtttgcagacggtaataagaggtagggattaccctatgagaaatgacaaggttagccttactatgacagtgttatctatgaacaaagagacggttttgagtgggaatatagagtctgattttagggtgggtcgagggacaaatatgtccataaacgctaatataaacaaccgaaatatgggacagttaactatcaaaactagtagttctcagcatttggaaatagctttgattgcggctgcctcgattttgagggttctttttaggcg

SEQ ID NO: 569 - DNA, 2034 bp, Xanthium strumarium
gatttatctttaggaagtacaagatagaaaaaataatggaagaaggaagtacaccagtcatcaatgtgcgtgccaaccatttggaaagaacagaaattcgtgaggatgaaaaaagtgaacgcattgaacatgaagtgaagaaagaaccggaattgaggcctgttcaaggtgtttctttatcttcaccaaagtctgcaaaactcacacctaatccaaatctcaaacctgattcaaaacctaaccattcttccattcctaattccaaacccaccactgcactcacccccacccctgctccatcgccagccccaactcgtcctgctggccttggcagaggtgcaccactactggaaccggcacaccgtgtggttcaatctcagcctaacggaaacacttctctgcaaaaccaagtcattgatgaaccaacgaatggggagtttgatgaaaatgatgacactcgtgaaaagctccagatgatccgggtcaagtttttgagacttgcccgtaggcttgggcagacccctcataacgttgttgtggctcaggtcttatataggctaggtttggctgaacaaataagaggcagcaatggaggccgtgttgctgcttttagctttgagcgtgctagtgctatggctgagcagttggaagcagctggtaaagaaccacttgagttctcatgcaccatcatggttcttgggaaaaccggtgttgggaaaagtgcaaccattaattctatatttgatgaagtcaagtttggaactgatgcgtttcaagttggaacaaggaaagttcaagatgttgttggaaccgtgcagggtatcaaggttcgcgttattgacacaccaggccttttttcttcatgggctgaccaaagaaaaaatgagaaaattctcaactctgttaaacggtttattcaaaaatcacctccagatatcgtgttatatcttgatcgtttggacatgcaaagtagggattttggtgatatgccacttttgagaaccataactgatatatttggtcaatctatctggtttaatgctattgtggtattgactcatgctgcatcggctccacccgaaggcccaaatggtacagctactagttatgacgttttgtgacccaacggtctcatgtggtccagcaagccattcggcaggctgcgggtgatatgcgtctcatgaaccctgtttcattagtagaaaaccattcagcgtgtagaaccaatcgggctggtcaaagggttttgccaaatgggcaagtgtggaagcctcatttgttactgctttcatttgcttcaaagattctggttgaagctaacatgcttttaaagttgcaagactcgccacctggcaagccatttgcaacaagaactagagcactgccgttaccatatattctttcaaatcttttacaatcgagacctcagctgaagttacctcaggagcagtttggcgatgacggtgatgacatggatgagtcatctgatgaagaatcatcagaatacgatgaattaccaccgtttaagcggttgactacttcccaattgtcaaagcttagcaaggcacagaagaaatcctattatgatgaattggaatacagagaaaagctcttcatgaagaaacagttgcaagaagaaaagaaacaaagaaagatgatgaaaaaaatggcagaagcagctaagaattttccaagtgatttaactgataataatgtagaagaagacagtaacggtgctgcaacagttcctgttgctgctcaagatatgaatttacctgctacatttgatgcagataacccgacccatcggtaccgggctcttgagtctgctaaccaatggctcattagacctgtgcttgacccgcatggctgggaccatgatgttggttatgaaggaatcaacgtggaacacttgcttgcactcaaagaaaagatacctgtatcgttttcaggtcagattaccaaagacaaaaaagatgctaatctccaaatggaggtatcaactgcattaaaacatggaaaatcaaagtcaac

SEQ ID NO: 570 - DNA, 3336 bp, Abutilon theophrasti
atcttcactcggcctgctccaatttttcttcctccattttccttaaaccctataccctaaagccgccgagggagcctatgaatccctctcttctcctttccccttcttccactcagcctcgccctcttcttttcttccctctcaccccttgttccctccccaccacacggcgccgtttcagggtctccttcccccgcaactccctctccactgatgaccaatcccctccctcatcggaaactgcatcccccaatattttcggaggccccaaggagcttactggcatccaacccttggttcagaatttgtcaccgcctgttagactagccacttctgctgtcatcgtcgccggggctcttgctgctgggtatggtctcgggctccgcttcggtggcaatcggaatgctgcctttggtggagcagccattctcggcgcagctggtggagctgctgcctatgcagtgaacgccgctgttcccgaagttgcggctgttactttgcataattatgttgctgcctgcgatagccccgacgccatcaagagagaagatattgaaaatattgcccaaaaatacggagtgagcaagcaggatgaggcatttaacatggagctttgtgacttgtacagtcggtttgtagattctgtccttccttctgcaggtgaagatcttagaggcgatgaagttgaaaccataatcagcttcaagaatgcattaggcattgatgaccctgatgcagcttctatgcatatggagattggtaggcgaatctttaggcaaaggcttgagactggagatcgtgatggtgatttcgagcagcgacgggcatttcagaagctgatttatgtatcaactctggtttttggagatgcatcaacttttcttttgccttggaagcgtgtttttaaggtcactgaatcacaggttgagatcgctatccgtgacaatgccaagcaattgtatgcttccaagataagttcagtcggaagagatgttgatccggaactgctcatctctctcagagaagcacaacttaaattcaaactttctgatgagcttgccaaggatctgttgatggagcacaaaagaaagctagttgaggaaaatatttctgtggcactcaacatactgaagtctagggcgagaactgctgggggagtcaagcaagcagtggaagagcttgacaagatactgtcattcaatgatttgcttatctcattgggtaaacatccagatgctgatcgttttgcccgtgggcttggtcccatctctctagttggcggtgagtatgatagtgacagaaagatggatgagctaaagcttctttaccgagcttatgcaacagattctttatccagtggtcgcatggaaatgcataaggttaatgcattgaaccaactgaggaacatacttggtttgggtaataaagaagcagaagctatcatacttgatgttacttcaaaagtatatcgcaaacgactttcagaggctttccagagtggtgacctagagatggcagatagcaaggctgccttcctccaaaacctatgtgaagaattgcaatttgatccacaaaaggccagtgagatccatgaagaaatctaccggaaaaagcttcaacaatgtgtggctgatggggaactggatgaaattgatgtttctgcattgctgaaggtgcgagtcatgctctgcattcctcaacaaatcgttgatgcagctcactcagatatctgtggcagtttgtttgagaaggctgtgaaggaggctatttctgctggtgttgatggctatgatgccgatgtaaagaatgctgtgaggaaagctgcacatggtttgcgattaactagagaaacagctattgacattgccggcaaggctgtccgtaaggtattcttgaattatgtgaaacggtctcgatcagctgataatcgtacagaatccgcaaaagaacttaagaagatgattgcctttaacaccttggtcgtcacagaattgttggcagacattaaaggggaatcttcggatgctccaccagaagaacctgttacagaggaagtaaaacaagttgatgaggatgatgaatgggaatcccttcagtcacttaggaaaataagacctaacaaggaacttcttgcaaagttgggcaagccaggccaaacagagataacactcaaagatgacctacccgaaagagaccgtaaggacctctacaaaacatacttgctttattgtctgacaggagaagtcaccaggattccttttggtgctcaaataaccacaaagaaggatgattcagagtatgttctactaaaccagcttggtgggatccttggtttgacgagtgaggagacagtggaagtccatcggagtttagcggagcaggcttttaggcaacaagctgaggtgattttagctgacgggcagttaacaaaggctagggttgagcagctgaatgagctgcaaaagaatgttggcttgcctggaccatatgcacaaaaaataataaagagcataacaactaccaaaatggcagctgccattgaaacagctattggtcaagggagactcaacattaagcagataagggagctcaaagaatcaggtgttgatatagacaacatgatctcagagagcttgcgagacaacctcttcaagaaaactgtagatgagattttctcagcaggcactggagagtttgatgaagaggaagtgtatgagaaaatcccagcagatctcaaggttaatactcagaaggcaaaagcagttgttcatgatcttgcacggactagattgtccaattcacttgttcaagctgttgcactgctgcgacagagaaatcaacagggagcgatttcctcacttaatgacttgctagcttgcgacaaggctgtgccttcgaagccgctatcatgggaggttgaagaggagctagccgatctttttggtgtatacgcaagaagtaatcctgcccctgagaagttgtcccgtttgcaatatctgcttaacataagtgattcagtggcagcagctgcccaagagatgggagatggaacactaccagtcggaacagaggaagaaaagtttgtgttttgaatgtttggtgtagagccttttgttttaggaacatttttgaaggccaatttatgttatgaagttgaaagtagaggtttagtgataaagaggtgtttgatctttgattgctgcttttttcttgctctatgttttgctcgacacttactactatttgtcctgagggattcttatattgagtcatgtctagccgaccccaaattattttgggattaagactttgttgttgttgttgggggaaacaata

SEQ ID NO: 571 - DNA, 5665 bp, Abutilon theophrasti
  unsure (1)..(5665): unsure at all n locations
agtcattatgtgatttaactacagacggacgaccatttctgccagtttttctacgatgaaccggtcttctgtacttggcccttcgagtataattatgaaaagggtgttcaccctaaaaagtatccacaatatacaaatattgatgagcaggcaatttctagcataactgaaacaacaggcccgaataattattaaattatcccccaaaattatatataaaaaacagaccagaaactggaatcatagaactaaagtagacatgtctcatgtctgatatgaagctcttaagtgaagcaaaaactaaattaagaagtcagtttttcaagtgattccattttgaaagaaagcaattaactatatacggctagataagaggagcaaacttgagtcaatgacggcaagaaggagaaagataaaagacagaatttgactgatacctcaaaacaatttaatatgctgttgaagtctgatatgtgataattagtttctgccttagtggagtgactctttatcccgatgatttcagtcggtagaaggtaggaatatttccggagattacattcctttctaggatcgaaactcctaaaagtaggcaatgatacaaaaataaaaggacactcagaaatgaaatatttgtgtaaactactgaagcagaattcggaataaacaaactcaggctctctcacttttgtgaaggtaatatactgaagactttgatatttcctggaagatgagagttaatgcaatgagccagagcaatgacgttggggtcttccttccaagcattttcaggtatctccatttttaaggagatcatagttgccaaagagtgaacctaaaataatccattcagaatacaagttttagcaccgacaaacaaccacatttcaagcacaaacaaacagtaacaaaaaacatactcctttatctgttcggctgcttctggcccaggcaattttgtgcagatcaccgtagttactctcacggattcctccagccttgtaaatggcagtttccagttcgttttcaacagctacatcacatcactgcaaccttttaatatgttccagaattcatagtagctatgaaggaaaaaggcaaaactgaaatgcaatggccaactgagcacctataatatgattaacagcaacacaaaataaataacagcttgaagttctaaacctctgttacttaaaatcgatatctccccagcaaattttcaatcggtatgcacgatcccaattagggaacgctggcaatccatttcagtgaaactaaagatccaattagtataaagttacagagtgaaacagacaatttgcaaacttcaaattttatttatttagaataatgtatttatataaacacaaaaaacatagatacattctaataaatcgtaattggctactactaaatgaatcggaaaaaactatccaagtagcaatttatgttctaaattccgtttctcgtgccagacaatcggcggtaacattgcagtggatatcgggcaggaaattctaaaccaaaataggaaaaaggaaagataagaaataaagaagcagtagcttactagataactcgtgctcatctcgctgcacttgaagacctctgtagtcggtaccaacgtagccgactcgcatgacgacctttttcttgcggaaaggttcccatttgccggcggagagagggaggggcgcgtccttttcttctacggagggctgagcagtgcagaggattcgaaaagggattaatttcaaaggaggctgccttggccttggagttttcacgacccatggagccaatgatactctcagacacgaaatggccattggctttgggttttgggttttcccggttcacttgcgtttcgggtctagttaacacacacagagtagaagacagaacgggatgatattgtgtgttacctgttcttgctgctgtcacgtagaacggtaccgtttagatttgctcatggcttggccgtcaaaaaacaatggggataattaatacaatattttcttttagtgtaatctacatagaaaatcacctggttataaaactatttaagtcactgaagtatttgttggaatatttaaatcaccaacgttatcgggttgaacatactggtccgggcgacgttaaataggaacggaaaatctacgtggcatttaatggctgagttaaattggtttatttacaaattgatgcggtcacttcacttcctaaattggtttatttacaaattgaccccttcactccctaaattctttacaatccagcccacgtttttgtcttctttctttacaatccagtcctggccgccaccgtcgtccttttctgccatcaccggcgttggtcacgtcctgaccgaaccaccttcggtcaccccctcacattccccaaccgaaccaccttagcagaaccaccgaaccaccatgatttctttcttcttttcctaaaaccctagctcttctttataccagccagccgccaccgatggtcaccgccctccgctcgtcatcgtcggtcctctgctcgtcgctgtcggtcctccactcgtccccgtcagtgcttctttggttgcgcaaaccgaattggttcgatttttctcgtcgccgccggtgttcctttagccatgtcggaaatatgaagaagatgaatgacgtggcggtgacgtggcttatttaatattttattatgccacatcattgtgccacgctgtgcaatttaacggtcaggacttgtttcttcaactcgataatgttagtgatttaaatattccaataagtacttcaatgacttaaatggtttttaaaaatactttagtgattttccatgcagtttaccatttcttttatttattttcttttattcaatttaaactccgtcatcattatcacattaacaatttggactgctcataacacaatattttgtaaaccattcaccaatagttctcatcttaattacatctcttcataaaaaccaattatatatttttttcattcctcaaaaacaaccaatgcagaattcatttaacctgattcctccattttcttaccacatctttactttaaactatacatttaaattgtgccctccctccatatgtcagtcttagagcatctttaatggaggtgaatatggggtggatataatgtggaaaccaaaatgaaggaaggaatgattaaagaggtgggatggatatgagaagatggatttaatccattagtggattccgataaaaaaattaatttttttattaattgggcgcgcgagacccaccggctgatttaatcttttttttcctttgacatatagtcgttgaattattggaatattggacatgcgagacctacatgtaaggaagagaaagagaaaaatgagaggattatggagtgaatggataaacatgcttttggtattattcttccttttcagttttactattttattgattcggtttcaaaagcgacactagcaccgagctgactattttctaacgccacacacattacaagagaatcgtgcaaagcccacaaatctaggggcacatagcccatcttccactcgttactctataagtaatcttagcctctaaaattaaagagacctctctccttcctgactacgtctccaccactatagataattcttagccaactcagaagaaccatccataacctcccctttactccatgtatcaacaaatttctatgagggcgattcatgacattaaatctaaattattttttctccttttatttaatctccaagacatgaaaatcctcctcatttagcatgaaaatccatattgattggattcttaaaaatcccgacgtgatattaaaacaatgaattgcagtcaacaaataagtccatgtgtcaatagatgcgttgtgtagcagtgttttagttaannnatgtttgtcatgtcattaatttcgtattatataacggtcaacaccgatcaagaaaacatattaattctaattgaaagatgaggaaagatattattcgtaaaaaaataaaacattaatttttttctctaaaagttcagagataatctgtattcttacgcgggtattgtatgattgtatctcttcctgaacattggtgtcctcacaattctaaaaaatatatgcttataaaagaaaatgatcaaattagaataatattaaaaaaaactaaaaatgtgaaaaatacatgatagatggagcttctttgcaattttaccacgttaaatttgcaaatcgatacaagctgaaggtgaagccgctgcagtgtatatctttaaactcttcttatctttctttcttttctttccctatcccatcttcactcggcctgctccaatttttcttcctccattctcgttaaaccctataccctgaagccgccgagggagcccatgaatccctctcttctcctttccccttcttcctctcagccccgccctattcttttcttccctctcaccccttgttccctccccaccacacggcgccgtttcagggtctccttcccccgcaactccctctccaccgatgaccaatcccctccctcatcggaaactgcatcccccaatattttcggaggccccaaggagcttactggcatccaacccttggttcagaatttgtcaccgcctgttagactagccacttctgctgtcatcgtcgccggggctcttgctgctgggtatggtctcgggctccgcttcggtggaaatcggaatgctgcctttggtggagctgccattctcggcgcagctggtggagctgctgcctatgctgtgaacgccgctgttcctgaagttgcggctgttactttgcataattatgtaactgcctgcgatagccccgacgccatcaagagagaagatattgaaaatattgcccaaaagtacgtcttattgaatcttacccattcattattgtgattaagttgaaaatattcaggcgtttgtttttcgctaatttcaccgggaacgatcatgctagtctttttctcaatgcttaaaatgattcagatacggagtgagcaagcaggatgaggcatttaacatggagctttgtgacctgtacagtcggtaagtttgatgccagttatagtcagctatctccttatttggacaaaggatatccttgcaaggtttggttctgaatctttgatggttacaggtttgtagattctgtccttccttctgcaggtgaagatcttagaggcgatgaagttgaaaccataatcagcttcaagaatgcattaggcattgatgaccctgatgcagcttctatgcatatggaggtaatcttgtgccgttcactctatcgatacgtttacctttaatggatgtttcagaatcgtttatttgatattgcttgctagattggtaggcgaatctttaggcaaaggcttgagactggggatcgtgatggtgatttcgagcagcgacgggtcagtcaattgtcgttattatgttaatctgtaattatgaatttggaacttaggaggatgtaatctgcatatggagcttgaccatttttagtttctttccagtgcaggcatttcagaagctgatttatgtatcaactctggtttttggagatgcatcaacttttcttttgccttggaagcgtgtttttaaggtcactgaatcacaggt

SEQ ID NO: 572 - DNA, 1003 bp, Abutilon theophrasti
attttaggttaatgcattgaaccaactgaggaacatacttggtttgggtaataaagaagcagaagctatcatacttgatgttacttcaaaagtatatcgcaaacgactttcagaggctttccagagtggtgacctagagatggcagatagcaaggctgccttcctccaaaacctatgtgaagaattgcaatttgatccacaaaaggccagtgagatccatgaaggtatcagaagcagggttgggaaaaagacaaatcagaggcttttttatcttccctattaggatattgtttttctgttttcaaccttgataatattatctggagtgtctgatatgtttattctgtttcaagaaatctaccggaaaaagcttcaacaatgtgtggctgatggggaactggatgaaattgatgtttctgcattgctgaaggtgcgagtcatgctctgcattcctcaacaaattgttgatgcagctcactcagatatctgtggcagtttgtttgagaaggtaaaattgtgtctccttggccctagagattcattattatagtactaaatttattcagccaattggcctgtacagttgtttttttattcatgttctacacttggaaatggtgtaagtcgatgcaatgacttagtatttattgcattagcatctcatcacctgtactgtaatttaaaaaggatctattgttctagcgactgtcatattgatattggaaactggcaaaaattaaaaatctcacatggattattggaaccaaaagatgtggttagttgtgtcatattgttgactctctttttcttctttggattataaattatcccttcaggctgtgaaggaggctatttctgctggtgttgatggctatgatgccgatgtaaagaatgctgtgaggaaagctgcacatggtttgcgattaactagagaaacagctattgacattgccggcaaggctgtgagtacacactagggttatgttgtgtcaatggttatttt

SEQ ID NO: 573 - DNA, 880 bp, Abutilon theophrasti
gtttgtatatttctgcattggcttctaactaaggatatttcgatcagaaatttttacttttacataccatttatgcaactaatgaaaaagaggtttttcagtgggggggtcaagcaagccgtggaagagcttgacaagatactgtcattcaatgatttgcttatctcattgagtaaacatccagatgctgatcgttttgcccgtgggcttggtcccatctctctagttggtatgctccatggtcctttgatcagatccatggatatagaccttgtcaattgtactggacagttatatatttaagcatatattaaaatttagtcagctgggtgattctctctggctttgtttaaaacgagttagcaaacatgttttttaccaagttgtatttatacctaatatttatgataaataaggtttgagtatcactaatccaaatccataaactagcattatttatgactggcttaggcggtgagtatgatagtgacagaaagatggatgagctaaagcttctttacagagcttatgcaacagattctttatccagtggtcgcatggaaatgcataaggtaacttagtttcttctttctatattcctgttcaatttgctcatggttagtcttagtttagaggtccaaagaacatcatgagtccctttattatagcagttattaccttctttgaaagatgatcactcctgaagaaaatttcttatatataaagctagtgtttatttgtttatctcctgcttatcttattaatagaagaaaactgaatgcttgtaacctggactaaatcagatgatccatattacgttatgaaaaaaatatcaagctggtttctaaagaatatgtgttcattgtcctgctattaattt

SEQ ID NO: 574 - DNA, 454 bp, Abutilon theophrasti
tgtagcttgccaaggatctgttgatggagcacaaaagaaagctagttgaggaaaatatttctgtggcactcaacatactgaagtctagggcgagaactgcgtatgattatcgatacctagactctaatgcagttttttcttttcgatcagaaagttttccttagtgatgatggttaattgcgtttgtatatttctgcattggcttctaattaaggatattccgatcggaaatttttacttttacataccatttgtgcaactaatgaaaaagaggtttttcagtgggggagtcaagcaagcagtggaagagcttgacaagatactgtcattcaatgatttgcttatctcattgggtaaacatccagatgctgatcgttttgcccgtgggcttggtcccatctctctagttggtatgctccttggtcctttcatcagatgcatggatatagacctt

SEQ ID NO: 575 - DNA, 1714 bp, Abutilon theophrasti
  unsure (1)..(1714): unsure at all n locations
acttgttcaagctgttgcactgctgcgacagagaaatcaacagggagcggtgaggaatatagaagcttggtttcatataattcaatagtgtttgtttcaacatacttgcatttgttataaggtcacttaattcctagattctaaatgctttgttgctggttttgtagatttcctcacttaatgacttgctagcttgcgacaaggctgtgccttcgaagccgctatcatgggaggttgaagaggagctagccgatctttttggtgtatacgcaagaagtaatcctgcccctgagaagttgtcccgtttgcaatatctgcttaacataagtgattcagtggcagcagctgcccaagagatgggagatggaacactaccagtcggaacagaggaagaaaagtttgtgttttgaatgtttggtgtagagccttttgttttaggaacatttttgaaggccaatttatgttatgaagttgaaagtagaggtttagtgataaagaggtgtttgatctttgattgctgcttttttcttgctctatgttttgctcgacacttactactatttgtcctgagggattcttatattgagtcatgtctagccgnnnnnaaattattttgggattaagactttgttgttgttgttgggggaaacaatatattctctctttatatatatatatataataataagccaaatatgaagattttctgattttgtgtctttctcctagttagtgcaaatcaaatatgagagaattagtttatacaagtattaatcattttctgctattctatttgcctccataagaaaaatatccactgccagccaatacagtgtcacgttcattttccagcaagaagttggaggcatggtacatgaaccttagagaatacctaataatacagttttctttgctatcatcaaatggtcaaataagttaaattgcagggttctttcagagactccaattggtgcctgcaaacctcccgtctgcctgcatgcaaagtgagcacatgagacatggtaaaaggagaaggattatcaattttcataatctgtaaattcggtacgcaagcagttttgaattttgtttaactataaatataaactaagagcttaaaagatgtagtaaatcattaaatttagaaaattatgaggttattgaaattaatgtagctataattatttgccacagaatagaattcatctaaagataatgcaactaagcagcagaaacaccaagaatggttaaaaaaacaaattttgttagctttatttctagtgtacaagatgcagcactttcctagattatccacataagccatgaattaagtaattttatgtgcatggctgcggtcaccatgagagcgaatctgttcattcaattcctgaggttcaaaaacattcctagataggatgtgtgcatctagaatcacatagaaaataacattttctcgtaaagcaatcagagactacgtttgattactattgcattaacacgaggaaaaaattaattattacattagtattaacgctaacatatggtacaaatcttaacttgaaattagaaagatgagcgtataactcgagcaaaatataggacctcgtcaacaaatcttaacttgaaattagaaagatgagcgtaaactcgagcaaaatataggacctcgtcaacataacgcaggtatattatatgctcagggcacaacatactc

SEQ ID NO: 576 - DNA, 946 bp, Abutilon theophrasti
tttctaatcatcatatatgtgctcaggtccgtaaggtattcttgaattatgtgaaacggtctcgatcagctgataatcgtacagaatccgcaaaagaacttaagaagatgattgcctttaacaccttggtcgtcacagaattgttggcagacattaaaggggaatcttcagatgctccaccagaagaacctgttacagaggaagtaaaacaagttgacgaggatgatgaatgggaatcccttcagtcacttaggaaaataagacctaacaaggaacttcttgcaaagttgggcaagccaggccaaacagagataatactcaaagatgacctccccgaaagagaccgtaaggacctctacaaaacatacttgctttattgtctgacagaagtcaccaggattccttttggtgctcaaataaccacaaagaaggatgattcagagtatgttctactaaaccagcttggtgggatccttggtttgacgagtgaggagacagtggaagtccatcggagtttagcggagcaggcttttaggcaacaagctgaggtgattttagctgacgggcagttaacaaaggctagggttgagcagctgaatgagctgcaaaagaatgttggcttgcctggaccatatgcacaaaaaataataaagagcataacaactaccaaaatggcagctgccattgaaacagctattggtcaagggagactcaacattaagcagataagggagctcaaagaatcaggtgttgatatagacaacatgatctcagagagcttgcgagacaacctcttcaagaaaactgtagatgagattttctcagcaggcactggagagtttgatgaagaggaagtgtatgagaaaatcccagcagatctcaaggttaatactcagaaggcaaaagcagttgttcatgatcttgcacggactagattgtccaattc

SEQ ID NO: 577 - DNA, 323 bp, Abutilon theophrasti
atatatactatttatgcctccaggttgagatcgctatccgtgacaatgccaagcaattgtatgcttccaagttaagttcagtcggaagaggtaacacatgcgtgttccttctgtggtgtattttagattgaccatttagaatttgaagtggttgtatgattaatgttattctgcaatcttgaaaacctaaataaaaacctttaatgttaatattgtttgaaatatttattttcagatgttgatccggaactgctcatctctcttagagaagcacaacttaaattcaaactttctgatgaggtacattcttcacaatttttggc

SEQ ID NO: 578 - DNA, 1218 bp, Alopecurus myosuroides
cgttgccgcgttggcggcggcggggtacaccctcgggacccgctacggcggcggctcgcggaccgcgtctgtcgcgggcgcggccgtgctcggggccgccggcctcgcgggcgccgccgccgtgaactccgtggtgccggacgtcgccgccgtggggctgcacaactacgtcgccagcagcgacgaccctaccgagctggaggccagccaggtggaggccatagcgagcaaatacggagtcagtacacaagatgcggctttcaaatcggagctctgtgacttgtataccagctttgtttactcagtacttcctccaggacatgaaaatctcaaaggtaccgaggttgaagatattataaagtttaaaagagctcttggactcgatgatgtagatgctgcaaacatgcacatggtggttggtagacgcttatacagagagagactcgatgcgttccaaaaattaatttttgtgtcaaatcttgtcttcggagatgcagcagacttcatacttccatggaaacatctttttgggatcacggattaccagatcgatattgctatgcgggagaatgccaaaagcttatacgcgttagagctcaagtccattggaagaggtcttgacataggcacgctcattgaagtaaggagggtacagcttgcatacaaactttttgacgaggttgctgctgacatgttcagggagcatgcgaagaacttgattcaagagaatatttcatctgctttatccatattgaagtccaatcctggttcagcgaacattccagcacaggttattgatgaagtgaatagcgtccttgcattcaatagtttgctaacagttctaagcaaacaccctcagggtgatcgatttgcacgtgggcttggacctgtttcgttaggtggagagtttgatcatgagaggatagttggtgatctaaaggtactctatgcagcctatgcaacggaagtactttcagatggcaatattgatgatgagaagcttgtcaacttgagtgaattgaggaatatatttggactggggaagcgtgaagcagaagcaatcatagaaggagtcacggcaaatgttaaatctcaagtaccggcataatactcgtgcgtgcgcatcgatgcacattaaagaaaatgtactactttgttcaagaaaactgttttctttgttgaactttgaaacagacaaagagaacaatgccattagaa

SEQ ID NO: 579 - DNA, 1994 bp, Alopecurus myosuroides
  unsure (1)..(1994): unsure at all n locations
gagtccttctgaaagcacttctgttgcatgtgggcttggacctatttcattaggtggagagcatgatcatgataggagggctggtgatcttaagatactctatagggcctatgcaacagaagtgctttcagaaggactccttgataatgagaagcttacacctttgaatgatcttcgcaatatatttggactggggaagcgtgaagcagaagccatcatatccgatgtcaaatctcaagcatacaggaagagacttgcaaaatgctttaacagcgatttggctgcggctcctagcaaagcatcattcctccaaaatctctgtgaagaactacattttgatcctgaactcgctagcaagatgcatgaagacatttacagacagaagcttcagcagttcgtagctgacggagagctgagcaaggatgaaacagaagctttgatggcattccaagtgcggctctgcatccctcaagaaaccgttgatgctgctcatgctgacatatgtggccagttgtttgaaaaggttgttaaggaagcgattgtatcagttgatggatatgacgctgatagacgagtggcagttaggaaagcagcacagggtctaaatttgaaaaaggaaactgctatgaccatcttcagtaaagcagtacggaaattgttcctgaactacattcagaaagcaaaagcagctgggaaccgcattgaacaggcaaaagagctgaagaagttaatttccttcaacacagttgttgtaagtgagcttctagctgacattaaaggagaggcaacaactgctgaacctgcagcatcaagtgcgacctcagaacctgagaccacagaatctgagggagaggatgttgactatgaatgggaatccctggaaacattaaagaagaccaggcctgataaagagctaaaagaaaaacttggcaagtcaagtcagaaagacataaccctcaaagatgatcttccattgagagacagagctgagctgtaccgaacatatttgatgttctgtatcaccggggagacgactaatgtttcatttgggacagcaatctcctcgaagaaagacaattcggagtatatgatgctaaggcaattgggaaacatacttggtttaacccgcaaggaagctcaagatgtccacattaagctggcagaaaaagcatttgtggaacaggctgaagtagttctagctgatgggaagctaacagaatccaaggctgaccagcttgcaaagatacagaagcaggttggtttgcccgctgagcacgcgcagaaaatcatcaagagcatcacaacaacaaagttgtcttctgcaattgaagcttctatagctcgagggcagattggtatagagcaggtccgaggactgaaagaagcaaattttcagctagatagcttgatttcagaaccgttgcgagaaacgatttacaaaaagtgtgcagaggagatattttcatcaggcacaggtgattttgatgaagaggaaatgtatgttaagatgccaggcgatcttatgataagtgttgagaaggccaagtcgattgttcagggtattgcaaagcttaggctggagaatgcccttgttcaggctgttgctcttcttcggcagaagaagaaagatggtgtgatctcttcattgaatgacttgctcgcatgtgacgccgctgtccctgcttcgaagccgttgtcgtggcccacactgggagagctggatgacctgtactgcgtttacatgaagagtattcctaagcccaataagttatctaggttgcagtacttactgaacataagtgctgagaaggctgagcagcttcgggatgccgcaacggcgggcacactgccggtcacagctcaagaggaagaagaagaattggcgttctaggagtgatgagaagatacttttgttaggtagccagcagagtcgagctcctgcgagacgtggtnctgtggcaccaacagctgctgttgtagctaggcatggtttt

SEQ ID NO: 580 - DNA, 731 bp, Amaranthus albus
tatacgtaaagagcgacgcagcacctgagaaggcctcacgtctacagtacctgctggggatcagcgactccacggctgctgctctaaaggagagggcagacactgtacccgttactggttctgaagtcgacgattttgtattttagagaagaaaagttgagctatagtctagatattcttcgactcgaaatcattactagccaggtgcagcaggtgcatattagcagctgttgctttaatgtccaccaaatctggaaacatagattccagatattccttttcgaacccatttgaaccagacatcataaactctaacaattgtttatgctttgaccacagttcatcaataccatagctgaagacgatatgatctgtttgcttatctcgcacatcgctgggcagaggcattcgtttgataggagcagcccctgcaaactgactgagtctataaaccccattcattgatttaaacagattatcctgctcgtatggcatcaaagaaaaattacttgatcttgttagctcttgcctggatccagaagttggtaaaagttgcgaaaaatccttataggatctggaaatgggttgttcatgataaaatacaagtccaggatgattatgagtagacgccattaaagaaagcaaaaccatatcgaatttcagcgagaatctgagatcagaaactgaagaaagagtagtttctgatcccagaagtctcggatccttgcgtt

SEQ ID NO: 581 - DNA, 1063 bp, Amaranthus albus
cggtttctctgcctcaataaagccacggcttgaaccaatgagttcgttaatctgcttcgagcaagttcatggacaattgctttagccttctgcgggttaattttcacatctgcgggaattttttcgtagacttcctcctcatcaaactctccggtaccggaagaaaatatctcatcaacagtcttcttgaagagattctcccgaagggtctccgcaatcatggtgtcgatattcacacccgcatccttgagttctctgatttgttttatgctgagccttccctggccaatagcagtttcaatggcagcagccatctttgaatttataatgttctctctaaccttttgagcatattctgcaggcagcccaacttgcttctgtacctcatcgagctgctccatccttgctttagttaactgtccatcggccaaaatgacctcggcctgctgtctaaaagcttgctccgccaaacttctatgaacctccacaatctctttacgtgaaagaccaagaatatcgccaagctgattcaaatagagatactctgtattgtccttttttgtggtgatttgtgcaccgaacggtatcttggtcacttcccctgttatgcagtacattaagtatgtcttgtacaggtcagccctctccctgtctgaaaggtcatctttgacggtaatttcagtctgccctggtttcccgattttcacctcgagttccttagtaggtcgtgacttccgtaatgtctgaagcgactcccattcttcctcatcttcaatctgcttctcttgctcttttgcaggttcctcgtctgttggagcatcagttgattcccctttgatgtctgcaactaattctgtgaccactaaggtgttaaaagcaatcatctttttgagaatttttgcagactcagtgcgactccctgctgcattgaacaagttgaagaacatatttggcctaggaaaacgtgaggcagaaggtataatgatggatgttacttcgaaggtgtatcgcaagctaactatctcaggtcgtttttctagtggtgctctggatgctgcagata

SEQ ID NO: 582 - DNA, 1063 bp, Amaranthus albus
ttgatggttatgatgcagatgtaaaagcatctgtaaggaaagcagcacacggcttacgtttgactagggaagctgctatgtcaattgctggcaaagcggtccgtcgaatatttatgaactttatcaaacaagcaagggcagcagggagtcgcactgagtctgcaaaaattctcaaaaagatgattgcttttaacaccttagtggtcacagaattagttgcagacatcaaaggggaatcaactgatgctccaacagacgaggaacctgcaaaagagcaagagaagcagattgaagatgaggaagaatgggagtcgcttcagacattacggaagtcacgacctactaaggaactcgaggtgaaaatcgggaaaccagggcagactgaaattaccgtcaaagatgacctttcagacagggagagggctgacctgtacaagacatacttaatgtactgcataacaggggaagtgaccaagataccgttcggtgcacaaatcaccacaaaaaaggacaatacagagtatctctatttgaatcagcttggcgatattcttggtctttcacgtaaagagattgtggaggttcatagaagtttggcggagcaagcttttagacagcaggccgaggtcattttggccgatggacagttaactaaagcaaggatggagcagctcgatgaggtacagaagcaagttgggctgcctgcagaatatgctcaaaaggttagagagaacattataaattcaaagatggctgctgccattgaaactgctattggccagggaaggctcagcataaaacaaatcagagaactcaaggatgcgggtgtgaatatcgacaccatgattgcggagacccttcgggagaatctcttcaagaagactgttgatgagatattttcttccggtaccggagagtttgatgaggaggaagtctacgaaaaaattcccgcagatgtgaaaattaacccgcagaaggctaaagcaattgtccatgaacttgctcgaagcagattaacgaactcattggttcaagccgtggctttattgaggcagagaaaccg

SEQ ID NO: 583 - DNA, 337 bp, Amaranthus chlorostachys
gagatccatgaagaaatatatcgacagaagcttcagcaatgtttagctgatggggagttgagtgaggaggatagtcaaagctttgcttcgtgtacgagttatgctctgtgttcctcaaaaggttgttgaagcaagcacatgctgaaatttgtggtagtttgtttgagaaggttgtaaaggatgctattgcttccggtgttgatggttatgacgcagatgtaaaagcatctgtaaggaaagcagcacatggcttgcgtttgactagagaagctgctatgtcaattgctggcaaggcggtccgtcgaatatttatgaactttatcaaacaagcaagggc

SEQ ID NO: 584 - DNA, 4425 bp, Amaranthus graecizans
gactcttgctccctttatgtcttccgttttgcacctcctcgtttgccatttctgcaccatgttctgtgtcttccgccttcagtttcagctctcgtacctctttctctgctagcgcagttttcatttccacctccttcgcctctgccattaacgcttccttccaagcattagccgctgctactttcttgtcagaaagttcacaagcttctactgcacatcctgtcaaataatcatactcaaatttcgatattctaatggtggatttccttttggaagccctagatcttgctacttcctcagcaagagttttaagtctttcaagcacatctaattctgctcttttaactacttcaagctcctcaattactacttccatggcctcctcatttgtactagttttagtctcgattccatcgatttcaaccctaatgttttcaatctcgtttctcaactccgattcctctttcttcgcgtcttccttttctctcgccaactcctccaacgcaagcgaaagtgtcggttccatggccttcgtcttctcctcacatgcttttgcagcttccaacttctctttcgctctaagaatcttcgagtttagtttctttatacacttctcggtttctgcttcccttttttcgattttagccttttccttcaaaacatcattcaactcatttctgattacatccatacttctcataacttgaaacccttctgttgtaatagcctcatactcttttcgtgctgcatccacttctctagctgaacttctcaaattttcatttctacgaaacccactgtccatttctttgatcaaattcagttcatgttgcaatacttcagaatccgacttagttagctcgaatttttcttcaagatctttcattttttcgatctcatccttcaacacacagattttctttctagtttcttcaatcagtaacaatttttttccatttcttcatttttctgtgattcaatctctttgagttcctttcgcgcctgaatttcagcgagttcaaccaatacctcctcatcattatcgtcttcctctcctctcctctcctctcccctcctctccccctgcaacaaccccatttctgggttgattcttcttcccaaaacccccgccccccattaaaatccccataaacccttaaaaatcaaattgaaaaaccctaaaaatgagttcaacacttcctctttcttcatccaaatccccacttcttatctggaattccacaaacccaaatccaatcccttcctttcttccccccaaatttatcaatttaccagtcgtttcctccttaaaacgacatcgttttcgggtttctaagctcagatgctccactaatccaatatctcaaccctcacccacagccgcacccgcacccgcacaggagatcacaaccacttcaactagtactagcagcaatagttctgatatatttgggcctacaagagaattatctggtatacaatcactggttgacgggttgtcacctccagtgagaataacaacctctgtacttctagttgtggctgcttcagctgctgggtatggtttgggttctcgatttgggggtacccggaatatggccattggtggcgctgttgcagttggtgttgttggtggtgttgctgcttacgggttgaattcttgtgtacctgaggttgctgctacccgtttgcataattttgttgctgaatgtgatgaccctcttaatttgaacaaggaggatattgttgctattgctaatcggtatggtgttagtaaacaagatgaggcttttactgctgagctttgtgacttgtaccttagattcatttcttcggtacttccgtctggaaatgaagatcttaagggtgatgaagttgaaacaatcattaaattcaaaaatggacttggaattgatgatcctgatgcggcaaacatgcatatagagcttgcccgtcgtattttcagacaaaggcttgaaaccggagatcgtgatggtgacattgaacagcgtcgggcatttcagaagctaatttatgtttcaactcgtgtttttggggaggcatcagcatttcttctaccctggaagcgtgtatttaaagtaactgattctcaggttgaagttgctgttcgtgacaatgctcaaagattgtatgctgagaggctgaaaccaattggcagagatttggatacaaagcagcttattgagttgagagaaactcaaatttcagttcagctctccgacgagttggccgaggagatgtttaaagagcatacaagaaatctagtagaagaatgcatttcaagagctgttgggattctaaaatcacggacgagagcagggggaactattgatgttgtgctagagcttgataaaattcttgcttttaacgatgtgcttctctcactaaaaaaccatccagatgctgataaatttgcccgtggaattgcaccaatttccttagtaggaggtgagtatgatagtgacaggaggattgatgacttgaagctcctttttagagcgtatgttacagatgctctatctaatggccgcatggagggcaacaagcttgctgcattgaacaagttgaagaacatatttggcctaggaaaacgtgaggcagaaggtataatgatggatgttacttcgaaggtgtatcgcaagctactatctcaggcgttttctagtggtgctctggatgctgcagatagcaaagcaaattaccttcagaatttgtgtgaccagctgcatttcgaccctgagaaagcaagtgggatccatgaagaaatatatcgacagaagcttcagcaatgtttagctgatggggagttgagtgaggaggatgttaaagctttgcttcgtgtacgagttatgctctgtgttcctcaaaaggttgttgaagcagcacatgctgaaatttgtggaagtttgtttgagaaggttgtaaaggatgctattgcttccggtgttgatggttatgatgcagatgtaaaagcatctgtaaggaaagcagcacacggcttacgtttgactagggaagctgctatgtcaattgctggcaaagcggtccgtcgaatatttatgaactttatcaaacaagcaagggcagcagggagtcgcactgagtctgcaaaaattctcaaaaagatgattgcttttaacaccttagtggtcacagaattagttgcagacatcaaaggggaatcaactgatgctccaacagacgaggaacctgcaaaagagcaagagaagcagattgaagatgaggaagaatgggagtcgcttcagacattacggaagtcacgacctactaaggaactcgaggtgaaaatcgggaaaccagggcagactgaaattaccgtcaaagatgacctttcagacagggagagggctgacctgtacaagacatacttaatgtactgcataacaggggaagtgaccaagataccgttcggtgcacaaatcaccacaaaaaaggacaatacagagtatctctatttgaatcagcttggcgatattcttggtctttcacgtaaagagattgtggaggttcatagaagtttggcggagcaagcttttagacagcaggccgaggtcattttggccgatggacagttaactaaagcaaggatggagcagctcgatgaggtacagaagcaagttgggctgcctgcagaatatgctcaaaaggttagagagaacattataaattcaaagatggctgctgccattgaaactgctattggccagggaaggctcagcataaaacaaatcagagaactcaaggatgcgggtgtgaatatcgacaccatgattgcggagacccttcgggagaatctcttcaagaagactgttgatgagatattttcttccggtaccggagagtttgatgaggaggaagtctacgaaaaaattcccgcagatgtgaaaattaacccgcagaaggctaaagcaattgtccatgaacttgctcgaagcagattaacgaactcattggttcaagccgtggctttattgaggcagagaaaccgtactggggtgatatccaccctgaatgatctgctagcctgtgacaaggctgtgacttccgagccgttgtcatgggaagtgcccgaggaactagcagatctgtttgccatatacgtaaagagcgacgcagcacctgagaaggcctcacgtctacagtacctgctggggatcagcgactccacggctgctgctctaaaggagagggcagacactgtacccgttactggttctgaagtcgacgattttgtattttagagaagaaaagttgagctatagtctagtgcagaggatattgtgttagtgaatactcaaataggtttatctatcaagaagataatttatttctgctgattttgcatttcgagtacgacaaaagatttaaatgagatagatacct

SEQ ID NO: 585 - DNA, 2743 bp, Amaranthus hybridus
atcggtatggtgttagtaaacaagatgaggcttttactgctgagctttgtgacttgtaccttagattcatttcttcagttcttccatctggaaatgaaaatcttaagggtgatgaagttgaaacaatcattaaattcaaaaatggacttggaattgatgaccctgatgctgcaaacatgcatatagagcttgcccgtcgaattttcagacaaaggcttgaaaccggagatcgtgatggtgacattgaacagcgtcgggcatttcagaagctaatttatgtttcaacccgtgtttttggggatgcatcagcatttcttctaccctggaagcgtgtatttaaagtaactgattcccaggttgaagttgctgttcgtgacagtgctcaaagattgtatgctgagaggctgaaaccaattggcagagatttggatacaaagcagcttattgagttgagagaaacccaaatttcagttcagctctctgacgagttggccgaggagatgtttaaagagcatacaagaaagctagtagaagaatgcatttcaagggctgttgagattctgaaatcacggacgagagcagggggaactattgatgttgtgttagagcttgataaaattcttgcttttaacgatttgcttctctcactaaaaaaccatccagatgctgataaatttgcccgtggaattgcaccgatttccttagtaggaggtgagtatgatagtgataggaggattgatgacttgaagctcctttttagagcgtatgttacagatgctctatctaatggccgcatggaggacaacaagcttgctgcattgaacaagttgaagaacatatttggcctaggaaaacgtgaggcagaaggtataatgatggatgttacttcgaaggtgtatcgcaagctactatctcaggccttttctagtggtgctctggatgctgctgatagcaaagcaaattaccttcagaacttgtgtgaccagctgcattttgaccctgagaaagcaagtgagatccatgaagaaatatatcgacagaagcttcagcaatgtttagctgatggggagttgagtgaggaggatgtcaaagctttgcttcgtgtacgagttatgctctgtgttcctcaaaaggttgttgaagcagcacatgctgaaatttgtggcagtttgtttgagaaggttgtaaaggatgctattgcttccggtgttgatggttatgacgcagatgtaaaagcatctgtaaggaaagcagcacatggcttgcgtttgactagagaagctgctatgtcaattgctggcaaggcggtccgtcgaatatttatgaactttatcaaacaagcaagggcagcagggagtcgcactgaatcagcaaaaatcctcaagaagatgattgcttttaacaccttagtggtctccgaattagttgcagatatcaaaggggaatcaactgatgctccaacggaggaggaaccagcaaaagagcaagagaagcagatcgaagatgaggaagaatgggaatcgctccagacattaaggaagtcacgacctactaaggagctcgaggcgaaaatcgggaaaccagggcagactgaaattaccgtcaaagatgacctttcagacagggagagggccgacctgtacaagacatacttaatgtactgcataacaggggaagtgaccaagataccgttcggtgcacaaatcaccacaaaaaaggacaatacagagtatctgtatttgaatcagcttggtgatattctcggtctttcacgtaaagagattgtggaggttcatagaagtttggccgagcaagcttttagacagcaggccgaggtcattttggctgatgggcagttaactaaagcaaggatggagcaactggatgaggtacagaagcaagtcgggctgcctgcagaatatgctcaaaaggttagagagaacattataaattcaaagatggctgctgccattgaaactgctattggccaaggaaggctcagcataaaacaaattagagaactcaaggatgcgggtgtcaatatcgacaccatgattgcagagacccttcgggagaatctcttcaagaagactgttgatgagatattttcttccggtaccggagagttcgatgaggaggaagtctacgaaaaaattcctgcagatgtgaaaattaacccgcagaaggctaaagcagttgtccatgaacttgctcgaagcagattaacgaactcattggttcaagccgtggctttattgaggcagagaaaccgtaatggggtgatatccaccctgaatgatttgctagcctgtgacaaggctgtgacttccgagccgttgtcatgggaagtgcccgaggaactagcagatctatttgccatatacgcgaagagcgatgcagcacctgagaaggtttcacgtctacagtatctgctggggatcagcgactccacagctgctgctctaaaggagagggcagacactgtacccgttgctggttctgaagtcgacgattttgtattttagagaagaaaagttgagctatagtctagtgcagaggatattgtgttagtgaatactcaaataggtttatttatcaagaagataatttatttctgctgattttgcatttcagagtatgacaaaagatttaaatgatcttttttatgtttggaacacccttataatttttttgtatggtacataattttgctattgaaggttttacatctgtggttaataaa

SEQ ID NO: 586 - DNA, 593 bp, Amaranthus hybridus
atgacttgttgaacactaaaagaacttttgaatgcatttggagttccaatatttgtagaaaacaaagaattgcctctttcttcatccaaatccccacttcttatctggaattctacaaacccaaatccaatcccttcttttcttccccccaaatttatcaatttaccagtcatttcctctttaaaacgacgtcgttttcgggtttctaagctcagttgctccactaacccaatatctcaatcttcacccacacccacacccacacccgcacccgcacccgcacaggagatcacaaccacttcaactagtactagcagcaatagttctgatatatttgggcctacaagagagttatctggtatacaatcactggttgatgggttgtcacctccggtgagaatagcaacctctgtacttatagttgtggctgcttctgctgctggatatggtttgggttctcgatttgggggtacccggaatatggccattggtggcgctgttgcagttggtgttgctggtggtgttgctgcttatgggttgaattcttgtgtacctgaggttgctgccacccgtttgcataattttgtagctga

SEQ ID NO: 587 - DNA, 3324 bp, Amaranthus lividus
cacaaccccatttgtgggttgattcttcttcccagaaccctccattaaaacccccataaacccttaaaatctaactaaaaaaaccctaaaaatgagttcaacacttcctctttcttcatccaaatccccacttcttatctggaattctacaaacccaaatccaatcccttcttttcttccccccaaatttatcaatttaccagtcatttcctctttaaaacgacgtcgttttcgggtttctaagctcagttgctccactaacccgatatctcaatcctcacccacacccacacccacacccgcacccgcacccgcacaggagatcacaaccacttcaactagtactagcagcaatagttctgatatatttgggcctacaagagagttatctggtatacaatcactggttgatgggttgtcacctccagtgagaatagcaacctctgtacttatagttgtggctgcttctgctgctggatatggtttgggttctcgatttgggggtacccggaatatggccattggtggcgctgttgcagttggtgttgctggtggtgttgctgcttatgggttgaattcttgtgtacctgaggttgctgccacccgtttgcataattttgtagctgaatgtgatgacccactcaatttcaacaaggaggatattgttgctattgctaatcggtatggtgttagtaaacaagatgaggcttttactgctgagctttgtgacttgtaccttagattcatttcttcggttcttccatctggaaatgaaaatcttaagggtgatgaagttgaaacaatcattaaattcaaaaatggacttggaattgatgaccctgatgctgcaaacatgcatatagagcttgcccgtcgaattttcagacaaaggcttgaaaccggagatcgtgatggtgacattgaacagcgtcgggcatttcagaagctaatttatgtttcaacccgtgtttttggggatgcatcagcatttcttctaccctggaagcgtgtatttaaagtaactgattcccaggttgaagttgctgttcgtgacagtgctcaaagattgtatgctgagaggctgaaaccaattggcagagatttggatacaaagcagcttattgagttgagagaaacccaaatttcagttcagctctctgacgagttggccgaggagatgtttaaagagcatacaagaaagctagtagaagaatgcatttcaagggctgttgagattctgaaatcacggacgagagcagggggaactattgatgttgtgttagagcttgataaaattcttgcttttaacgatttgcttctctcactaaaaaaccatccagatgctgataaatttgcccgtggaattgcaccgatttccttagtaggaggtgagtatgatagtgataggaggattgatgacttgaagctcctttttagagcgtatgttacagatgctctatctaatggccgcatggaggacaacaagcttgctgcattgaacaagttgaagaatatatttggcctaggaaaacgtgaggcagaaggtataatgatggatgttacttcgaaggtgtatcgcaagctactatctcaggccttttctagtggtgctctggatgctgctgatagcaaagcaaattaccttcagaacttgtgtgaccagctgcattttgaccctgagaaagcaagtgagatccatgaagaaatatatcgacagaagcttcagcaatgtttagctgatggggagttgagtgaggaggatgtcaaagctttgcttcgtgtacgggttatgctctgtgttcctcaaaaggttgttgaagcagcacatgctgaaatttgtggtagtttgtttgagaaggttgtaaaggatgctattgcttccggtgttgatggttatgacgcagatgtaaaagcatctgtaaggaaagcagcacatggcttgcgtttgactagagaagctgctatgtcaattgctggcaaggcggtccgtcgaatatttatgaactttatcaaacaagcaagggcagcagggagtcgcactgaatcagcaaaaatcctcaagaagatgattgcttttaacaccttagtggtctccgaattagttgcagatatcaaaggggaatcaactgatgctccaacggaggaggaaccagcaaaagagcaagagaagcagatcgaagatgaggaagaatgggaatcgctccagacattaaggaagtcacgacctactaaggagctcgaggcaaaaatcgggaaaccagggcagactgaaattaccgtcaaagatgacctttcagacagggagagggccgacctgtacaagacatacttaatgtactgcataacaggggaagtgaccaagataccgttcggtgcacaaatcaccacaaaaaaggacaatacagagtatctgtatttgaatcagcttggtgatattctcggtctttcacgtaaagagattgtggaggttcatagaagtttggccgagcaagcttttagacagcaggccgaggtcattttggctgatgggcagttaactaaagcaaggatggagcaactggatgaggtacagaagcaagtcgggctgcctgcagaatatgctcaaaaggttagagagaacattataaattcaaagatggctgctgccattgaaactgctattggccaaggaaggctcagcataaaacaaattagagaactcaaggatgcgggtgtcaatatcgacaccatgattgcagagacccttcgggagaatctcttcaagaagactgttgatgagatattttcttccggtaccggagagttcgatgaggaggaagtctacgaaaaaattcctgcagatgtgaaaattaacccgcagaaggctaaagcagttgtccatgaacttgctcgaagcagattaacgaactcattggttcaagccgtggctttattgaggcagagaaaccgtaatggggtgatatccaccctgaatgatttgctagcctgtgacaaggctgtgacttccgagccgttgtcatgggaagtgcccgaggaactagcagatctatttgccatatacgcgaagagcgatgcagcacctgagaaggtttcacgtctacagtatctgctggggatcagcgactccacagctgctgctctaaaggagagggcagacactgtacccgttgctggttctgaagtcgacgattttgtattttagagaagaaaagttgagctatagtctagtgcagaggatattgtgttagtgaatactcaaataggtttatttatcaagaagataatttatttctgctgattttgcatttcagagtatgacaaaag

SEQ ID NO: 588 - DNA, 3413 bp, Amaranthus palmeri
ctcctctcttctccctctgcaacaaccccatctctgggttcattcttcttcccggaaccctccattaatacccccataaacccttaaaatcaaactaaataaaccctaaaaatgagttcaacacttcctctttcttcatccacatccccacttatctggaatttcgcaaacccaaatccaatcccttcttttcttccccccaaatttatcaatttaccagtcgtttcctctttaaaacgacgtcggtttcgggtttctaagctcagatgctccgctaacccaatatctcaaccctcacccacacccgcacccgcacaggagatcactaccacttcaactagtactagcaggaatagttctgatatatttgggcctacaagagagttatctggtatacaatcactggttgacgggttgtcacctccagtgagaatagcgacctctgtacttatagttgtggctgcttctgctgctgggtatggtttgggttctcgatttgggggtacccggaatatggccattggtggcgctgttgcagttggtgttgctggtggtgttgctgcttatgggttgaattcttgtgtacctgaggttgctgccacccgtttgcataattttgtagctgaatgtgatgacccacttaatttgaacaaggacgatattgttgctattgctaatcggtatggtgttagtaaacaagatgaggcttttactgctgagctttgtgacttgtaccttagattcatttcttcggttcttccatctggaaatgaagatcttaagggtgatgaagttgaaacaatcattaaattcaaaaatggacttggaattgatgaccctgatgctgcaaacatgcatatagagcttgcccgtcgaattttcagacaaaggcttgaaaccggagatcgtgatggtgacattgaacagcgtcgggcatttcagaagctaatttatgtttcaactcgtgtttttggggatgcatcagcgtttcttctaccctggaagcgtgtatttaaagtaactgattcccaggttgaagttgctgttcgtgacagtgctcaaagattgtatgctgagaggctgaaaccaattggcagagatttggatacaaatcagcttattaagttgagagaaactcaaatttcagttcagctctctgacgagttggccgaggagatgtttaaagagcatacaagaaagctagtagaagaatgcatttcaagggctgttgagattctgaaatcacggacgagagcagggggaactattgatgttgtgctagagcttgataaaattcttgcttttaacgatttgcttctctcactaaaaaaccatccagatgctgataaatttgcccgtggaattgcaccaatttccttagtaggaggtgagtatgatagtgacaggaagattgatgacttgaagctcctttttagagcgtatgttacatatgctctatctaatggccgcatggaggacaacaagcttgctgcattgaacaagttgaagaacatatttggcctaggaaatcgtgaggcagaaggtataatgatggatgttacttcgaaggtgtatcgcaagctactatctcaggcgttttctagtggtgctctggatgctgctgatagcaaagcaaattaccttcagaacttgtgtgaccagctgcattttgaccctgagaaagcaagtgagatccatgaagaaatatatcgacagaagcttcagcaatgtttagctgatggggagttgagtgaggaggatgtcaaagctttgcttcgtgtacgagttatgctctgtgttcctcaaaaggttgttgaagcagcacatgctgaaatttgtggtagtttgtttgagaaggttgtgaaggatgctattgcttccggtgttgatggttatgacgcagatgtaaaagcatctgtaaggaaagcagcacatggcttgcgtttgactagagaagctgctatgtcaattgctggcaaggcggtccgtcgaatatttatgaactttatcaaacaagcaagggcagcagggagtcgcactgaatcagcaaaaatcctcaagaagatgattgcttttaacaccttagtggtcacagaattagttgcagacatcaaaggggaatcaactgatgatccaacggaggaggaaccagcaaaagagcaagagaagcagatcgaagatgaggaagaatgggaatcgctccagacattaaggaagtcacgacctactaaggaactcgaggcgaaaatcgggaaaccagggcagactgaaattaccgtcaaagatgacctttcagacagggagagggctgacctgtacaagacatacttaatgtactgcataacaggggaagtgaccaagataccgttcggtgcacaaatcaccacaaaaaaggacaatacagagtatctgtatttgaatcagcttggtgatattctcggtcttacacgtaaagagattgtggaggttcatcgaagtttggccgagcaagcttttagacagcaggccgaggtcattttggctgatgggcagttaactaaagcaaggatggagcaactggatgaggtacagaagcaagtcgggctgcctgcagaatatgctcaaaaagttagagagaacattataaattcaaagatggctgctgccattgaaactgctattggccaaggaaggctcagcataaaacaaattagagaactcaaggatgcgggtgtcaatatcgacactatgattgcagagacccttcgggagaatctctttaagaagactgttgatgaaatattttcttccggtaccggagagttcgatgaagaggaagtctatgaaaaaattcccgcagatgtgaaaattaacccgcagaaggctaaagcagttgtccacgaacttgctcgaagcagattaacaaactcattggttcaagccgtggctttattgaggcagagaaaccgtaatggggtgatatccaccctgaatgatttgctagcctgtgacaaggctgtgacttccgagcctttgtcatgggaagtgcccgaggaactagcggatctatttgctatatacgcaaagagcgacgcagcacctgagaaggtctcacgtctacagtatctgctggggatcagcgactccacagctgctgctctaaaggagagggcagacactgtacccgttgctggttctgaagtcgacgattttgtattttagagaagaaaagttgagctatagtctagtgcagaggatattgtgttagtgaactcaaaataggtttatctatcaagaagataatttatttctgctgattttgcatttctcgtagtatcgcgttttttctatgtttggaacacccttataatttttttgtatggtacataattttgcttttgaaggttttacatctgtggttaatgaaaattttg

SEQ ID NO: 589 - DNA, 13698 bp, Amaranthus palmeri
atatatatatatataattgaaatatttatacaacaaaatatacgctaatgttcaatggattttgtacaaataatctaatctctatcatcctcttttatcctatttaattgagatcgtctttaacgactcttacgatagtaagaagcggtcatgtgacgatcgagaagataggtgactggaactgaaatggcgcaacttagaatggctttgtatcatcgtggggatatgacaactctacctcctccaaatgaacatctagaggaaaagacatgtcacaaacttaatcaatccaaaaaagggattctcgcttgcagctctaattgcccctcaagttgcaaagcaactaacatatgtaaattaaacttataacgggcatgaggtggttgtcattctaaatcctccatcgttgctaggataccttcacgtataccatacataatttataaacacattcattgtgtcacatgcttatgactacaagccataaactaagtcattaactagcacatcctcatccacacccacatcgtcctcaaaagcagcttctataaattcattactcattatcagagtctcaacatgatcgctcatctgttgctcctaattaaaccctttatgtcatttgaaagttggatttgagggtttgatgaggaatacaagaggaaaataaaacaaagggaatttgaatttcttaggttataagtagcgtaggcgtaagggaatcagtagatgaagttacatacaaaacttgatttgtttctactatattcacatttgattccttatggataccttttctgcatacatctccaaagacgaaatataagtagactttgaatgttttcatatagattctaaggtctcctcatcctcaacgggatagtcaattatccatccatcccatatttaaaaattatatttacactacatgttgtatcgatcccaatccttgaacatatatgaagttttaactcattcgaattcatattcgagttgcatagaaaagtttatatttaccaccaatatgcttaacattcctttttacttgtttaaattttaaaatgccaaaagtgtagtatagtcacaagacacgatgccattttctacataaatacatataaattcgatattagtatcaagtttttttttttattttttatcttttgttcgctgttgataatgatgaacaaaccttgtccttaggcttggattagagagtacgtttattttgaaaatacaaattttcccaagtttatcttggaaattcttgtagaaaacaatctcgaaattttaaaacaaataagcaaaaatatttaaaaaatcatattatagccaatttttgaaactatttctcaagataagttttcccagacctgaggtttgtgtctattcacactctgtaacaacgaacaaagatagagggttcaaaaaaaaaggaaaaggtttgttagctgttactaacagcgaacaaagctaaaaactggtcaaacaagaggatccgctgtttttagctcgcatctgttcgttgttattgatagcgaataaagactgaaggtaaaaaaaagtcaaagtttttgttcgcttttagttatagagaacaaactctgtgactttttttgagagacgtctatgctataaatggtctctcaagagagagcctgttatatttttgcttatttgtttcaaattttcaaacaatctcattattttcaaattggaaaatttgccaagaatgatcccagctatcacccgttggccaaaaataatcccaactatcgattattttttaataatcctaaccattcatcaaatttgctcaaaacagtcccacaccctcaattgggtgatattgtagttgctttgaatttgagcggggataatgcttctaattatgataaaagtgatgaagaagagacacatgttgcgaatcagcacacagattagaagaaattcaaatggtaccgtgaaactattttgagcaaattcgataaatagttaaaattattaataaataatcgatagttagaattattctaggtaaattttcctttcaaatttccatgttatgtcttgaagtttaaaccgggcttttgtattggaaacccaaacgacaaaagcccacaccaaaccattttttgggctactacactattggctacagtctctttcagtctatcatcaaatacaaaacagcaagaaaagaaccctctctttctcgcacaccattatcgtcttcctctcctctcttctccctctgcaacaaccccatctctgggttcattcttcttcccggaaccctccattaacacccccataaaccctttaaatcaaactaaataaaccctaaaaatgagttcaacacttcctctttcttcatccacatccccacttatctggaattccgcaaacccaaatccaatcccttcttttcttccccccaaatttatcaatttaccagtcgtttcctctttaaaacgacgtcggtttcgggtttctaagctcagatgctccgctaacccaatatctcaaccctcacccacacccgcacccgcacaggagatcactaccacttcaactagtactagcaggaatagttctgatatatttgggcctacaagagaattatctggtatacaatcgctggttgacgggttgtcacctccggtgagaatagcaacctctgtacttatagtcgtggctgcttctgctgctgggtatggtttgggttctcgatttgggggtacccggaatatagccattggtggcgctgttgcagctggtgttgctggtggtgttgctgcttatgggttgaattcttgtgtacctgaggttgctgccacccgtttgcataattttgtagctgaatgtgatgacccacttaatttgaacaaggacgacattgttgctattgctaatcggtatttgttattgtatttggttgtttttgtttacaattattgttgggaggagtattgaagttatatgtttgaatttatgctttttcaggtatggtgttagtaaacaagatgaggcttttactgctgagctttgtgacttgtaccttaggtgagtgtgatttgacctaatgagttattttagaatgctaatggtttgtttcttgttaattttgacatattgtggtggctggtggacatgttttatagtattgttttgtaatcgtttgtgcctcttaatttgctacatagtggaaccagtgtgggagctttttcgtacgaatgtagcaaaataagagggacatatgacaatggttgaagtttttcttgtattatactgcccattcatcctaatttaattgttttgcccctccaatatagtgtggaggtagttgacatggagaagaagagaaagagaaaaggtggagatgagggtaggggcgatttctcacagtatatttccattgagattgctccatttacatgaaaatatgtaagaccttttttgtggttcaaggagcaaatccttaatgatgggcatgtacttaagaaagtattgaatgcgaagaggatatatcaatgttggatgtagcaaaatccaaacactactatgataaaaattcatataggattttgggatttggttagaaagttgtctaattttctatgtaatggtattggatttagtatgaatgatgatacctctaccgcgagggagatgaggtggggggaggctactaataggggttagtttagttgatttcgtgaaatctttgaatattatgagataggagttggcagtggcacacttatttttggacgtgaacttgaacatactcttgttagctatatttttggacataaatgtaatgtattaagtcggagatataaaaggaaaatatagcaaattatgaggcacggaggaactacttgatagttcatagtccataccgccatccagaaataaaataaccatatcttgatgttgtctttagtaattgttgttcctagggggccattgattcattgtctgatgttcttttcaattttttgtatagattcatttcttcggttcttccatctggaaatgaagatcttaagggtgatgaagttgaaacaatcattaaattcaaaaatggacttggaattgatgaccctgatgctgcaaacatgcatatagaggtattgtggtgtttgtattttaacttatatcagtttgttttgtcaatatatatttctacttttatggcaattagtaatgtcaatattgaattttgtatttttggctgtagcttgcccgtcgaattttcagacaaaggcttgaaaccggagatcgtgatggtgacattgaacagcgtcgggtgagattcttgtatttatgtgattattgtcatgcaatcaaagtttgttgatggagatttgtagcttgaccaattttggtgagtttcagcgcaggcatttcagaagctaatttatgtttcaactcgtgtttttggggatgcatcagcgtttcttctaccctggaagcgtgtatttaaagtaactgattcccaggtaggtaactgtcagtacgctgatttctagttcttttgattttggcaaacattcttccatccattatgagtttagaatccctaaaaccgatctctgccaagccatctgatgtttaaaaatgctataattttatatgtatacctctagattcatcatgaatcctacaagtaccttcttaataaactgacattaccagtatttcagtgtttgtataccacattcaaatttgaccaagtactttgaaagggaggaaattcaagtatagattgaggattcatattataatgtttctttgttaggttgaagttgctgttcgtgacagtgctcaaagattgtatgctgagaggctgaaaccaattggcagaggttagtatccacttgcagcgcattgttgtggtgaaagttaatgatttgtatttttcctaaggtgattaattgagtcacaaactcattgatttgaatgatattagtgttggtaaggaagcacttatggggtgttcgttttttgatgtgtgggattggaattgaaaattgggataatagagattaaggggtacgaataagacagggaattatttgttggtatttgatctaagagtctccatcccatgttttgatttagttggaataaggtagtgactaactaatatgtcactactttacacgtaatatactcgcaaaagttaagggagtacatacacgacctataatactaaataagtaatgattcttgggattgtaggggttgtaatccccatatgaccactcaaacccaagactcagtttcatcttttgctcacaagcgtagacacaaactaatgtttgaaatgtaatatgcatattatgcaatcacacataccaaatgctgtgctatgcttggtattcgactacaaaatatttaattttttttttgcttacttccctaatgtttgtttgcggatgtagttagttataattacattatgtcttatcccttgtttgttggtgtattgtattatgttttcatgtttagatttggatacaaatcagcttattaagttgagagaaactcaaatttcagttcagctctctgacgaggtattttcttcgtgacattgaatggtatcttatattggaaataagtaatagttttttattttgaactaaatttatgtcttacagttggccgaggagatgtttaaagagcatacaagaaagctagtagaagaatgcatttcaagggctgttgagattctgaaatcacggacgagagctgggtatgttcaatggcttatgcagtaatcttcatcttaaggaactggaagacagttttttttgcttttgcattaagaaaaatatattttttttgaaaagctttatatcttgtgcttttcttggtttagttttagggtatgcggtttggattatctgtccttttatgctcattctctcacatatatatgtttgacaggggaactattgatgttgtgctagagcttgataaaattattgcttttaacgatttgcttctctcactaaaaaaccatccggatgctgataaatttgcccgtggaattgcaccaatttccttagtaggtaatattactatctttactagttgtcattgactttatatgagcgggcatccgggactagaatttcacattcatagttcaatataatttgtatcatttcaggaggtgagtatgatagtgacaggaagattgatgacctgaagctcctttttagagcgtatgttacatatgctctatctaatggccgcatggaggacaacaaggtgacaagatttctcctttaaccgattcatgttatcattatctgcttactttgtgattcactattactccatttgacatattattgtggtcagctgtggtttgtgtcatgaggacatatttaggaatttataattttgtttcacctaattggggagttagagcaccttgtaatgcatcatggacccaggtttatgggattactcaattcatttattctagggtaatggaaggatatgtttgacttttcgatcctcttttttattttttttgttcctgctttctctcaaatatggggataggcctagactttttcactaactttgttttttttttttaacttgttttgtagtgttctacaatgatattgttgatattatgtatttctgaatcttccattcactcaatcattgttgacgtgttctaattaagattagtctccattttttcatatcccatgctaattaatgtttctataaactctaattttatttgtagcttgctgcattgaacaagttgaagaacatatttggcctaggaaatcgtgaggcagaaggtataatgatggatgttacttcgaaggtgtatcgcaagctactatctcaggcgttttctagtggtgctctggatgctgctgatagcaaagcaaattaccttcagaacttgtgtgaccagctgcattttgaccctgagaaagcaagtgagatccatgaaggtactgctccctcctacttcttgattgtttatggtcaggagctattgacttaagaggggattttgtggcctttctatactgtatcctcaatcctctttgtattgatattgtgaccttacaataatatagcctcatggagcaaggcttcagttgcacaagcctaaggaggaaccttttagatcttaagctagatcaaattttacacctttttttggtgaagggtagaatctgattttcaattatgactccctcatatattttagatatcacaataactaaaaacagtggtgattttaattttttttggtacttgattgggagcattttcagttttttactgtattaatcaagtgtttttggacattgtcataagctggatcatcttttgtatatcatatatatttatgatactcttcgttaaatttatagctcgcctgttgctttttttcttcttatttttaacatgttttctcttatagaaatatatcgacagaagcttcagcaatgtttagctgatggggaattgagtgaggaggatgtcaaagctttgcttcgtgtacgagttatgctctgtgttcctcaaaaggttgttgaagcagcacatgctgaaatttgtggtagtttgtttgagaaggtatgtgtttggaacttttaagcttccctccattctttttctcatcttcctcaatgatcatttgctaaaaatacaatgttatatctctatttgtttaagaaaaaattgtacgttctgctgaatatctagcttacaaagccgagaaatattcgtgctggccaactatatttatgatttcttttgaatttctttcctaccttgtcgtttcctctcttttgcttagtaaatcagttgacccgttacctatttctaattaaattatttttaaagtcaggtcaagtcgggttcggttctaaggtcgggtaaattatagggtcatcgagtctgttttgaacacttctaaaaatttgtttcctactgcttttctatgttttatgtatccccctgcctcggtgtcgggttgcattgagctgatacaaaatggtatattttttatttcaggttgtgaaggatgctattgcttccggtgttgatggttatgacgcagatgtaaaagcatctgtaaggaaagccgcacatggcttgcgtttgacaagagaagctgctatgtcaattgctggcaaggcggtgagtgtcaattttcctgtgatatttatcagttactttatattcttctgtataagatattctccataaataactttatcctcgaaatttccaagatttgatttttgaatgcagatgggacttcattctgtgatcccaacctcattcaccttctgctgatagatcccggtactgaattggttactaatggatcattccttacgtcttgcaggtccgtcgaatatttatgaactttatcaaacaagcaagggcagcagggagtcgcactgaatcagcaaaaatcctcaagaagatgattgcttttaacaccttagtggtcaccgaattagttgcagacatcaaaggggaatcaactgatgctccaacggaggaggaaccagcaaaagagcaagagaagcagatcgaagatgaggaagaatgggaatcgctccagacattaaggaagtcacgacctactaaggaactcgaggcgaaaatcgggaaaccagggcagactgaaattaccgtcaaagatgacctttcagacagggagagggctgacctgtacaagacatacttaatgtactgcataacaggggaagtgaccaagataccgttcggtgcacaaatcaccacaaaaaaggacaatacagagtatctgtatttgaatcagcttggtgatattctcggtcttacacgtaaagagattgtggaggttcatcgaagtttggccgagcaagcttttagacagcaggccgaggtcattttggctgatgggcagttaactaaagcaaggatggagcaactggatgaggtacagaagcaagtcgggctgcctgcagaatatgctcaaaaagttagagagaacattataaattcaaagatggctgctgccattgaaactgctattggccaaggaaggctcagcataaaacaaattagagaactcaaggatgcgggtgtcaatatcgacactatgattgcagagacccttcgggagaatctctttaagaagactgttgatgaaatattttcttccggtaccggagagttcgatgaagaggaagtctatgaaaaaattcccgcagatgtgaaaattaacccgcagaaggctaaagcagttgtccacgaacttgctcgaagcagattaacaaactcattggttcaagccgtggctttattgaggcagagaaaccgtaatggggtggtaagcttctgatggctgtaaaatatctttaagtttcatttacggcccgtttggtcattctcatggtgatgaaaaattgatcatcaaaatgtttatttattcacaaagatttttgaagcaaaacaagtaaaacaagtaaggccgttaaaattgtcacaagatttttgtgaagaaaataagatatttgaagcaatggaatgaattttgtgaagaaaataagatatttgaagcaaaacaagtaaggccgttaaaattgtcacaagatttttccatcaaaattacactaactttttaggactattcccactatttaataccaattaccaattgggctgttagatttttgccatttaacactgatttcttttgtacccgactttaatcttttgagattaaggctatgacatagttgttgtaacagtaatttcttttgcttcatttttgcagatatccaccctgaatgatttgctagcctgtgacaaggctgtgacttccgagcctttgtcatgggaagtgcccgaggaactagcagatttatttgccatatacgcgaagagcgacgcagcacctgagaaggtctcacgtctacagtatctgctggggatcagcgactccacagctgctgctctgaaggagagggcagacactgtacccgttgctggttctgaagtcgacgattttgtattttagagaagaaaagttgagctatagtctagtgcagaggatattgtgttagtgaactcaaaataggtttatctatcaagaagataatttatttgtgctgattttgcatttctcgtagtatcgcgttttttctatgtttggaacacccttataatttttttgtatggtacataattttgctaatgaaggttttacatctgtggttaatgaaaattttgtttttgcattagtctcttagcatcttttggtacattggaactggaagtacattataggatctattcatgaccttgctgatacctccctcttcatgaatttgaatttgacttaattttcattatgatccgtcttttttttattattttaaattattttcatattaggttatcatctcacattctcttcgaatctcatccacaaaaccgatttttttaatttcgtttaacatattttgtcttttgaatgggtttatttttcttttcttttaaatttcttggcttgagttgagccttccttgtacgatgttttacaaagcatgaaggagaccttcttgactattttcttttggtgattgtacttatagcgaaaaaaactccataattttggaaaataacttttcctaatgcttattttaagattttttttgaataattttgcttaattgttcaaattttcaagatgggtttagttttagcatttatacaatgtgttaaagccatctccatgtctcaaacattttccttcataactttttacaaagaaaccaaatggatattacatttggatatatacactttgaatttttattgaatatatatctatccatttttacttattatgaagaatatcttattgaatattaatgcaagtaaatatttgctgatgtgttgaatattaacatttttacccttaaaaattttggtgggcaataaaataaatctgatgttaacacgtgtcatggaaattaacaacttgtaatatgaatgactaaagtaaaacaagattaaacataattcatgaactttatcgagtaaattttccaactgggttacatcaatattcatcatttcaattcctacaatttagtaccgataaccaaacggatatcgggaacactcaaaagctcctaaaaagcaaaagggttatccagagaaggttctgaagtttggggaggatgcaaacagaagctctgaacttctgacctttctgtagcaattgactaacctcaccatattccccactacaacaatgttcacacttacaatcctccacttttcttacatacatcaacgaaattatccactaaaccatattaattagtgcttaatctaaccttaatgtcaaacatttagcaagttatccactaaaccagattaattagtgcgggagcaggtctgctctaggcttttgccaatttccctgttgaaatctgtatttttgaccaaaatagaaagctgtgagttagttataacgtaatagtaatcctatatataggaaactgatatttgctgatctgataagaagagaaacaagcttgtatacattcctgttttagactgttattatgggtattaagctgctgaagctaagaattttactggttctgtttcttataggaacaacttacgcacagctttcggcgaattattatacaaagacatgtccaagagctctctcgacaatccgagctgcggtgcataaagctgtagctgctgagaagcgtatgggggcatctttgctccgactccacttccatgactgctttgtcaatgtacgtttattccttaatatgtcttaagaaagttcatgttagtgtgtggtagtgttgatttctgatacttgtttttgtttgcgtaggggtgtgatgcatccattcttttaaatgacacctcaacgtttaccggagagcaaactgctggcgcgaatgcagggtctctgaggggatttaccgttgtcgatgatattaaatctcaagtcgagaatgtttgtcctggtgttgtttcttgtgctgatattcttgctgtggcagcaagggattctgttgttttggtaagtcgagctattacagagatttttcaatttttgatcagctgaggttaaaaaatgctaagcgtatctcgtttttgattctgcagttgggtggccctttttggcaagtgcagctgggtaggagagattctactacagctagtttaagcactgcgaattccgacattccatccccaaacgccgacctaagtggccttctatcttccttctcgaaaaaaggactaactgaaaaagaaatggtggttttatcaggtaagtataatacctgatcttttgccttactattagtatccatcagctatttgatagtggagaattaagattgtgtttactatgcaggagcacatacaattgggcaagcgagatgtgtagtattccgcaccagagtttacaacgagagcaacatcgatgcatcatttgtgggttccttgaaatccaactgcccaagtaatggaggcgacaacaatctcagcccactcgactccaccagccctactgtctttgacaatgggtatttcaaagacctggtaaacaacaaaggtctgatgcactccgatcagcagcttttcaatggcggatcaactgattcacaggtcacatcttacagcaaagattactcatccttccgttcggactttgcaagcgctatggtgaaaatgggtaacctgagtcccctcaccggaacaaacggagaaatcagaaccagctgctggaaaacaaactaatccatagaccctctatatatcgtcccataccttccgctcttagaatcaagttaagacatcaaggtgcaggatatataatctatactccatgttttgtatcagttgttttggatcttgtaggcactaaccaaagccttctgatccttgtcttccctttgcaagatattgccaaaatgttaaaaattattgatatattaaataatatacagcctatccacagttgtattgtaaaatttgagccaatataggcttgaactttaatctttaatgctactattgtagttgtagcctgcttggactatttgattgtaatcaacatgtcaatactccaatgtccaaagtctccaatctaggagacattgacaatcttaccttgtaataacaaagaggttgttcttgattgcaaacatcacataaataagaagcgcaaatgttttagtaaggcattttactaaaaaatcatccgagacatttaataatctttatcaattagtaaaaaatggcaagagcctagtaagaattgagctgattaaccaaatgatacaatttcagaaagttcaaactgtatatgtgacatgttttatcacttgaaactgtaggagttagaagatggataaagaattggactaaaataagtaattcaattagctccaaatgcaccagcctgaatcagagtttagtagccccactaattaacatttttactaacaccataaaaatgatacatggtccggttaatcacttcaattgcagcaagcattttctttcttcctcatacttagatacctgatgcatcctttatttccctgtctgttattttgacactccgactcatcctctgttgaatgtctgatc

SEQ ID NO: 590 - DNA, 2942 bp, Amaranthus rudis
cattggtggcgctgttgcagttggtgttgctggtggtgttgctgcttatgggttgaattcttgtgtacctgaggttgctgctacccgtttgcataattttgtagctgaatgtgatgacccacttaatttgaacaaggacgaaattgttgctattgctaatcggtatggtgttagtaaacaagatgaggcttttactgctgagctttgtgatttgtaccttagattcatttcttcagtacttccatctggaaatgaagatcttaagggtgatgaagttgaaacaatcattaaattcaaaaatggacttggaattgatgaccctgatgctgcaaacatgcatatagagcttgcccgtcgaatttttagacaaaggcttgaaaccggagatcgtgatggtaacattgaacagcgtcgggcatttcagaagctaatttatgtttcaacacgtgtttttggggaggcatcaacatttcttctaccctggaagcgtgtatttaaagtaactgattctcaggttgaagttgctgttcgtgacaatgctcaaaggttgtatgctgagaggctgaaaccaattggcagagatttggatacaaagcagcttattgagctgagagaaactcaaatttcagttcagctctctgacgagttggccgaggagatgtttaaagagcatacaagaaagctagtagaagaatgcatttcaagagctgttgagattctaaaatcacggacgagagcagggggaactattgatgttgtgttagagcttgataaaattcttgcttttaacgatgtgcttctctcactaaaaaaccatccagatgctgataaatttgcccgtggaatcgcaccaatttccttagtaggaggtgagtatgatagtgacaggaggattgatgacttgaagctcctttatagagcatatattacagatgctctatctaatggccgcatggaggacaacaagcttgctgcattgaacaagttgaagaacatatttggcctaggaaaacgtgaggcagaaggtataatgatggatgttacctcgaaggtgtatcgcaagctactatctcaggcgttttctagtggtgctctggatgctgcagatagcaaagcaagttaccttcagaatttgtgtgaccagctgcattttgaccctgagaaagcaagtgagatccatgaagaaatatatcgacagaagcttcagcaatgtttagctgatggggaattgagtgaggaggatgtcaaagctttgcttcgtgtacgagttatgctctgtgttcctcaaaaggttgttgaagcagcacatgctgaaatttgtggtagtttgtttgagaaggttgtaaaggatgctattgcttccggtgttgatggttatgatgcagatgtaaaagcatctgtaaggaaagcagcacatggcttgcgtttgactaaggaagctgctatgtcaattgctggcaaagcggtccgtcgaatatttatgaactttatcaaacaagctcgggcagcagggagtcgcactgaatcagcaaaaattctcaagaagatgattgcttttaacaccttagtggtcacagaattagttgcagacatcaaaggggaatcaactgatgctccaacagaggaggaacctgcaaaagagcaagagaagcagatcgaagacgaggaagaatgggagtcgctccagacattacggaagtcacgacctactaaggaactcgaggcgaaaattgggaaacccggcagactgaaattaccgtcaaagatgacctttcagacagggagagggctgacctgtacaagacatacttaatgtactgcataacaggggaagtgaccaagataccattcggtgcacaaatcaccacaaaaaaggacaacacagagtatctctatttgaatcagcttggtgatattcttggtctttcacgtaaagagattgtggaggttcatagaagtttggccgagcaagcttttagacagcaggccgaggtcattttagccgatgggcagttaactaaagcacggatggagcaactcgatgaggtacagaagcaagtcgggctgcctgcagaatatgctcaaaaggttagagagaacattataaattcaaagatggctgctgccattgaaactgctatcggccagggaaggctcagcataaaacaaatcagagaactcaaggatgcgggtgtcaatatcgacaccatgattgcggagacccttcgggagaatctcttcaagaagactgttgatgagatattttcttccggtaccggagagttcgatgaggaggaagtctacgaaaaaattcccgcagatgtgaaaattaacccacagaaggctaaagcagttgtccatgaacttgctcgaagcagattaacgaactcattggttcaagccgtggctttattgaggcagagaaaccgtactggggtgatatccaccctgaatgatctgctagcctgtgacaaggctgtgacttccgagccgttgtcatgggaagtgcccgaggaactagcagatctatttgccatatacgtgaagagcgacgcagcacctgagaaggtctcacgtctacagtatctgctggggatcagtgactccacggctgctgctctaaaggagagggcagacactgtacccgttactggttctgaagtcgacgattttgtattttagagaagaaaagttgagctatagtctagtgcagaggatattgtgttagtgaatactcaaataggtttatctatcaagaacataatttatttctgctgattttgcattttgagtacgacaaaagatttaaatgagatagatacccgagttcgtataacgtcttttctatgttcgggagacacccttattattttttttgtatggtacataaattttgctattgaaggttttacatctgtggttaataaaaattttgtttttgc

SEQ ID NO: 591 - DNA, 730 bp, Amaranthus rudis
gcaactcgaagcagcatttcgcctcgcacaacatcccacaaagtacactattgacaaaacaaagaaaaggatcacattgaatatcgcaaccaccctccactcggttttcatgtactgagcaactcctgccttgcaggaatcacaattgtagcacttaatggtcctcgctttctcgcacaccattatcgtcttcctctcctctccctctgcaacaaccccatttctgggttcattcttcttcccaaaaccctccattaaagcccccataaacccttaaaatcaaactaaaaaaccctaaaatgagttcaacacttcctctttcttcttccaaatccccacttcttatctgtaattccacaaacccaaatccaaccccttctttttttccccccaaatttatcaatttaccagtcatttcctccttaaaacgacgtcgttttcgggtttctaagctcagatgctccactaacccaatatctcaaccctatcccacacccgcacccgcacccgcacccgcacccacacaggagatcacaaccacttcaactagcactaccagcaatagttctgatatatttgggcctacaagagaattatctggtatacaatcactggttgacggtttgtcacctccagtgagaatagcaacctctgtacttctagttgtggctgcttcagctgctgggtatggattgggttctcgatttgggggctcccggccgtaatggcc

SEQ ID NO: 592 - DNA, 226 bp, Amaranthus rudis
acaaaagcccacaccaaatcatattttgggccgctccactattggctacagtctctttcagtctatcatcaaatacaaaacagcaagaaaagaaccctctctttctcgcacaccattatcgtcttcctctcctctccctctgcaacaaccccatttctgggttcattcttcttcccaaaaccctccattaaagcccccataaacccttaaaaatcaaactaaaaaa

SEQ ID NO: 593 - DNA, 1280 bp, Amaranthus rudis
ttttttatttcaggttgtaaaggatgctattgcttccggtgttgatggttatgatgcagatgtaaaagcatctgtaaggaaagcagcacatggcttgcgtttgactaaggaagctgctatgtcaattgctggcaaggcggtgagtgtcgattcttgtttgatatttttatcaattattttttttcttctgtgaaagatattctccataaataactttatcctcgaaattgccaagatttgatttttgaatgcagatgggacttcattctgtgatcccaacctcattcaccttctgctgaatactgaattggttactaatggatcattccttacgtcttgcaggtccgtcgaatatttatgaactttatcaaacaagctcgggcagcagggagtcgcactgaatcagcaaaaattctcaagaagatgattgcttttaacaccttagtggtcacagaattagttgcagacatcaaaggggaatcaactgatgctccaacagaggaggaacctgcaaaagagcaagagaagcagatcgaagacgaggaagaatgggagtcgctccagacattacggaagtcacgacctactaaggaactcgaggcgaaaattgggaaacccggccagactgaaattaccgtcaaagatgacctttcagacagggagagggctgacctgtacaagacatacttaatgtactgcataacaggggaagtgaccaagataccattcggtgcacaaatcaccacaaaaaaggacaacacagagtatctctatttgaatcagcttggtgatattcttggtctttcacgtaaagagattgtggaggttcatagaagtttggccgagcaagcttttagacagcaggccgaggtcattttagccgatgggcagttaactaaagcacggatggagcaactcgatgaggtacagaagcaagtcgggctgcctgcagaatatgctcaaaaggttagagagaacattataaattcaaagatggctgctgccattgaaactgctatcggccagggaaggctcagcataaaacaaatcagagaactcaaggatgcgggtgtcaatatcgacaccatgattgcggagacccttcgggagaatctcttcaagaagactgttgatgagatattttcttccggtaccggagagttcgatgaggaggaagtctacgaaaaaattcccgcagatgtgaaaattaacccacagaaggctaaagcagttgtccatgaacttgctcgaagcagattaacgaactcattggttcaagc

SEQ ID NO: 594 - DNA, 1810 bp, Amaranthus rudis
acggttactgcttgacacgctcaagtcgaaagcggcacaattgcgtgagggagaactgatagttggaaaaaaaaatgcacggaaggaaacgggtaaatgccaaaagaaactgccggtatttataatactagtaattagggttagggttaaattttatcttagtgggtttttaaaaatagcaaattagttagatttagattgaattctaattataaaaatagtaaattagttaggccttaggaattaggctaatttatcttgattggttattaaaaatagtaaattagtgagacccaatatttagttttaccaactaactcaaataatccgatttttataatattaaatccaattaaatattattataatttattattattatttctatcttaaaataatttgttcccaaaatttcgtaatgttacatataatagggaaattatcaatggtatccctatattttggcactttatcaatggtacccccaagttttttttatatcaacggtatcctcgtattattgagcgttttacaaccgtaaccttttttagctttttccgtcaaaaatccttcaaaaccgttaactttcatttatgttttgaattgaaaaataaaagaaaaagaaaaaaacttaatggttttgatcgaaattggacggaaaaattttagaaaggttacggttgtaaaacgctcaatagtacgaaggtaccattgataataaaaaaaacctgggagtatcattgataaaatgtcaaaactcaggggtaccattgataatttctctatatagtagtatatcacatctatatagtagtatatcacatttttgggcttcaattatcagctttatatatataacataattccgggatctttaagccgatggttgaagcccaaaatacattaggagagatgtgtagatgcaattcatgtcctccatatatgatgctaaatattccccttgaaacgaaaggtgaatcttatcacgttgactttctgatacacttacattttcacgtgattctatttggtaggatgtcaagaaaaaaaatgcacaaaatccacaaacatacttgtcccttcgctttaaataggaaaacaactgaagaccaagtacataagatagctcgtaaaatactcttttgtcctactcagttagcaacattttggatttctgagagtttaacttaaatgttgcaacgactgggacataggagtagaagtgatgatacatataaactaagtatttgaattcttaaactcatgcattagtgatttactcaaagttcttttcaatcaaaaaagttccacatgctttaaatgaccataattacagggtcatagcaaattatacatcaaattaaaggaattctacaatccaagctcttcttcaacagcctacaaaataaagagcttgattgtgttctatttcgatcctcgacaaatcaccgccattttcatcgaccttttgagcaactcgaagcagcatttcgcctcgcacaacatcccacaaagtacactattgactgatgcaaaaagaaaaaccgaaagatttatactcgcacgtataatgttagataacgggcactaacagtatttcatttcttttctaatatcacgatttataaacattcttagagaaccagaacatgtctatcatgaatggttcgagtatcttaccaaaacaaagaaaaggatcacattgaatatcgcaaccaccctccactcggttttcatgtattgagcaactcctgccctgaagaagattcaggcaagtccacactaattaaccgagggaaagaaaagaatc

SEQ ID NO: 595 - DNA, 963 bp, Amaranthus rudis
cccacaaagtacactattgactgatacaaaaagaatcgaaagatttatactcgcacgcattatgttagataacgggtagcatttcatttcttttctaatatcacgatttataaacatccttagagaaccagaacatgtttatcatgaatggtttcgagtatcttaccaaaacaaagaaaaggatcacattgaatatcgcaaccaccctccactcggttttcatgtactgagcaactcctgccctgaggaagattcaggcaagtccacactcattaaccgagggcaagaaaagaatcgttttacgaaaaaagtatacttctagaagaaaaaaaaaacgtacttgcaggaatcacaattgtagcacttaatggtcctcgcattcttgtacagcttgcagtctttgttcgaactggccgggcgatagctcaaatcataataggatgccttgacagcagggtatccacacctacgcaacggattaattacgggttacaataagctttgccatgccaaggtcacagtcaacgacattccagcaaatcccatgtgtactaactgtggcgaagccacatggggggctggcggcccccatggcccaccctcgcggtccactcttgtggactatttttttagttcaacccctgcacaatttttgattgtaatctgctactctgctagtaatgtcacacgagttgtagagagttggtggtttaagtaaaggaagccttaatattagtcctagcaaaagctgatccgacctgctaacccgtcttgaacctcttgccccatgctatattaacttaatatagcatggggaaagaggttcaagttttgtggcaacaatttataatgttttgtttttactatagttgtcaatgtaaataagtctaaaactcaaatatgttcggtatatcacaagacacatttagaagttttgttcatagtaattttacatcacttatt

SEQ ID NO: 596 - DNA, 525 bp, Amaranthus rudis
tttgctattggattataaaatatttaaaaactttttgcttaattacctaatgtttatgtttggggatatagttagttataattgcattatgtcttatcccttgtttgttgatgtattgtattatgttttcatgttcagatttggatacaaagcagcttattgagttgagagaaactcaaatttcaattcagctctctgacgaggtatattctttgtgacattgaatggtatcttatattggaaatacgtgatagtttttcatgttgaactaaatttatgtcttacagttggccgaggagatgtttaaggagcatacaagaaagctagtagaagaatgcatttcaagagctgttgtgattctgaaatcacggacgagagcagggtatgttcaatggcttatgcagtaatattcatcttaaggaattggaggagtttttttttgcttttgctttgagaataatatatatttttgaaaagctttatatcttgtgccttccttggtttagttttagggtatgaggcttg

SEQ ID NO: 597 - DNA, 1294 bp, Amaranthus rudis
tttgttttgtcaatatgtatttctaattttatggcagttagtattgtcaatattgaattttgtatttttgactgtagcttgcccgtcgaatttttagacaaaggcttgaaaccggagatcgtgatggtgacattgaacagcgtcgggtgagattcttgtatttatgtgatttatatcctgcaatccaaagtttgttgggtgattgtaatggagatttgtagcttgaccaattttggtgagtttcagcgcaggcatttcagaagctaatttatgtttcaacacgtgtttttggggaggcatcaacatttcttctaccctggaagcgtgtatttaaagtaactgattctcaggtaggtaactgtcagtacattagttccacgatgtgattttgacgggcattcttccacccattatgagtttagaacccctaaaaccgatttctgccaagccatctgatgtttaaaaatgctataattttatacgtacacctctagattcatcatgtatcctacaagtaccttcttaaaaaactgacattacctgtatttcagtgtttgtttaccacattcaattttgaccaagtactttgaaagggaggaaattcaagtatagattgaggattcatattgtggtgtctctttgttaggttgaagttgctgttcgtgacaatgctcaaaggttgtatgctgagaggctgaaaccaattggcagaggttagtatctgcttgcagtgcattgatgtggcgaaagtttatgatttatgtttttcctaaggtgattaactgtgtcaaaaactcattgatttgaatgatatcagtgttggtaaggaagcacttatggggtgtttggtttttgtgtgtaggattgaaagtgaaatttgggataatagagattaaagggtaggaataagatggggaaattagttgttggggttcatctaaaagtctccattccatgtttgcatttagttgaaataacgtagggactaactaatatgtcactactttacacacaatatactcgcaaaagctaagggagaacatatgcgacctataatactagctcctctgtaatgattcttgggattgtagggggtttagtctgcatatgatcactcaaaaccaagatgcaatgccatcttttgctcacaagtgtgggcctgcttggccacaaacttaagttgaaaatgtaaattgcaattccacataccaaatgctgtgctatggttgctattcgattataaaatattttaaaactttttgcttaattacctaatgtttatgtttggggatat

SEQ ID NO: 598 - DNA, 423 bp, Amaranthus rudis
attttgtgaaatctttgaatattatgagttaggagttgacagtggcacacgtatttttggacgtgaactagaacatactataatgaattaagtgggagattaataaaaggaaaatacagcaaattgtgaggcacagaggaactaattcatagttcatagtccataccacaatccagaaataaatcaagcatatcttgatgttgtctttagtaattgttgttccaaaggggcctttgattcattgcctgatgttcttttcaattctttgtatagattcatttcttcagtacttccatctggaaatgaagatcttaagggtgatgaagttgaaacaatcattaaattcaaaaaaggacttggaattgatgaccctgatgctgcaaacatgcatatagaggtattgtggtgttagtatttcaactt

SEQ ID NO: 599 - DNA, 258 bp, Amaranthus rudis
tgtttacaattattgttgggaggagcattaagatttcatgtttgaatctgtgcctttttcaggtatggtgttagtaaacaagatgaggcttttactgctgagatttgtgacttgtaccttaggtgagtgtaatttgacttaatgagttattttagaatgttattatggtttgtttcgtgttaatttttgacatattgtggtgctggtggacatgtttcatagtattactttaaaatcgtttgtgcctcttaatttgct

SEQ ID NO: 600 - DNA, 546 bp, Amaranthus rudis
actgatttcttttgcttcatttttgcagatatccaccctgaatgatctgctagcctgtgacaaggctgtgacttccgagccgttgtcatgggaagtgcccgaggaactagcagatctatttgccatatacgtgaagagcgacgcagcacctgagaaggtctcacgtctacagtatctgctggggatcagtgactccacggctgctgctctaaaggagagggcagacactgtacccgttactggttctgaagtcgacgattttgtattttagagaagaaaagttgagctatagtctagtgcagaggatattgtgttagtgaatactcaaataggtttatctatcaagaacatactttatttctgctgattttgcattttgagtacgaccaaagatttaaatgagatagatacctgagattgtatcgcgattcgcgtcttttatatgtttgggacaaccttataatttttttgtatggtacataattttgcttttattgaaggttttacatctgtggttaataaaaatattgtttttgcattagtctc

SEQ ID NO: 601 - DNA, 368 bp, Amaranthus rudis
gttataattacattatgtcttatcttttgtttgttggtgtattgtattatgttttcatgttcagatttggatacaaagcagcttattgagctgagagaaactcaaatttcaattcagctctctgacgaggtattttctttgtgacattgaatggtatcttatattggaaataagtaatagtttttttattttgaactaaatttatgtttacagttggccgaggagatgtttaaagagcatacaagaaagctagtagaagaatgcatttcaagagctgttgagattctaaaatcacggacgagagcagggtatgttaaatggctcatgcagtaatcttcaacttaaggaactggaagatagtttttttt

SEQ ID NO: 602 - DNA, 2328 bp, Amaranthus rudis
tttgaaaagctttatctcgtgttttccttggtttagttttagggtatgaggtttggattatctgtccttttatgctcatttctctcacatatatatatgtttgacaggggaactattgatgttgtgttagagcttgataaaattcttgcttttaacgatgtgcttctctcactaaaaaaccatccagatgctgataaatttgcccgtggaattgcaccaatttccttagtaggtaatattactatcttgctactagttgtcattgactttacatgagcgggcatccaggactagaatttcacattcatagttcaatatattttgtatcatttcaggaggtgagtatgatagtgacaggaggattgatgacttgaagctcctttatagagcatatattacagatgctctatctaatggccgcatggaggacaacaaggtgacaagattcctcctttaaccgattcatgttatcattatctgcttagtttgtgattcactagtttgtgattcactattactccattggacatagtattgtaatcagctatggtctgtgtcttggggacatatttaggaattcatgattttgcttctacctaattgtggagttagagcaccttgtaatgcatcatggacccaggtttatgggattactcaattcatttattttagggtaatgtaaggatatgtttgacttttcgatcctcttttattttttttgttcctgctttctcttaaatatggggataggtgaaattgatagatacctagacttttcactaactttgtttatttaacttgtttattagtgttctacaaagtattgttgatattacgtattcctgaatcttccattcactgaatcactgttgacgtgttctaattaagattagtctccatttttccatagcccatgctaatcaatgtttctataaattctaattttatttgtagcttgctgcattgaacaagttgaagaacatatttggcctaggaaaacgtgaggcagaaggtataatgatggatgttacctcgaaggtgtatcgcaagctactatctcaggcgttttctagtggtgctctggatgctgcagatagcaaagcaagttaccttcagaatttgtgtgaccagctgcattttgaccctgagaaagcaagtgagatccatgaaggtactgctccctactacttcttgattgtttatggtcagaagctattgacataacaggggatgttttggcctttctatactgtatcctcaatcctcatggcattgatattgtggccttacaatactctagcctcataaaacaaggctttgcttgcacacaagcctaaagaacctttttgatcttaacctagatctaattttacacctttttggtggagggtagaagatgattttcatctatgattccctcatttattttagatatcacaataacaaaagacggtgctgcatttgatttgtgttggtacttgattgggagtatttttagttttttactgtatgaattaagtgtttttagataagctcacctgttgtttttttttcttacttttaacatgttttctcttatagaaatatatcgacagaagcttcagcaatgtttagctgatggggagttgagtgaggaggatgtcaaagctttgcttcgtgtacgagttatgctctgtgttcctcaaaaggttgttgaagcagcacatgctgaaatttgtggtagtttgtttgagaaggtatgtgtttgaacttttaagcttgcctcccttcttggatctcagtcttttgctcagctttcactatgatcatttgctaaaaatacaatgttatatctttgtttgtttatgaaaaaattgtacgttctgttgaatatctagcttacaaagccgagaattttttgcgttcgccaactatattacgtgatatccgttgaattgctttcctaccttgccgtttcatctcttttgcataataaatcagttgacccaatacccattacctatttgctaattagatgcttagtgacagctgcttgtctccgctttaatttttgatgttgtggaatttagtaatttataacaaaaaagctagaggtgttcattcgggtcattgggtcaattttgggttaggtgtttctggtcggttcaatatcaggtcttgtgtctacattgattttacattattttaaattctttttgaagtctggtcaagtcgggttcggtggcaaggttgagtaaatatcgggtcatcgggtctattttgaacacctttaaaaaaactcatgtttcctaatgcttttgtgcgagtgctcttatgttttatgttgcc

SEQ ID NO: 603 - DNA, 3407 bp, Amaranthus spinosus
ccattatcgtcttcctctcctctccctctgcaacaaccccatctctgggttgattcttcttcccggaaccctccattaaaaccccaacaaacccttaaaatcaaactaaataaaccctaaaaatgagttcaacacttcctctttcttcatccacatcctcacttatctggaatttcgcaaacccaaatccaatcccttcttttcttccccccaaatttatcaatttaccagttgtttcctctttaaaacgacgtcggtttcgggtttctaagctcagatgctccgctaacccaatatctcaaccctcacccacacccgcacccgcacaggagatcactaccacttcaactagtactagcaggaatagttctgatatatttgggcctacaagagagttatctggtatacaatcactggttgacgggttgtcacctccagtgagaatagcgacctctgtacttatagttgtggctgcttctgctgctgggtatggtttgggttctcgatttgggggtacccggaatatggccattggtggcgctgttgcagttggtgttgctggtggtgttgctgcttatgggttgaattcttgtgtacctgaggttgctgccacccgtttgcataattttgtagctgaatgtgatgacccacttaatttgaacaaggaggatattgttgctattgctaatcggtatggtgttagtaaacaagatgaggcttttactgctgagctttgtgacttgtaccttagattcatttcttcggttcttccatctggaaatgaagatcttaagggtgatgaagttgaaacaatcattaaattcaaaaatggacttggaattgatgaccctgatgctgcaaacatgcatatagagcttgcccgtcgaattttcagacaaaggcttgaaaccggagatcgtgatggtgacattgaacagcgtcgggcatttcagaagctaatttatgtttcaactcgtgtttttggggatgcatcagcatttcttctaccctggaagcgtgtatttaaaataactgattcccaggttgaagttgctgttcgtgacagtgctcaaagattgtatgctgagaggctgaaaccaattggcagagatttggatacaaagcagcttattgagttgagagaaactcaaatttcagttcagctttctgacgagttggccgaggagatgtttaaagagcatacaagaaagctagtagaagaatgcatttcaagggctgttgagattctgaaatcacggacgagagcaaggggaactattgatgttgtgctagagcttgataaaattcttgcttttaacgatttgcttctctcactaaaaaaccatccagttgctgataaatttgcccgtggaattgcaccaatttccttagttggaggtgaatatgatagtgataggagaattgatgacttgaagctcctttttagagcgtatgttacatattctctatctaatggccgcatggaggacaacaagcttgctgcattgaacaagttgaagaacatatttggcctaggaaatcgtgaggcagaaggtataatgatggatgttacttcgaaggtgtatcgcaagctactatctcaggcgttttcaagtggtgctctggatgctgctgatagcaaagcaaattatcttcagaacttgtgtgaccagctgcattttgaccctgagaaagcaagtgagatccatgaagaaatatatcgacagaagcttcagcaatgtttagctgatggggagttgagtgaggaggatgtcaaagctttgcttcgtgtacgagttatgctctgtgttcctcaaaaggttgttgaagcagcacatgctgaaatttgtggtagtttgtttgagaaggttgtaaaggatgctattgcttccggtgttgacggttatgacgcagatgtaaaagcatctgtaaggaaagcagcacatggcttgcgtttgactagagaggctgctatgtcaattgctggaaaggcggttcgtcgaatatttatgaactttatcaaacaagcaagggcagcagggagtcgcactgaatcagcaaaaatcctcaagaagatgattgcttttaacaccttagtggtcaccgaattagttgcagacatcaaaggggaatcaactgatgctccagcggaggaggaaccagcaaaagagcaagagaagcagatcgaagatgaggaagaatgggaatcgctccagacattaaggaagtcacgacctactaaggaactcgaggcgaaaatcgggaaaccagggcagactgaaattaccgtcaaagatgacctttcagacagggagagggctgacctgtacaagacatacttaatgtactgcataacaggggaagtgaccaagataccgttcggtgcacaaatcaccacaaaaaaggacaatacagagtatctgtatttgaatcagcttggtgatattctcggtcttacacgtaaagagattgtggaggttcatcgaagtttggccgagcaggcttttagacagcaggccgaggtcattttggcagatgggcagttgactaaagcaaggatggagcaactggatgaggtacagaagcaagtcgggctgcctgcagaatatgctcaaaaggttagagagaacattataaattcaaagatggctgctgccattgaaactgctattggccaaggaaggctcagcataaaacaaattagagaactcaaggatgcgggtgtcaatatcgacaccatgattgcagagacccttcgggagaatctcttcaagaagactgttgatgagatattttcttccggtaccggagagttcgatgaggaggaagtctacgaaaaaattccctcagatgtgaaaattaacccgcagaaggctaaagcagttgtccatgaacttgctcgaagcagattaacgaactcattggttcaagccgtggctttattgaggcagagaaaccgtaatggggtgatatccaccctgaatgatttgctagcctgtgacaaggctgtgacttccgagcctttgtcatgggaagtgcccgaggaactagcagatctatttgccatatacgcgaagagcgacgcagcacctgagaaggtctcacgtctacagtatctgctggggctcagtgactcgacagctgctgctctaaaggagagggcagacactgtacccgttgctggttctgaagtcgacgattttgtattttagagaagaaaagttgagctatagtctagtgcagaggatattgtgttagtaaactcaaaataggtttatctatcaagaagataatttatttctgctgattttgcatttctcgtagtatcgcgttttttctatgtttggaacaccattataatttttttgtatggtacataattttgctattgaaggttttacatctgt

SEQ ID NO: 604 - DNA, 3380 bp, Amaranthus thunbergii
cccatttgtgggttgattcttcttcccagaaccctccattaaaacccccataaacccttaaaatctaactaaaaaaaaccctaaaaatgagttcaacacttcctctttcttcatccaaatccccacttcttatctggaattctacaaacccaaatccaatcccttcttttcttccccccaaatttatcaatttaccagtcatttcctctttaaaacgacgtcgttttcgggtttctaagctcagttgctccactaacccaatatctcaatcctcacccacacccacacccacacccgcacccgcacaggagatcacaaccacttcaactagtactagcagcaatagttctgatatatttgggcctacaagagagttatctggtatacaatcactggttgatgggttgtcacctccagtgagaatagcaacctctgtacttatagttgtggctgcttctgctgctggatatggtttgggttctcgatttgggggtacccggaatatggccattggtggcgctgttgcagttggtgttgctggtggtgttgctgcttatgggttgaattcttgtgtacctgaggttgctgccacccgtttgcataattttgtagctgaatgtgatgacccactcaatttgaacaaggaggatattgttgctattgctaatcggtatggtgttagtaaacaagatgaggcttttactgctgagctttgtgacttgtaccttagattcatttcttcggttcttccatctggaaatgaaaatcttaagggtgatgaagttgaaacaatcattaaattcaaaaatggacttggaattgatgaccctgatgctgcaaacatgcatatagagcttgcccgtcgaattttcagacaaaggcttgaaaccggagatcgtgatggtgacattgaacagcgtcgggcatttcagaagctaatttatgtttcaacccgtgtttttggggatgcatcagcatttcttctaccctggaagcgtgtatttaaagtaactgattcccaggttgaagttgctgttcgtgacagtgctcaaagattgtatgctgagaggctgaaaccaattggcagagatttggatacaaagcagcttattgagttgagagaaacccaaatttcagttcagctctctgacgagttggccgaggagatgtttaaagagcatacaagaaagctagtagaagaatgcatttcaagggctgttgagattctgaaatcacggacgagagcagggggaactattgatgttgtgttagagcttgataaaattcttgcttttaacgatttgcttctctcactaaaaaaccatccagatgctgataaatttgctcgtggaattgcaccgatttccttagtaggaggtgagtatgatagtgataggaggattgatgacttgaagctcctttttagagcgtatgttacagatgctctatctaatggccgcatggaggacaacaagcttgctgcattgaacaagttgaagaacatatttggcctaggaaaacgtgaggcagaaggtataatgatggatgttacttcgaaggtgtatcgcaagctactatctcaggccttttctagtggtgctctggatgctgctgatagcaaagcaaattaccttcagaacttgtgtgaccagctgcattttgaccctgagaaagcaagtgagatccatgaagaaatatatcgacagaagcttcagcaatgtttagctgatggggagttgagtgaggaggatgtcaaagctttgcttcgtgtacgagttatgctctgtgttcctcaaaaggttgttgaagcagcacatgctgaaatttgtggcagtttgtttgagaaggttgtaaaggatgctattgcttccggtgttgatggttatgacgcagatgtaaaagcatctgtaaggaaagcagcacatggcttgcgtttgactagagaagctgctatgtcaattgctggcaaggcggtccgtcgaatatttatgaactttatcaaacaagcaagggcagcagggagtcgcactgaatcagcaaaaatcctcaagaagatgattgcttttaacaccttagtggtctccgaattagttgcagatatcaaaggggaatcaactgatgctccaacggaggaggaaccagcaaaagagcaagagaagcagatcgaagatgaggaagaatgggaatcgctccagacattaaggaagtcacgacctactaaggagctcgaggcgaaaatcgggaaaccagggcagactgaaattactgtcaaagatgacctttcagacagggagagggccgacctgtacaagacatacttaatgtactgcataacaggggaagtgaccaagataccgttcggtgcacaaatcaccacaaaaaaggacaatacagagtatctgtatttgaatcagcttggtgatattctcggtctttcacgtaaagagattgtggaggttcatagaagtttggccgagcaagcttttagacagcaggccgaggtcattttggctgatgggcagttaactaaagcaaggatggagcaactggatgaggtacagaagcaagtcgggctgcctgcagaatatgctcaaaaggttagagagaacattataaattcaaagatggctgctgccattgaaactgctattggccaaggaaggctcagcataaaacaaattagagaactcaaggatgcgggtgtcaatatcgacaccatgattgcagagacccttcgggagaatctcttcaagaagactgttgatgagatattttcttccggtaccggagagttcgatgaggaggaagtctacgaaaaaattcctgcagatgtgaaaattaacccgcagaaggctaaagcagttgtccatgaacttgctcgaagcagattaacgaactctttggttcaagccgtggctttattgaggcagagaaaccgtaatggggtgatatccaccctgaatgatttgctagcctgtgacaaggctgtgacttccgagccgttgtcatgggaagtgcccgaggaactagcagatctatttgccatatacgcgaagagcgatgcagcacctgagaaggtttcacgtctacagtatctgctggggatcagcgactccacagctgctgctctaaaggagagggcagacactgtacccgttgctggttctgaagtcgacgattttgtattttagagaagaaaagttgagctatagtctagtgcagaggatattgtgttagtgaatactcaaataggtttatttatcaagaagataatttatttctgctgattttgcatttcagagtatgacaaaagatttaaatgatctttttaatgtttggaacacccttataatttttttgtatggtacataattttgcta

SEQ ID NO: 605 - DNA, 3406 bp, Amaranthus viridis
cccccatttgtgggttgattcttcttcccagaaccctccattaaaacccccataaacccttaaaatctaactaaaaaaaccctaaaaatgagttcaacacttcctctttcttcatccaaatccccacttcttatctggaattctacaaacccaaatccaatcccttcttttcttccccccaaatttatcaatttaccagtcatttcctctttaaaacgacgtcgttttcgggtttctaagctcagttgctccactaacccaatatctcaatcctcacccacacccacacccacacccgcacccgcacaggagatcacaaccacttcaactagtactagcagcaatagttctgatatatttgggcctacaagagagttatctggtatacaatcactggttgatgggttgtcacctccagtgagaatagcaacctctgtacttatagttgtggctgcttctgctgctggatatggtttgggttctcgatttgggggtacccggaatatggccattggtggcgctgttgcagttggtgttgctggtggtgttgctgcttatgggttgaattcttgtgtacctgaggttgctgccacccgtttgcataattttgtagctgaatgtgatgacccactcaatttgaacaaggaggatattgttgctattgctaatcggtatggtgttagtaaacaagatgaggcttttactgctgagctttgtgacttgtaccttagattcatttcttcggttcttccatctggaaatgaaaatcttaagggtgatgaagttgaaacaatcattaaattcaaaaatggacttggaattgatgaccctgatgctgcaaacatgcatatagagcttgcccgtcgaattttcagacaaaggcttgaaaccggagatcgtgatggtgacattgaacagcgtcgggcatttcagaagctaatttatgtttcaacccgtgtttttggggatgcatcagcatttcttctaccctggaagcgtgtatttaaagtaactgattcccaggttgaagttgctgttcgtgacagtgctcaaagattgtatgctgagaggctgaaaccaattggcagagatttggatacaaagcagcttattgagttgagagaaacccaaatttcagttcagctctctgacgagttggccgaggagatgtttaaagagcatacaagaaagctagtagaagaatgcatttcaagggctgttgagattctgaaatcacggacgagagcagggggaactattgatgttgtgttagagcttgataaaattcttgcttttaacgatttgcttctctcactaaaaaaccatccagatgctgataaatttgctcgtggaattgcaccgatttccttagtaggaggtgagtatgatagtgataggaggattgatgacttgaagctcctttttagagcgtatgttacagatgctctatctaatggccgcatggaggacaacaagcttgctgcattgaacaagttgaagaacatatttggcctaggaaaacgtgaggcagaaggtataatgatggatgttacttcgaaggtgtatcgcaagctactatctcaggccttttctagtggtgctctggatgctgctgatagcaaagcaaattaccttcagaacttgtgtgaccagctgcattttgaccctgagaaagcaagtgagatccatgaagaaatatatcgacagaagcttcagcaatgtttagctgatggggagttgagtgaggaggatgtcaaagctttgcttcgtgtacgagttatgctctgtgttcctcaaaaggttgttgaagcagcacatgctgaaatttgtggcagtttgtttgagaaggttgtaaaggatgctattgcttccggtgttgatggttatgacgcagatgtaaaagcatctgtaaggaaagcagcacatggcttgcgtttgactagagaagctgctatgtcaattgctggcaaggcggtccgtcgaatatttatgaactttatcaaacaagcaagggcagcagggagtcgcactgaatcagcaaaaatcctcaagaagatgattgcttttaacaccttagtggtctccgaattagttgcagatatcaaaggggaatcaactgatgctccaacggaggaggaaccagcaaaagagcaagagaagcagatcgaagatgaggaagaatgggaatcgctccagacattaaggaagtcacgacctactaaggagctcgaggcgaaaatcgggaaaccagggcagactgaaattactgtcaaagatgacctttcagacagggagagggccgacctgtacaagacatacttaatgtactgcataacaggggaagtgaccaagataccgttcggtgcacaaatcaccacaaaaaaggacaatacagagtatctgtatttgaatcagcttggtgatattctcggtctttcacgtaaagagattgtggaggttcatagaagtttggccgagcaagcttttagacagcaggccgaggtcattttggctgatgggcagttaactaaagcaaggatggagcaactggatgaggtacagaagcaagtcgggctgcctgcagaatatgctcaaaaggttagagagaacattataaattcaaagatggctgctgccattgaaactgctattggccaaggaaggctcagcataaaacaaattagagaactcaaggatgcgggtgtcaatatcgacaccatgattgcagagacccttcgggagaatctcttcaagaagactgttgatgagatattttcttccggtaccggagagttcgatgaggaggaagtctacgaaaaaattcctgcagatgtgaaaattaacccgcagaaggctaaagcagttgtccatgaacttgctcgaagcagattaacgaactctttggttcaagccgtggctttattgaggcagagaaaccgtaatggggtgatatccaccctgaatgatttgctagcctgtgacaaggctgtgacttccgagccgttgtcatgggaagtgcccgaggaactagcagatctatttgccatatacgcgaagagcgatgcagcacctgagaaggtttcacgtctacagtatctgctggggatcagcgactccacagctgctgctctaaaggagagggcagacactgtacccgttgctggttctgaagtcgacgattttgtattttagagaagaaaagttgagctatagtctagtgcagaggatattgtgttagtgaatactcaaataggtttatttatcaagaagataatttatttctgctgattttgcatttcagagtatgacaaaagatttaaatgatctttttaatgtttggaacacccttataatttttttgtatggtacataattttgctattgaaggttttacatctgtggttaa

SEQ ID NO: 606 - DNA, 1286 bp, Ambrosia artemisiifolia
aggttcggaaaattttcattagttacatacaaagatcacgagcttcgggtagtcgaacagaggctgcaagagaactcaaaaagatgatagcattcaacaacttagttgtaacggaacttgtgtcagatatcaaaggagaatcatctgagaccaccacagaagatgagcccattgatgtcgaagtgaaacccgtagaggaagtagacgatgaagaatgggagtcactgcaaacccttagaaaagttaagccggcccgaatgaccacagggaagcccggtcaaactgaaataactctcaaagacgaccttccagacagggacagaaccgacctgtacaagacgtatttactctattgtttaacgggtgaagtgacacgggtcccatttggtgctcaaatcaccaccaaaaaagacgattctgaatatgcttttctaaaacagctagggggtattttagggttgaccgataaagaaattgtggaagtccacagaagcttagctgaacaggcttttacacaacaagctgaagttatattagcagatgggcaactaacaaaagcgcgtgttgcacaattaaacgagttgcaaagacaagttggattgccatctgaatatgctcaaaaaataataaagaacataacgagcacaaaaatggcagctgcgcttgaaactgctgtgggccagggtcggctcagtataaaggaaatccgtgagcttaaagggtcgggaatcgagttagatgtgatggtgtcacagagtttaagacaaaatctttttaagaaaacagtcgatgatatattttcttcaggaaccggtgagtttgatgaggtagaggtttatgagaagattccggaagatcttggcatcgatgctaacaaggctcgggatgttgttcatgaacttgcgcgaactcggttgtcaaattctttgattcaggctgtttcgttattgagacagagaaatacttcaggggtggtacgtgcgaattctttttccttaatagtttaggtttaagtgtgttggtcaggacaaaccctgaaccaaaagcttcatatatcccctgaaaattaataattaatatacccattaaacgacaaattttcttatatacccatctcattaaatacgatatacaatatgatcaatgctcgttaaacatgtccctttctttttactaataggtgtatttaatattttgtttttttaataataattctagtaaacgtttaatccattactaaagaactcatgaatccggccaataccttgctaatcaataagatcagg

SEQ ID NO: 607 - DNA, 630 bp, Ambrosia artemisiifolia
acttgttctttccggacacacaaggtctttatatataatagtttttaagatttcaatatatttggatggtgcaggtttcttctctgaacgacttgttagcctgtgacaaagccgtacccgcctcaccattatcatgggaagtgcctgaagagttggcagacctgttttcaatatacatcaagaatgaccctgcacctgaaaagctgtcacggttacagtacttgttgagcatcgatgatgcaaccgctgaagcattgaaagagctgaaggatcgtgcagtaccaactagtgaaactagtgaagaggagtttgtattttgagtttagtttttagtaacattttgtgcgcgatggcaactggcttgcgctataggtgagagaactacgggtctttcttcccaaatgtctattttagatatgtttgaacgggtgtgtatgactaaactggattttgttgagttttatgaataacatgaatgtatggttgatatctgtcactccattagaggcggtattcgaaccaattgaatatcaccggctctagtgaaacgttcgaacaaacaagtaaacaaataaagtgacgggtcctgtaaattgtgattatataaaacttggtccaatccatcccatc

SEQ ID NO: 608 - DNA, 636 bp, Ambrosia artemisiifolia
ggtaaaatgatgtgacaccattattttgatgacgtgttggtgtaccacattattgtcttacctgttataaaagattacttgcataaaaagacattatttttttcttacatacaatagcataaaaatgaaaggaagttacatttgggtgtaatgaatctcaactagtgtcaaagatgacagaattattccaacaataatttaaataatgatctaggatgttttatgcattcaaaccattttattttgacattggtccatttcttttatctaacgtattttactttaccggtttaactagttagagattacatggcataatgtttcttcttcctatttttcatcttacaaagctttctgccctgagccaattgaggaatatatttggtctgggtaaaagggaagcggagtcgattgcaatagaagtcacttcaaaggtatataggaaacgccttgctgaatctgtaaccggtggtgctttagaagctgcagatagtaaagcagcttttcttcaaaatctttgcgaagaattgcacttcgatcctgagaaagccattgaaatccatgaaggtaatttaggcttcaaagtcttatgcaagggttgatttgggttatgtcttatattggacggttcaaaac

SEQ ID NO: 609 - DNA, 219 bp, Ambrosia artemisiifolia
cactatttattgggcaggcggcgagtatgacggtgataggaagatggatgacttaaagctcctctacagggcatatgttgctgattctctatctggtggtcgtatggagaaagagaaggtacataattgagtatttttttgtgggtcccattatatcatgtcgagagaactgaagatgttgcgggtctattttttttagaagaaatggataagaaatgg

SEQ ID NO: 610 - DNA, 711 bp, Ambrosia artemisiifolia
ttatatataaatgttaaagaaattacacaaaaagatttcctggtcaacttcactcaaattcatttgggccttaaaattttttgatccgttacccagaccgtttggcccggttatattgccacctctatgagtttagatattaaatgaagatacagggcttgaccattgtggggggctccagtgcaggcatttcagaagctgatttatgtttcaacactcgtgtttggagaggcttcaggttttcttttaccttggaagcgtgtattcaaggttaccgaatcacaggtattaattaattcaaacatgcgtacttgtaagaattacaaaattaatagaagtaataactaggttagagacccgtgtgttacacattgattggcctgataattctctgtgcaacaggttgaggttgctataagggacaatgcccaaaggttatatgcttccaagctaaaattgattggccaaggtaagtttgtaacattaattaattattgattggccaaagctaaaactacgttattcttgaacacatgtaatttatttatgtaatcatattcgagacattatgattttgatattaatatagtttttagtaaggttccacaccaactatatagttgtgcactagtaaaggaggtgctttgatgtgattctaaaagtgattctatgatgccggataaccagtactatataatcagctgtaataga

SEQ ID NO: 611 - DNA, 1034 bp, Ambrosia artemisiifolia
attttgctatctacatgcttttacctacacacacgtacaattttttgcattttttccctggttagcttcctcaaggtactttgaagtgtattctattattgaatacttgctgccgttcgttcattttatttctttctcagatacgtgttatccgtacttccttctgatggtgaagatttaaagggcgatgaagctgatattattattaagttcaaaaattctttgggaattgatgatcccgatgcagcggccatgcatatggaggtataatttacagcattggtatctggtatttggttcaagatggataacgtctttccgtttagcagttatgtgtgtaattatttttgcatgtgttcaacagattggtaggcgtattttcaggcaaaggttggaaactggtgatcgtgaagcagatgcacaacagcgtcgggtatgtttcatgtctaacgggtcacaatgacgtggataaaatgagaagacaactaaaaaagtgactggttaaatggtgcagaagtcacccaatttgtttcttaatgcataaaacctccaaaatcattataactaaaaaactagatcatgtgtagtcatagattgctggtcattttggtgctgaatgagtagaggtggtaatttgaccatttacttctgaatgggtctattcgggctatgtttcatggttaacgggtcacacggataaaacaaatgaatagctaaaagatgccataaaagtcatccaaagtgtactttttacgtgtaaaacatccaaagtggttttgaccaaaaaattagaatgttattgaccctgttgtcaatagctaagatagcgttcggtatagcgcgctccatagcgtgtcgactatatatctcgagaatctgattttagcgactccatagcgtggaaatagcgggattccaggttttttataatataaatactaaatagcgggatttcatgctgttttttctgtattaatatagctatttaatataagtagcgtatttagatgaaaaacagcgtattttgataaaat

SEQ ID NO: 612 - DNA, 545 bp, Ambrosia artemisiifolia
aacagaaaccgttacagattcaaacacagttatcgtctccctaccgtccgttgctcatcacaaccaacacaaacagaccagccgtcaactaacgccgttagcaacacaacattcggtgaacgtaaggagctgacggcgttacagtcggtggtggactctatgtcaccggctgttaggttagctagctccgttgttgttgtagctggtgctgtggctgctggatatggattagggttaagaattggggggaataagagtgctagtttgggtggggctgtggttttgggtgctgctggtgccggtgcggtttacgcggttaattcgtcggttgtgccggagattgctgctgttagtttgcataattatgttgccggttcggatcctggcgcggttacgaaggaagatattgagaatattgctagcaggtttatttgttattaagtttgtttagttatggtttttagtatagaagtatagaaatgaaacgttaatcatgttagttagtatgccttattgagttattgtgttactagttatattatttt

SEQ ID NO: 613 - DNA, 702 bp, Ambrosia artemisiifolia
tattgtgtttcatctttacccgtaccagaagttatcagctttgatccgttactcgagtcccaaccaactctttttaaaaccatcttgaaagttgaaaggctccaaaatgttcttatgtttaattcttttacagcaatataccggcaaaatcttcagcaatacgtgaacgatggagaacttagtgatgaagaggtcaagtctctggaaagattgcaagttatgctttgtctccctaaacaaacggttgaaaagattcacgaggatatatgtggcacgttatttgaaaaggtgactcatatggattctttttaatatgttacgtatatcttatatttctctgtgtgcttttggtatttctttgaaggccaacaaacaggctgtaaaacttctcttgcttctgtcttacatacccaaactaaattcatttaatttatttgtaatgtcagtagttgatggttttttgatcttatcataatttcaggttgttaaggaggctatagctgccggagttgatggttatgatgctgatgttaaacagtctgtaagaaaggctgcgtatggtttacgtttaacaaggggcgtggccatgtctattgctggcaaggcagtaagtgcttcttcacgattgttgtattatcctgatgtggcaaaatgggctggccttactggtcaaaacgaatttgtgtcaggttgatctgaaaa

SEQ ID NO: 614 - DNA, 275 bp, Ambrosia artemisiifolia
tacatgatcttcacacctttatataaatgatcaaacactcaagacaattaaattaaactgtgttgcagtcaagtgttgtgtttattttactgctaagatgaattacggttttcagcagggatgcccgacttattgttgaagaacttgataagatattggcattcaataacttgttagtctcattgaagaatcatcctgatgcaagtcggtttgctcgtggggttggtccagtttctctgataggtaattatgctcttaagtcttatctagaagtg

SEQ ID NO: 615 - DNA, 2692 bp, Ambrosia trifida
cagatatggtgttagcaaacagaatgaagctttcaatgctgagctttgtgatatatactgtcgatacgtgttatccgtacttccttctgatggtgaagatttaaagggcgatgaagctgatattattattaaattcaaaaattcattgggaattgatgatcccgatgcagcggccatgcatatggagattggtaggcgtattttcaggcaaaggttggaaactggtgatcgtgaagcagatgcagaacagcgtcgggcatttcagaagctgatttatgtttcaacactcgtgtttggagaggcttcagggttttcttttaccttggaagcgtgtattcaaggttaccgaatcacaggttgaggttgctataagggacaatgctcaaaggttatatgctttcaagctaaaattgattggccaagatattcatccggaagagcttattagtcttagagatgcacaattacaatgtcggctttcagatgagctagctgaagatatgttcagggagcacattagaaagcttgttgaagcaaatatatcaacaagtgtggatgtactcaagtccagaacaagaacagccagggatgcccgacttattgttgaagaacttgataagatattggcattcaataacttgttagtctcattgaagaatcatgctgatgcaagtcggtttgctcgtggggttggtccagtttctctgataggcggcgagtatgatggtgataggaagatggatgacttaaagctcctctacagggcatacgttgctgattctctatctggtggtcgtatggagaaagagaagctttctgccctgagccaattgaggaatatatttggtctgggtaaaagggaagcggagtcgattgcaatagaagtcacttcaaaggtatataggaaacgccttgctgaatcagtaaccggtggtgctttagaagctgcagatagtaaagcagccttttcttcaaaatctttgtgaagaattgcacttcgatcctgagaaagccattgaaatccatgaagcaatataccggcaaaatcttcagcaatacgtgagcgatggagaacttagtgatgaagaggtcaagtctctggaaagattgcaagttatgctttgtctccctaaacaaacggttgaaaagattcacgaggatatatgtggcacgttattcgaaaaggttgttaaggaggctatagctgccggagttgatggttatgatgctgatgttaaacaggctgtaagaaaggctgcgtatggtttacgtttaacaaggggcgtggccatgtccattgctggcaaggcagttcggaaaattttcatcagttacatacaaagatcacgagcttcgggtagtcgaacagaggctgcaagagaactcaaaaagatgatagcattcaacaacttagttgtaacggaacttgtgtcagatatcaaaggagaatcatctgagaccaccacagaagacgagcccattgatgtcgaagcgaaacccgtagaggaagtagacgatgaggaatgggagtcactgcaaacccttagaaaagtcaagccggcccgaatgaccacagggaagcccggtcaaactgaaataactctcaaagacgaccttccagacagggacagaaccgacctgtacaagacgtatttactctattgtttaaccggtgaagtgacacgggttccatttggtgctcaaatcaccaccaaaaaagacgattctgaatacggttttctaaaacaactagggggtattttagggttgaccgataaagaaattgtggacgtccatagaagcttagctgaacaggcttttacacaacaagctgaagttatattagcagatgggcaactaacaacagcgcgtgtttcacaattaaacgagttgcaaagacaagttggattgccatctgaatatgctcaaaaaataataaagaacataacgagcacgaaaatggcagctgcgcttgaaactgctgtgggccagggtcggctcagtataaaggaaatccgtgagcttaaaggatcaggaatcgagttagatgtgatggtgtcacagagtttaagacaaaatctttttaagaaaacagtcgatgatatattttcttcaggaaccggtgagtttgatgaggtggaagtttatgagaagattccggaagatcttggcatcgatgctaacaaggctcgggatgttgttcatgaacttgcgcgaactcggttgtcaaattctttgattcaggccgtttcgttattgagacagagaaatacttcaggggtggtttcttctctgaacgacttgttagcctgtgacaaagccgtacccgcctcaccattatcatgggaagtgcctgaagagttgtcagacctgttttcaatatacatcaagaatgaccccgcacctgaaaagctgtcacggttacagtacttgttgagcatcgatgatgcaaccgctgaagcattgaaagagatgaaggatcgcgcagtaccaactagtgaaactagtgaagaggagtttgtattttgagtttagtttttagcaacattttgtgcgcgatggcaactggcttgcgctataggtgagagaactacgggtctttcttcccaaatgtctattttagatatgtttgaacggaggtgtgtgactaaactggtttttgttgagttttatgaataacatgaatgtatgg

SEQ ID NO: 616 - DNA, 260 bp, Ambrosia trifida
tgatgcaagtcggtttgctcgtggggttggtccagtttctctgataggtaattatgctctcaagtcttatctagaagtgctgagatggacaggtcggtcaggttgggtaacaggtcaaaactaacttgggtagaaacaattctttttgcttttacgtgttaaaacagaccatctaggttgctttgacttttaatcactttatttataatattttataaatgactgatgtgctcatttcgattacagaaaagtattattac

SEQ ID NO: 617 - DNA, 392 bp, Ambrosia trifida
agcttaaataaactgttccttattgttgatgacttgatgcataaattttattgtatttgtttctttcagatatggtgttagcaaacagaatgaagctttcaatgctgagctttgtgatatatactgtcggtgagtggaaattgttttatataaccccctttttttatctttttcttggccactcttattatggtcattagcaactaatctcattctaaactttatacttttttttaatcaatttagtgactcttaaaagggggttttgttattttggatctttttttctttttactctagtggtgtgctcatagtcacataattcgctggtaaggccacgattctcgttctggatcgttcgtaccaattcgcggtacgatcgcggtcctggt

SEQ ID NO: 618 - DNA, 411 bp, Ambrosia trifida
gtgcaggtttcttctctgaacgacttgttagcctgtgacaaagccgtacccgcctcaccattatcatgggaagtgcctgaagagttgtcagacctgttttcaatatacatcaagaatgaccccgcacctgaaaagctgtcacggttacagtacttgttgagcatcgatgatgcaaccgctgaagcattgaaagagatgaaggatcgtgcagtaccaactagtgaaactagtgaagaggagtttgtattttgagtttagtttttagtaacattttgtgcgcgatggcaactggcttgcgctataggtgagagaactacgggtctttgttcccaaatgtctattttagatatgtttgaacgggggtgtgtgactaaactggtttttgttgagttttatgaataacatgaatgt

SEQ ID NO: 619 - DNA, 203 bp, Ambrosia trifida
accatcttgaaagttgaaaggctccaaaatgttcttatgtttaattcttttacagcaatataccggcaaaatcttcagcaatacgtgagcgatggagaacttagtgatgaagaggtcaagtctctggagagattgcaagttatgctttgtctccctaaacaaacggttgaaaagattcacgaggatatatgtggcacgttatt

SEQ ID NO: 620 - DNA, 337 bp, Ambrosia trifida
ttctaaaacagctagggggtattttagggttgaccgataaagaaattgtggacgtccatagaagcttagctgaacaggcttttacacaacaagctgaagttatattagcagatgggcaactaacaacagcgcgtgtttcacaattaaacgagttgcaaagacaagttggattgccatctgaatatgctcaaaaaataataaagaacataacgagcacgaaaatggcagctgcgcttgaaactgctgtgggccagggtcggctcagtataaaggaaatccgtgagcttaaaggatcgggaattgagttagatgtcatggtgtcacagagtttaagaca

SEQ ID NO: 621 - DNA, 439 bp, Ambrosia trifida
atctgtaacaatcagttctttaacttcaaattaccaaagttatttttttatgctactcaacagtccacttaaagaaagactgttgtgtgtactaaaaattctagattcatgtaatcctttgaaagtctctattttctatacatatttacccccatccgtgacatgtttcttagatattcatccggaagagcttattagtcttagagatgcacaattacaatgtcggctttcagatgaggtacaccttttaagttgataagcaacttaatagtatattaccacttgtaatcgtttatttactggtttgtatattttgcagctagctgaagatatgttcagggagcacattagaaagcttgttgaagcaaatatatcaacaagtgtggatgtactcaagtccagaacaagaacagcgtacatgatcttcacacctttatat

SEQ ID NO: 622 - DNA, 400 bp, Ambrosia trifida
attatttttttcttacatacaatggcacaaaaatgaaaggaagttacatttgggtgtaatgaatctcaactagtgtcaacaatgatagacccagttatattattccaacaataatttaaataatgatctaggatgttttatgcattcaaaccattttattttgacgttggtccagtttctttttatgtaacatattttattttaccggtttaactagttagagattacatggcataatgtttcttcttcttttttcctcttacaaagctttctgccctgagccaattgaggaatatatttggtctgggtaaaagggaagcggagtcaattgcaatagaagtcacttcaaaggtatataggaaacgccttgctgaatctgtaaccggtggtgctttagaag

SEQ ID NO: 623 - DNA, 988 bp, Ambrosia trifida
atatatactctctatacccagagctactttcccatgtcaactttttgcggtgtcaacccattgtgcaagcttgggctatgataatgagtcagccgtgtaaaatgaagtattttagtttaaaagttaactgtctacagtctttactactgtttttgaaaagttggataatttttaaagtagtattttgtaattttaaatcgtaagattatcaatatgtaaaactcaacctaagattagcaatatgtacatgctggtgggttgactatttaacccaactcgctttgacctacctaaaaacttaatcgttttgacgatctctacctcattttgctatctacatgcttttacctacacacaatgcacaattttttgcacttttccctggttagcttcctcaaggtacttgcaaatgtatcaataattctattattgaatacttgctgccgttcgttcattttatttctttctcagatacgtgttatcagtacttccttctgatggtgaagatttaaagggcgatgaagctgatattattattaaattcaaaaattcattgggaattgatgatcccgatgcagcggccatgcatatggaggtataatttacagcattggtatctggtatttggttcaagatggagaacgtctttcagtttaccagttatgtttgtgattatttttgcatttgttcaacagattggtaggcgtattttcaggcaaaggttggaaactggtgatcgtgaagcagatgcagaacagcgtcgggtatgtttcatgtctaacgggtcacaatgacgtggataaaatgagaagacaactaaaaaagtgactggttaaatgggtcacccaatttgtttcttaatgcataaaacgtccaaaatcattttaactaaaaaactagatcatgtgtagtcatagattgctggtcattttggtgctgaatgagtagaggtggtaatttgaccatttacttctgaatgggtctattc

SEQ ID NO: 624 - DNA, 1305 bp, Ambrosia trifida
gatcttatcataatttcaggttgttaaggaggctatagctgccggagttgatggttatgatgctgatgttaaacaggctgtaagaaaggctgcgtatggtttacgtttaacaaggggcgtggccatgtccattgctggcaaggcagtaagtgcttcttcacgattgttgtattatccgtagatgtggcaaaatgggctggcctgactggtcaaaacgagtttgtgtcggttaggttgatctgaaaccccaaaatactaattttgttttccaaaaattggtacaagtcggttatggttactaaaaactataccatttcagtagtaatctagtttgtttttattctaatgatttaaaagattttatcattcagactcagagtgtaccggttcagtgactttgatccaacccggacaccacctgttagtttaattgtttcaaaaacccaatactaacccgaacactattaacccatgtaagccaatcatgaaccaaaatataaacaagttggctgggtaattgggccaaataggttgtaaactatcggggtgaacttataatttttcaaatttctctttattcaattttattttcaagcgggttgtcgggttggctcattaatcctcagttgaacacacgtatttattaaaaaggttagaagtgttttatttttgtgttgactttttcgcgtacgggtttgccacttatatttttacttgttttaagctagttgttattttatctgttttataaaatggattgaaatcaccacctttagttaaatgattatatatttgtagtcaagctcagcattatgatacaattttatgcaggttcggaaaattttcattagttacatacaaagatcacgagcttcgggtagtcgaacagaggctgcaagagaactcaaaaagatgatagcattcaacaacttagttgtaacggaacttgtgtcagatatcaaaggagaatcatctgagacccccacagaagacgagcccattgatgtcgaagcgaaacccgtagcggaagtagacgatgaggaatgggagtcactgcaaacccttagaaaagtaaagccggcccgaatgaccacagggaagcccggtcaaactgaaataactctcaaagacgaccttccagacagggacagaaccgacctgtacaagacgtatttactctattgtttaaccggtgaagtgacacgggttccatttggtgctcaaatcaccaccaaaaaagacgattctgaatacggttttctaaaacaactagggggaattttagggttgactgataaagaaatt

SEQ ID NO: 625 - DNA, 292 bp, Ambrosia trifida
atggtgtcacagagtttaagacaaaatctttttaagaaaacagtcgatgatatattttcttcaggaaccggtgagtttgatgaggtggaagtttatgagaagattccggaagatcttggcatcgatgctaacaaggctcgggatgttgttcatgaacttgcgcgaactcggttatcaaattctttgattcaggctgtttcgttattgagacagagaaatacttcaggggtggtacgtgcgaattctttttccttcatagtttaggtttaagtgtgttggttaggacaaaccc

SEQ ID NO: 626 - DNA, 351 bp, Ambrosia trifida
gctattgctacatcgtgtataggtaacttgtcgctatcatcacctattcgttatttgctatcgacaactatggttattgatataatcttactactgatatcccagctgacactagttatatataaatactaaagaaattacacaaaaaatttcccggtcaacttcactcaaattcatttgggccttacatttttttgatccgttacccagaccgtttggccgagttatattgcaacctctatgagtttagatattaaatgaagatacaggacttgaccattgtggggggctccagtgcaggcatttcagaagctgatttatgtttcaacactcgtgtttggagaggcttca

SEQ ID NO: 627 - DNA, 386 bp, Ambrosia trifida
ggtctgggtaaaagggaagcggagtcgattgcaatagaagtcacttcaaaggtatataggaaacgccttgctgaatctgtaaccggtggtgctttagaagctgcagatagtaaagcagctattcttcaaaatctttgtgaagaattgcacttcgatcctgagaaagccattgaaatccatgaaggtaatttaggcttcaaaatcttatgcaagggttgatttgggttatgtcttatattggacggttcaaaatgaagaaaaagtagctaaaagaaataggtcaaataggttgaacagatcaaaactcgcctcagtagcatctataatgcatctacatttcattgttgttgtattaaaatttttggttgtgttgggtaaatttagtt

SEQ ID NO: 628 - DNA, 1448 bp, Avena fatua
atgtgttcggcggccggaaggagctcacgggcgtgcagcccctagtggaggcgctgccgcccgtcgcgcgggccgcgctggagctcgcggtcgttgccgcggcggcgacggccgggtacagccttgggacccgctacggcggcggctcgcgtaccgcgtcgatcgcgggcgcggccgtgctcggggccgccggccttgcgggcgctgctgcagtgaactccgtggtgccggaggtcgctgccgtggggctgcacaactacgttgccggccgcgacgaccccactgagctggaggccgccgaggtggaggccatcgcgagcaaatatggagtcggtacacaagatgcggctttcaaatcagagctctgtgacttgtatgccagctttgtttactcagtgattcctccaggacatggagatctcaaaggtaacgaggttgaagctattataaagtttaaaagagctcttggacttgatgatgtagatgctgcaaatatgcacatggcggttggtagacgcttatacagagagaggctcgacgcgttccaaaaattaatttttgtgtcaaatcttgtcttcggagatgcatctgagttcatacttccatggaaacatcttttcgggatcacggattatcagatcgatattgctatgcgggagaatgccaaaagtttatatgcgttagagctcaagtctattggaagaggtcttgacataggcacgctcattgaagtaaggagggtacagattgcatataaactttttgacgagattgctgctgacatgttcagggagcatgcgaagagcttgatccaagaaaacatttcatctgctctatccatattgaaatccaatccgggttcgacgaacattccaacagaggttattagtgaagtgaatagcattcttgcattcaatagtttgctaacagttctaagcaagttccctcagggagatcgatttgcacgtgggcttggaccagtttcgttagctggagactttgatcatgatagaatggttggtgatctaaagatactctacgcggcctatgcaacggaaatactttcagatggaaaccttgatgatgagaagtttgttcgcttgagtgaattgaggaatatatttggactggggaagcgtgaagcagaagcaatcatagaaggaatcacgtcaaatgttaaatctcaagtaccggcataatactctgtgtgtgcattgatgcatattacagaaattgcaggaaaccgttttctttgttgaatcatgaacaaacaaagagaacaatgcaattcgaactttgccacttaccatttgatgattttctggggagttatcaggtagaccttattgtgaacatcaaataagcatccacgaactgatactcatgtacacattatagcgtaaactgttgttactacagcaaagaataacaacatggacatagaagta

SEQ ID NO: 629 - DNA, 1357 bp, Chenopodium album
tttgaccctgagaaggcgagtgagatccatgcagaaatatatcgacagaagctacagcaatgcttagctgatggagagttgagtgaggaggatgtcaaagctttactacgcgtacgggtcatgctgtgtgtgccccaaaaaattgttgaagctgctcatgctgatatttgtggcagtttgtttgagaaggttgtgaaggatgcaattgcttccggtgttgacggatatgatgcggatgttaaagaaaatgtgaggaaagcagcacatggtttgcgcttgactagggaagctgcaatgtcaattgctagtaaggcggtccgcagaatattcattaactacattaaacaggcaagggcagctggaagtcgcactgaatctgcaaaaatacttaagaagatgatcgcattcaacaccttggtggtcactgaattagttgctgatattaaaggggaatcaactgatgttccaacagaagaacctgttaaagaggaagaggagaaatttgaagatgaggaagaatgggagtcactccagacattaagaaaatcaagacctactaaggaacttgaggccaaaattgggaaacctgggcagacagagattactgttaaagatgaccttccagagagggagagggctgacctgtacaagacatacttgttatactgcataactggcgaagtaaccaagattccatttggtgcacaaatcaccacgaagaaggacaacacagaatacctctatctgaatcagcttggtgatattcttggtcttacacgtaaggagattgtagaggttcatagaggtatggctgagcaagcttttagacagcaagcagaggtcattctggctgatggacagttgactaaggctaggatggagcaactggatgaggttcagaagcaagttggcttgccaccagagtatgctcaaaaggtgagagagaacattataaattcaaaaatggctgctgccatagaaacagctattggccaaggaaggctcagcataaaacaaattagagaactcaaggaagctggtgtaaatattgacaacatgatagcagtgagtttacgggagaatctcttcaagaagtctgtggatgagatattttcttctggtactggagaatttgatgatgaggaagtctatgaaaagattcccgccgacttgaaaattaacccagagaaggctaaaggagttgtccgcgaacttgctcgtagtagattagctaactcattggttcaagcatgtagctttactaagacagagaaaccgcagcggggtgatctccactcttaatgatctgctagcttgtgacaaggctgtgacagctgagcccttatcatgggaagtg

SEQ ID NO: 630 - DNA, 624 bp, Chenopodium album
ttgaggttgctgttcgtgacaatgctcaaaggctgtatgctcagagactgaaatcaattagcagagatctggatatgaagcagcttgttaatctgagagaagctcaactttcgtatcgtttgtctgatgagttggccgaggagatgtttaaggaacatacaagaaaactagtagaagaatgcatttcaagagctgttgacattctgaagtcccgtaatagagcagggggagctattgaggttgtaaatgagctgaatagagtacttgcttttaatgataagcttgtctcattaagaaaccatccagatgctggtaattttgcccgaggcatcgggccaatttccttagtagatggtgagtttgacagtgacaggaggattgatgacttgaagcttctctacagagcatatattactgattctttatcaagtggccgcatggaagacagcaagcttgctgcattgaaccagttaaagaacatatttggtcttggaaaacgtgaagcagaaagtattaagatggatgtgacctcaaaggtttatcgcaagctactgtctcaagcgttttctagtggtgatttggatgcagctgaaagcaaagcgaattatcttcagaatctgtgtg

SEQ ID NO: 631 - DNA, 569 bp, Convolvulus arvensis
aaatcggtttgccgcctccttatgctcaaaagattatcaagggcataactacttctaaactgtcgggagccctcgaaactgctgttggtcagggaaggctaagtatgaaggaaattagagaattgaaggaagctggagttgaattaaaggccatggtctctgaaagcttacgggaaaacctgttcaaaaaagcagtggacgatatgttctcatctggtactggcgagtttgatgaagaagaagtgtacgagaagttccctgtagatctgagtattaatgccgagaaggccaaaagggttgtgcaggaactcgcacgtactagattgtcaaattcccttgttcaggctgtggcacttctaaggcaaagaaaccagaaaggagtggttgcctcgctcaataacttgttagcctgtgacaaggttgtaccttcaactccattatcatgggaggtgcccgaggaactttccgatctcctcctgatatatctgaaaagtgacccagcacccgagaagctctcgaggctacaattatttgctagatataagtgattcaaaggcagacatgctaag

SEQ ID NO: 632 - DNA, 659 bp, Convolvulus arvensis
gcctatcttcaaaacctttgtgaagagttgcattttgatccacagaaagcaattgagattcataaagatatatatcagcaaaagcttcagcaagctgtctctgatggagaactaagtgatgaggatgtgaattcattgaagcagttacaggttatgctctgcattcccaagcaaaccgttgaaacagcacatgctgaaatctgtggcaatttgtttgaaaaggcggttaaggaagcaatatctggaggagtggatggatttgatcccgatataaggaaagctgtgagaaaagctgcttatggtttacgcttaaccagggaagttgcaatgtctatcgctagtaaagcggttcgaaagattttggtcggttacattcagcaggcccgaggagctggcagtcgcactgaagttgacaaaagaattgaaaaagatgatattatttaatagcttggttttgactcgactagttgctgatattaaaggtgaagatgaatcatctgattctgtgcaagaggaggagcctatcaaggaggaagagaagcaaacatttgaggaagaggaatgggaaactgtgcgatcacttcagagaataaaaccaaacagggaaaatgtaaagaaacaaattcagaccgagattactctgaaagatgaccttccag

SEQ ID NO: 633 - DNA, 3423 bp, Conyza canadensis
ccatctccgccttttcccccttttatctctttctctatcttccctatccacatttccacttctcaaaactcgccggacctccatcgccggcgtaaaaactcacaatctcaccgtcatgaatccgtcactcctttcaacacaacaacaacaaccaccttctatcctattcactccatttctaaaccccacacctctcaaattcactactaattcactcaccttcactcgccggcgccaccgttatgcttaccggaatccttccgtcaggtgctccgcttcatctcccgaccagccttccagtgccgctcccgtcaccgatgttttcggaggaaagaaggagttaacggcatttcaatcgatgatcgattccatgacgccaacagttaggttggctagctcagttgttgtagttgcggctgcggttgcggctggatatggattagggttgcgtatcggtgggaataagaatgttggtttgggtggagctgttgttttgggtgctgctggtgctggtgctgtttacgctatgaattcttctgttccagaggttgctgctgttagtttgcataattatgtggctggttcggatcctgggtcggttaagaaagaagatattgaaagcattgccagcagatatggtgttagcaaacaggacgaagctttcaatgcagagctttgtgatatatattgccgatatgttacatccgtgcttccttctggaggtgaagatttaaagggtgacgaggctgatattatcattaaattcaaaaattcactgggaattgatgaccctgatgcagcatctatgcacatggagattggtaggcgtattttcagacaaagattggaaactggtgatcgtgaagcagatgcagaacagcgtcgggcatttcagaagctgatttatgtttcaacactcgtgtttggagaggcttcaggttttcttttaccctggaagcgtgtgttcaaggttaccgagtcacaggttgaggttgctatacgtgacaatgcccaacggttgtatgcttccaagctaaaattagttactcaagatgttcagcctgaatatcttattagcctgagagatgcacaactgcagtgtcggctttccgatgagctagctgaggacatgttcagggagcatagtagaaagcttgttgaagcaaatatatctacaagtatggatgtactcaagtccaggacaagaactgccaaggacgccagacttattgtagaagaacttgataagatattagcattcaataatgcacttgtctcactcaaaagccatcctgatgcgagtcgttttgctcgtgggcttggtcccatttctttaataggtggcgagtatgatggtgatagaaagatggacgaccttaagctcctgtacagagcatacattgctgattctctatcaggtggccgtatggagaaagacaagcttgctgcattgagccagttgaggaatatctttggtttgggtaaaagggaagcagaatcaattgcaatagacgtcacctcaaaagtataccgtaaactccttgccgagtctgtaactgggggtgctttagaagctgcagatagcaaagcagcttttcttcaaaatctttgtgagcagttgcactttgacactgagaaagccattgagattcatgaagagatataccgtcaaaaccttcaacaatatgtgaaagatggagagcttagtgatgatgaggttaagtccctggagaggttgcaagttatgctttgcatccctaaacaaattgttgaaaagattcatgaggagatctgtggcactttatttgaaaaggttgttaaggaggctatagctgcaggagttgatgggtatgatgctgatgtccaacaagctgtaagaaaggctgcatatggtttacggttaacaaggcaggtggccatgtctattgctggcaaggcggtacggaaaatttttataagttacatacaaagatcacgggcgtcaggtagccgcacagaggcagcaagagagctcaagaagatgatagcattcaacaacttagttgtaactgaactcgtgtcagacatcaaaggcgaatcatccgagacgacctcagaagacgagattattgatgtggaagcaaaacccgtcgaagaagtagaggatgaagatcaagaatgggagtcattacagacccttcgtaaaatcagaccgacacaaatgacccaggggaagaagggtcaaacagatataactctcaaagatgaccttcctgatagggacagagccgacctttacaaaacctatttactctattgtttaaccggggaagttacaagagtcccgtttggggctcaaatcaccacaaaaaaggacgattctgagtatgtctttttaaagcaattaggtggcattcttgggctgactgataaagagattgtggatgtgcatagaagcttagccgagcaagctttcaggcagcaagctgaggtaatattagcagatgggcagctcacaaaagcccgtgtttcacagctaaatgagctgcagagacaagtcggattgccatctgagtatgcccaaaagataataaagaacataacgagcactaaaatggcagctgcccttgaaactgctgtgggccaggggcgtctcagtataaaggagattcgtgagctcaaggggtcagggattgagctagatgtgatggtctcagaaagtctaagacagaatctttttaagaaaacagtagatgatatattttcttcagggactggtgagtttgatgaggttgaagtttatgaaaagatcccggaagatcttagtatcgatgtagagaaggcgagaggtgttgttcatgaacttgcacgaactaggttgtcaaattctttgattcaggctgtatcgttgcttagacagaggaatgctaaaggggtggtttcttctctgaacgacttgttagcctgtgacaaagccgtaccagcatcaccgttgtcttgggaggtgactgaagagttggcagatctctttctaatatatctgaagagtgacccagcgcctgaaaagttgtcacgtttaaaatacttgttggacatcaatgatgcaacagcagaagcactacaagggatgaaagatcgagcaatgcctagtagtggaactagtgaagaggagtttgttttttgagtttttcctccaggttttaagagctataggcagacaggcaggtgttgtaggtaaggggatgagtcttccctgcagagtattcgattgttcgaatacgtatttgtttaaagattgtattgttcaccataggtaccgtaagatgtttgatagtatgtacattatgaaactggtttttgttggatttccagaactcagtaatttttgaataaacatgaatgccagtattgagttggctgatacatgtggatttaactacaaaa

SEQ ID NO: 634 - DNA, 2613 bp, Conyza canadensis
gactgactcaactaccgacaaaaatgaactttcttgacccgctgcccaatccgttcttttgccacctcattaatgaccaagttacttatcttacataaaatgggttttgttatatactttttccctaacatcaaattgatctcacgcaaaagattcttttgggaatgcattacatcaagattgcaacgttgctgtttttttcattataaagtatcaacatcaaatttggcccaacaaatttattgtgctattctcaaggagtatcttagatatctgatattgttatgcatttaagttgaaccacttgtcccttaaatgcaacattttttctacatgatgaatttgtatgctctacttattctatggtatctttttcgaaatgtcaacatgtatgtaccatttctctttttggcagtttctcatttcaaagattgcgactttatgaagtatgaatatcttggatagttgactaatagtaaaagcacctaaatctaatgctagaatgaagtttgtaatacttctagaaagtgttatttagttttgtgtggcatttgtaatgctagaatgattttgttttttcagcaaggacgccagacttattgtagaagaacttgataagatattagcattcaataatgcacttgtctcactcaaaagccatcctgatgcgagtcgttttgctcgtgggcttggtcccatttctttaataggtaccctgatgctctatccagagcaattttcgttccttcaaaacatagaggtggcaacatggcaggtcgggcaggttgggtaacatgtgaaaacgggaatggttcaaagtgtcactgatggctgggatgacccaaaaagtatatttgcctacaaattttgatttttgatttaatataaatatctgattaccagcattatgctttctcaattaaatttagtattttaagtaaaatgacctagaaggttgtacgcattacagataactccggctgagctttaaccatttgactcattttctttacatacctttttagttgaactttgaccagctagagataaacataacttaattgacccacttacaagtaaatgggtttaaaaatgccgcctctagtaaaatatcgtatttcttgtttattcattggtaacctatatcacttatgggggtaggtggcgagtatgatggtgatagaaagatggacgaccttaagctcctgtacagagcatacattgctgattctctatcaggtggccgtatggagaaagacaaggtaccaattaccaaataaactttcctgtttgggtcctattgtacatgtgattgaacttgtgaagtttgcttaaatgtttatggctcgacattttggtctgtcaaaacatttctgtattgtcctctcattcatgtgaagggaattaatgaaacggtcgagtccgatagaaatgtgacccatatatactggtggatataaactgggctatatatttattctacttttacataatgtttttttgtttcttgtgctccatagcttgctgcattgagccagttgaggaatatctttggtttgggtaaaagggaagcagaatcaattgcaatagacgtcacctcaaaagtataccgtaaactccttgccgagtctgtaactgggggtgctttagaagctgcagatagcaaagcagcttttcttcaaaatctttgtgagcagttgcactttgacactgagaaagccattgagattcatgaaggtagtgtgtgctgggaaactttcttttttatctatgtcatctctttgataattagaattgtaaagaactagtaggttgagtaacgggttaaaatgagttgtctcttgttacggttgaaaagggtcaggttgagttgatacatgaatactctttagcccgattcctattaatagtcgagttgttggatatgatcacaaatattaatgtttcactatagtaacgtcctttaaatagaaccatttaggatgtcacaagcctttaatatgcgtttcaggagactgttaaccccttcgacccgtttcttcttcagctgccttctgtttgacctgtaatcgactctttatcagtaaatgagtcgaacttgccaaatctactgagaatcaaggaaaagtctgtatgcataattgttgtgttgttctttacatcttggtcgtgaaactgttgtttaggttgacttgttaatggctggaagctttcgtattacaaaatattggtgtagttcttgcaatatccttatgcgttaatttgtaacagagatataccgtcaaaaccttcaacaatatgtgaaagatggagagcttagtgatgatgaggttaagtccctggagaggttgcaagttatgctttgcatccctaaacaaattgttgaaaagattcatgaggagatctgtggcactttatttgaaaaggtaattactttactgaatctttttatatatatgaccaatgtcgttgaaccgatcaaaaataaaactaaataccattaattagctagggcaagtagagtatcgtatctacagggaatcaagggaaagtgttgaagaattttacaaaattaattaaactagacatgaaacttaaaaccgattgattgat

SEQ ID NO: 635 - DNA, 2749 bp, Conyza canadensis
tcaactcataagaatatttttattatgtacaactcagttatatttatttattgatacaatcttaaaataaaattaaaaaaaaaatgcactggtctaaccactagttttttttacaaaaaccctgcctacacccccactcaccccccaacatttcatttccatctccgcccttttcccccttttatctctttctctatcttccctatccacatttccacttctcaaaactcgccggacctccatcgccggcgtaaaaactcacaatctcaccgtcatgaatccgtcactcctttcaacacaacaacaacaaccaccttctatcctattcactccatttctaaaccccacacctctcaaattcactactaattcactcaccttcactcgccggcgccaccgttatgcttaccggaatccttccgtcaggtgctccgcttcatctcccgaccagccttccagtgccgctcccgtcaccgatgttttcggaggtactgttttcattaaatttaaattaattaaagtaaatttaaaaattctacttagaagttgttataagtttgttacaatgaataactaactatatgtataatatcgtaagatagcattatacttttccgaaatgtgtatttaggtaatttaaaaaaaaagtggtcatatttgaataaaatttaacttttcaaaaaagagaaaaaaggtaattaaaatacttttatgttcattcaggtaattgtaactatatttgacctggctaaagcttgtttttatactatctaaatgtatatatgtattttaaaacaggaaagaaggagttaacggcatttcaatcgatgatcgattccatgacgccaacagttaggttggctagctcagttgttgtagttgcggctgcggttgcggctggatatggattagggttgcgtatcggtgggaataagaatgttggtttgggtggagctgttgttttgggtgctgctggtgctggtgctgtttacgctatgaattcttctgttccagaggttgctgctgttagtttgcataattatgtggctggttcggatcctgggtcggttaagaaagaagatattgaaagcattgccagcaggtttttgttttttcattgtctcaaataaataaaattgcttgcagtttatgctgtttttagattgcagaatgatgattttttggtttaagcaaatgaatattagtgcagttttgtgatgaactgaatgatatattaagagttgatctatagtttttaaaaggaaggatcagttatcatatatgtctgtgtaagtttaatgaaactgtatgtgactttcacattgggcaaaaaggcaatcatatatgaaaaatgacaaattatggatttgtttttatgattatttgaaaaacgagtttttgctgttcttatgggcaaacaaaaagcttatctttgggtgaatgttttgctgatttagtattgatatacaatacaagtcaactgggaaaatgactgtatgcaactgtgttaagcatgaatggttttgattttctggcaaaattagatgataagctagccggggatgagactagctaagaatatatctggaaaatagtatatattaggctagttgtctttctaatatatgtgtttggtaaaattagatcaaagtagctgatcttgtatgcaatgaggtgcaacgttttgtttattgtaagttaaagtttgtttattattttgtatcaaggataagaagcttggaacatgtatagattcttatcgttagttagcaaaagaattaatgaggaaaatattgagacttacttgtaggaacatagtgaacgagttgcggtcttttgtatacttggcagaaatccctgctagctagtgtcttgactgttgatgtttatacttctgcatttcagatatggtgttagcaaacaggacgaagctttcaatgcagagctttgtgatatatattgccggtgagtaacttttttttttttagtatgtagaacttttatgtgagtgactatgttcatctaatttctgatgtccactgcatgtagtttagtagaggctgcagtttgaacctgtatatgggcaaatagtttttggtttatgattgtagttaacatgtttaagggatcaaccatttaaaggaaatttttagtgtaagtaagctcaaatgtcaaatacaccaaatggttttaaaaacagccttaagcctacttaggtgcttattgcttacatcttccaatattgatttttcaaagagattggagtcatgattattaataccagattttgttgtcataatctcttaaagttttataaaggttaaacaaaaaacagactaaaagatttggctggtaaacttaattcgctttgactagtccgttttgtcatctataagctttctgattcttttatcgacctatcataataaagtttatacatctcttgacctatcaagtcttttcacacttttatcagtttcacacattcccccctggtaatgcaaaagaattcatggaaacttattaccattttatcattctattcatatctcagatatgttacatccgtgcttccttctggaggtgaagatttaaagggtgacgaggctgatattatcattaaattcaaaaattcactgggaattgatgaccctgatgcagcatctatgcacatggaggtactgtttacaatgttgatttgttgatgaataatttggatgaagggggagaaaaagagaaggggatgggg

SEQ ID NO: 636 - DNA, 2077 bp, Conyza canadensis
ggggtaagctgtcttatttcaagatgcactgatctttctcttcaccctttgtatatgttcaacagattggtaggcgtattttcagacaaagattggaaactggtgatcgtgaagcagatgcagaacagcgtcgggtgagttacctttcaattcgctactgaataggatggaagttcatcaacgtttattactgcatatgacttgcgttggtatactaaaaagttctagataaaactttttaataattgttaagcattaagagttcaaatgtttgtatacaaactaacaaaagaactatagtttgaccaaaaaatgtttgtggggcagcccaacccaaattgacttgttactgccccaacccgtattgaacctgtacccaaccagctgatccttagaattagttggctaagtaaagatacagagctttatcattgttgggggtctccagtgcaggcatttcagaagctgatttatgtttcaacactcgtgtttggagaggcttcaggttttcttttaccctggaagcgtgtgttcaaggttaccgagtcacaggtatcatcattgtcattgttaattcaaacatataacagtgtggcttcgtaaatttacaaacttattaagtaattatgtctatgttcgaaagcagctcatagatttttggctgttggtaattttctgtccatcaggttgaggttgctatacgtgacaatgcccaacggttgtatgcttccaagctaaaattagttactcaaggtaaggctgtttcgttgattatattgaactttcatgtcaactatataatcatgaactagtaacatgtttagatgtggacttcggaagtgattataagttattcaatagtttaatttagatactcagctgtataacttacagatgaatatcctgtttacagttagtcacatgctgagtgtgtggcttgaaaattcatggcatagagaattatgaagataggtgtttataaaatgagtcatgagagtaaaagcctctaaaatttgattaggtaattttgttatatttttagttccacctggtctttaactgatcattctaaactctagttatatgactccgacatgaatagattataagaagcaactccatccatccaagcatcaagaattgattagctgcttcatatattgtttattaaataatcagttctgaaatgcaaatccatatacctcaatggtatataagttatgtcttctattttacttgacaatctactttaagcaacaatagtttgtgttctaaaatattacatgtactctgttaaaatataatttcccatacatatttacctatgtttctgttgcatctcttagatgttcagcctgaatatcttattagcctgagagatgcacaactgcagtgtcggctttccgatgaggtaagcattttaaaggtcattaatgaatacatttgatgaccagttgtagtgttctaatgattgaattggatttctttcagctagctgaggacatgttcagggagcatagtagaaagcttgttgaagcaaatatatctacaagtatggatgtactcaagtccaggacaagaactgcgtaagttatattggtgccttatcagataatatttgatatagatgtgacattcttgacttgtgaattattcggttctgttatggtttgcctctaatggctcaaatgggtaaaataatacaaattggtttagaggaaacaagttgaatttcatatgaagtgaaatttatatgaaagattagattattattgaagtcatagtattttttgtaattatattggacacactaattagatatagaagttctaatgtttctggactagaggtcttactgacttaagtccaggacaagaaccgtgtaagtgatattggtgccttatcagataatatttgaaatagatgtgacattcttgacttgtttgcttgtgaattagtaggttctggttttggtttatggctcaaatgggtaaaataatacaaattggtttaggaaaacaagttgaatttcatacgaagtgaagtttatatgaaagaagattattattgaagtcat

SEQ ID NO: 637 - DNA, 3600 bp, Conyza canadensis
tcttgacttgattcttgactttgcttgacttgtttatgatccatttaacttcaatttgtcaccaaagacctgaaacacttaaacaaacataaacacgccctaatcgtctattaacattcacaaaacatgttcgttttcatactttaagattagacgacttaggcgtttatcaatataccttgagtttccatgtgcatttgttttttatgggaggctaatgaacacagatatagcttctccgttaaacatttaatgtttggattgatttgtggtttcaactttagagtgatatgttaattgtttatcaagtacttcgtatctaaattacccttcaataaaggagaacaaaaggaatattacaggcccaaatcataataggcaagtgggtgatttaccaattactatagaatcttacctagaaattaactattggagttttcaatggataggttgatgccaatttggagtcggtggttttttgtggttcttttttaattatcattttcgagtgagtattattaataaaaaaaggatttcaggttgttaaggaggctatagctgcaggagttgatgggtatgatgctgatgtccaacaagctgtaagaaaggctgcatatggtttacggttaacaaggcaggtggccatgtctattgctggcaaggcggtaagtccttcatggcagttgtattattagaggttgtagcttgagtgggttggtggtcagaataatgagtaaaattaatgcagattaggcctggaacatatttttccaaatatttcaaattccattacagagatttaatgtgcagtttttgttgttatgtaaaacagtaaaagacaatccgtttattcaatacaatgatttagaggagatttcatgcaaaagttaaacgtccttacatttgacccatttgatgtgctttcttttaactagttattttattatagataaaacgtagcaccaattgacctatccattacccagtgaatcaaagtcatcaccttttattttctgtagctgtgtacagttcatattcaagttttgtgactttgtcacattatgacattcttttgtgcaggtacggaaaatttttataagttacatacaaagatcacgggcgtcaggtagccgcacagaggcagcaagagagctcaagaagatgatagcattcaacaacttagttgtaactgaactcgtgtcagacatcaaaggcgaatcatccgagacgacctcagaagacgagattattgatgtggaagcaaaacccgtcgaagaagtagaggatgaagatcaagaatgggagtcattacagacccttcgtaaaatcagaccgacacaaatgacccaggggaagaagggtcaaacagatataactctcaaagatgaccttcctgatagggacagagccgacctttacaaaacctatttactctattgtttaaccggggaagttacaagagtcccgtttggggctcaaatcaccacaaaaaaggacgattctgagtatgtctttttaaagcaattaggtggcattcttgggctgactgataaagagattgtggatgtgcatagaagcttagccgagcaagctttcaggcagcaagctgaggtaatattagcagatgggcagctcacaaaagcccgtgtttcacagctaaatgagctgcagagacaagtcggattgccatctgagtatgcccaaaagataataaagaacataacgagcactaaaatggcagctgcccttgaaactgctgtgggccaggggcgtctcagtataaaggagattcgtgagctcaaggggtcagggattgagctagatgtgatggtctcagaaagtctaagacagaatctttttaagaaaacagtagatgatatattttcttcagggactggtgagtttgatgaggttgaagtttatgaaaagatcccggaagatcttagtatcgatgtagagaaggcgagaggtgttgttcatgaacttgcacgaactaggttgtcaaattctttgattcaggctgtatcgttgcttagacagaggaatgctaaaggggtggtaagtgtaaactagagtttcctatttacctcttaatctaacctaatttgagagacgttcgctcccatttatcaaaattttgattatccaattgttccaacttcaatcaattgaaacacataagtactatcatctaccaatttcaaacaataatgcccaatgtgcacaaaagttgatgcagattcaaaatttaccaaaaataagcttatgtttctaggctatccaaaataaaaaattatatatgttttgagaaatcagagcccgtctgtttattttgtatatttagtttatacaagaaacttttgattctcttattcgtttggttttggacatctgctcttacaacatggaataattgaaccataatattctctaattcggcaatctttgaattgagtgtgttggttcattttgggccccacgtttttttaaattctgatgaacggcgttcttataattttttgcgatttggatacaggtttcttctctgaacgacttgttagcctgtgacaaagccgtaccagcatcaccgttgtcttgggaggtgactgaagagttggcagatctctttctaatatatctgaagagtgacccagcgcctgaaaagttgtcacgtttaaaatacttgttggacatcaatgatgcaacagcagaagcactacaagggatgaaagatcgagcaatgcctagtagtggaactagtgaagaggagtttgttttttgagtttttcctccaggttttaagagctataggcagacaggcaggtgttgtaggtaaggggatgagtcttccctgcagagtattcgattgttcgaatacgtatttgtttaaagattgtattgttcaccataggtaccgtaagatgtttgatagtatgtacattatgaaactggtttttgttggatttccagaactcagtaatttttgaataaacatgaatgccagtattgagttggctgatacatgtggatttaactacattcaaggattttgggtcatgtaagattgttactaggggtttgtaatacgtgacccaggtccataagcccgaatagttgacctgaaagtctgaaaccaccttcggttcagaactgaactgaactgtatcgttccaattttatcggatgtcccccatgggacgaactgaactgttatctatttatcgtctatgtgtgaaacaggctgtctgttagttccgtactcgtaatctcttacgttcaatataaaaccaagtatgtgtttcattaattgttaggtgtggctagtctgattctaaacataagttttgcgacgtctttaaaccaaattaatgtccatgtaggttctcggtgctcttttggaatttgtgaattgtgatagtattgacaattggtgcacctatatcatatctatatctataatccattaataaccaaattaccccactcccttttaacacatttacctttaaaatgtcttttatggccttctaatttacattaccctattttttctctatcacgctcattacacacacatacgttcatccgatttccgatttt

SEQ ID NO: 638 - DNA, 608 bp, Cyperus esculentus
gcgcgaggaggtcgagggcgtcgcaaagaggtctgaactgttctgcgtttaattgcagaagaacaagctgtggtgttgttgagctttatgttctaataatctcattctgtgctctgtttattagttcttaatcctatatatttttttattcaaaatatagatatggcatcaataagcaagatgaagccttcagaatcgagttatgtgatatctacagcaggtaaaagttgcaacatattttaatctcttctctcttatacttcgtgactgcatacgtcccatgaacatcaccaggattttaaagtttttctgaatatttgcaggttcgtttatgcagttcttcccccaggtggagaagatttgaagggtaatgaggttgagacaatcataaaattcaaagctgctcttggaatcgatgatccagatgctgcgaatgttcatttggaggtactatttgtattttggaaaatgtgttaattgtctcctgaattagaacttcgactttgaataatatttaggtgaatttacatttaaatatatatattataatgcagattggacgttgcatatttagagagaggttggaaacaggagatcctgattctgat

SEQ ID NO: 639 - DNA, 10038 bp, Cyperus esculentus
  unsure (1)..(10038): unsure at all n locations
accctaaccctaaccctacctcccccgatggacctctccctcctcctcctccacccttcccctcctctctccctccgcctccctcctccccctctcccccgccgccacctctctctccgccgccgcaaggtaatggcctcttcaacctccgtgtccgcctccacgcacattacttcctccgtcttcgggcccaggagggagctcacgggcgtccagccggtcatcgagggcatgtccccgcccgtccgcgtcgccagctcgcttcttctcgccgcggcggcggtcgctgcggggtatgggttagggtttaagattgccggcagtaagaatgccgcttttgctggtgcggcggcgttggggttggccggtggggcgatggtgtataaaatgaacgccgaggtgccggaggttgccgccgtgacgcttcacaatctcgtgctgggtcacgaggacccgctcgagttgaagcgcgaggaggtcgagggcgtcgccaagaggtctggatttgttggaattgaagtattgaactgttgtggctttaattgcagaagaagaagctgtggtgttgttgaactttatgttctaataatctcattctgtgctctgtttattggttcttaatcctatatatttttattattcaaaatatagatatggcatcaataagcaagatgaagccttcagaattgagttatgcgatatctacagcaggtaaagttgcaacatattttaatctcttccgtctaatactaggtgactgcatacatcccgctgacatcacctggatttaaaaattttgctgaatatttgcaggttcgtttatgccgttcttcccccaggtggagaagatttgaagggtaatgaggttgagacaattataaaattcaaagctgctcttggaatcgatgatccagatgctgcgaatgttcatttggaggtgtaactatttgtattttggaaaatgtgttaattgtcccctgaattagaactttgattttgaataatatttaggtgaagttatatttaaatatatattataatacagattggacggcgcatatttagagagaggttagaaacaggagatcctgattctgatgcagctcagagactggtattcattttttccccttactgttatatagttttgattcgcgtttacatatggtggtgttcttaataattgtccaaataaaaattaacaggcatttcagaaactcatatatgtgtcaaatcttgtctttggagaagcatcaacttttcttttgccctggaaacggcttttcaaggtcactgattctcaggtaagtattatttgaagggtgctcaatttcagttgtattatcactatatactctggttagatttcatctctggcttgccccaatttgtctgggactaggggctttgttgatgttgttgcttttcaaggtcgcctatatatagtggaccccaacatgattgggactaaaggctctgttgttgttgtctgtactctgtagagtcacctaaattcatgttattgagaattgatccattttacaattttcaagtccgtccttgcatggatctgtctgcttatgtgataattttttcttaggttaatatagctatccgagagaatgcaaggaaattgtattctataaagctcaactctgtgggaagaggtaataacatttcattctaagtttctaacgatattcagttctcttgttcttttttttttaatatgcaaatcctgattgttagcactgttataaaagataattggttaatctatagcaccacccaaaacaaatataggatgttcggtaaatatgaacttggatttgcttctagcttgatctatataggataattttattatttgaaaataacaacaacctttatacccccacttgtattaacagagaagtaaaggataaactaaagttattggttggtttttgtatataagaatcagcaaaggataaatggagaaaaagaagaagaataaagtagtcattcttcttttctgccagattagcccatgaattttcattttgctttgctgatattatgtggtcgtatgaacttgtcacacctgcctttcttttgttgggctttgttcctctcctgttgttcagaatacattggatggttgcaggtagttatggacctttcatttgaaatcagacaatctgaactggctattatgatgtttgaaatataccgcttagaagttaagagtctcctgggatcatccagcgaactctgtacattagagaagaatccaatttctgcccatattataacaacaaatctttcccggcccatttaggagaaataatgtatttttgtctgttcattttgttttattcagatgtagatgcaaatcagcttactgaattgaggaaatctcaactactttacaaattatctgatgaggtacaccgcatatcaaataccacttcctttaagaaaattactgcctgagttataacattgcaccccattattctacagatagctgctgaaatgttcagagagcatactagaagcttagttgaaaagaacatttctgaagctttaagcattttgaagtctcgctctaaagtcgcgtatgaattctgtgacaccttttagatattatattttatgtttagacattggtgaataacttttgtttgttttgttttactcgtacagaacagggatgccacaagtgactgaagaactggaaaaggttttggcatttaatgatttactgacagaactcagcaagcatccacaagcgtctcaatttgctcctggggttgggcctgtgtctctaataggtaaattaggatgggatcttccatcatgtgtctgaaaaccatctgctagtttctttttcaacgttgaaatatagactgatgggatgatgtcataatcttgctgtgtatatatatttgataggtgggcaatatggtgctgaaaagaatcttaaggatgcaaagctcctatatcaggcatatgcgcttgaatgtttccccgatgggcggcttgataagattaaggtattataattttatcaataataattatattaataatttatccaattataaattaaaccaaagatcaccaaatccatttagttggtacctgctgatgttgtttattttttaaatgtacaaaaatgcagattaataaattgaacaatttgaggaacatactagggttagggaagcatgaggctgaagccatattgctagagattaagtcaactgtgtataaaaagaggctctctaaagccttcaataatgagctagctacagcaccaagcaaagccgccttcctccaggatttatgtgaagaattgcaattccatccagaaaatgcgagcaaattgcatgaaggtactttataccattttctgacgtgctaatactttgtcagttgcttattgtgacattttaagaggagtatctttgagatatatgcagagatatacagacagaagattcagcagctggtagctaacaatgagctgagcaaggaggacgtggatacattgacgtcttatcaagtacgactttgcatacctcaatcaactgttgatgccatacacaatgacatatgtgggaaactatttgcaaaggtaatatctttttgctcttattaataacacattctatgatcttcatggtttttcacccaagttctaagatggaatttctttgaaggttgtggaaaatgcggtctcctcagggattaaagggtttgatgctaatgcaaggtccgctgtcaggaaggcagctcacggattgcgattatccaaggatgaagctatggccatcaccgataaagctgtacattacctgcaacttttggcctcctcttacatcacccattttctgctatcaaagttgatgaacttgtttcccttttgtttcttttttaggtgcgtagagcactgcttgtttatatccggcgcgcaagagcagcaggcaacaaaattgagactgcaaaagagctaaaaagaatgattgaattcaactcatttgtggtgactccactaatcgctgagattaaaggggagccagtagctgttaccccagaaactgaacccaaatcagaaataaaaccagaaacaacagataaaactgaagatggagatgatgaaatgaaattgttgacggatttgaaggaaaaaagtcccaaaaaagctgcagaaaggaaggcttcattgccattccagaaagaaataaccctaaaagaggatgtcccgtaccttgacagagctaacctatacgaagcatacctacactattgcatgactggcgatgtgaccaaaaccccatttggcctcaacctagcaaccaaaattgctgatgatgagtacacacgcctcgacctgttaggtgacattctaggactgaactctgatgaagccaaacggattcgtgtaagcattgctgagaagtcatttgttaaagaagctgaggtcatcttagctgatgggcagttgacaaaggccaagatggaacaactgtcaaggttacaaaatgatgtgaaattacctgaagagcatgcgcagaaggtgatcaagaacataattcgtaacagaatgacagcctcactcgaggccgctgtgaaccggggtcgcatggggctgaaggaggtgcgtgaattgaaggaggcaaatgttgacatcaaagacgtcatgtctgaggcattgagagagacaatcttcaaaaaagcagcggaggaggccttctcaagcggcaagggggaatttgatgagactgagatgtatgataaagtcactgaagaattgagcattgataaggagaaggcaaaggaggttgtaaaggaaattgccaaggctaggcttgggaatgctctcgttcaggctattgctcagcttcggcagaaaaaccaagatggagtggtaagttggtgttttgtggaaaacgtgttcagaaatattaatagacttttatcgcaaaattgaagtgcacatgctcaaatgactgcaaagcgtctgaaaacttaattaggactagatgaagagagcattttcttcagttgaatatatttattaaatataaataggtgtaccttccaaaaccctgattaaaaaaagttaaatcaaagacgttttttcaaaagtgagaacatatattgggttcgaaaaagcaaaggcaatttttttaaaagcatatcagttttgccagtacaagttgctattgagctaaattatgagaataagagctggaaatattctaatatttgatatggcctcaatataactgtgatatctgttgcattctgtttgcatgacagatgaagtcgttgaatgacatgctagcttgtgacatggtagcaccgtctagtggggctgtcccttggtcttcccctggcgagctggatgacctttactgcatctacttaaagaccattccaaagcccgataaactttcaagacttcaaaagttgcttggaataagcgatgagaaagctttctcacttcaagatgctgcaagggaaggtactctgccgattgcatctgctgaagaagaggagtttgctttctagacctttgaagaaacaattttgctagctggtattagttgctgtgttgtatacctttgtttgcatgtggttctcgaatagtgtctccgcaggtgtcatttatgttgtttctagatgtataggattattattgttaaagtgttgttcaaacatcttctatttctttgatgtaataatccggcttgccgagcttctaaatgagagtttaaatttaatattttgttttctcaatttcctgtccgcattcaacatgggtctcttgtttgggactagagctgaacttaatttgatcggtttaagcgttgcaataatcataatgatgttttaaacgttacattaaaattttattaacagtaatgatttattagcttaacgatactgcagtgatcacaataaaatgtacattccaaatcgacttaaaaataaaattgtatctatcttatgaatttgcggttcgtatctctggaactgaattgtgggcaaataaaactaccctcccccggacaagcatacattgttgagttttcatcatgcaattcagaacctccaatgctaatttatatctgcaatacctaaaccatgtcattaacttgttcaatttgttcgtaataaacgtaagccatctcaataatttgacaatcttataaatcttaacgggacctccaaataaatttgaaaaaataaattacagacgtcctccatcttagaaaattgtttacattttaacgttcatacaatatttggttatttgatgtttcatcatatatcattattattgtcaaaaatctgtgcgctctataattattgatgagtcgtcaaatcgcactcaagttgcacataactataaacatcaaagataaataggtgatgtgttaataaacaacaatatatggtcaaattcaattggaagatataccgctctacatcacatgcaatatgcacattaccatttccatctgatcacaaattttacatgtaagtcggcccttgctatccatgaagctaaagccacctcaaagctatccacgttcagtagaacggtatgacattcttttgcctagaaatggaaatcgaagtaattggttcagacattatccggccagaactccctaaagaaagctctcttaaattccttttcctgcattaacttttcctcctcttgcagttttcttaatctctttgttaccagcttatctctctttgtagatttcttcgctttcattcacctaaaaaaaaaaaaaacatacatgaatcaattttacaacaacgagccaattaatcctctgatgacaatcattgtaatataaccacggaatgcataaaattttaccatgataaaaatagtgatgattcaatcatattattatcacaacgaacctttgttttaggagggtctttctgaacttccggtattttcttttttctatctgcgcctaaaccgcgtttgttgttcttcacacgtgtctccagtggttccaatcttccctattaaagaaaggtgaaaaccatcacaaagataatcaaatatccaacaaaaaatcagttacactataccatgaaaagcattgtggaatttattttttaacatacataatatggacataaaaaatgtcaactagaagtaaagaatatgaatcataactagacaaacctagtgggacactaatgaagagacgtcacttttatgtaccataacaagagagttcctagtatcccaaagagtagttctcaacgactagcattaatttcaggattgattttttgatttattcatgaatgattccaaattgaagtctgtcagtcaaaatctctcttccattgtatattcctattggcaagtgattttcttatcatatcttatctgtatttcctaacatttatgaaaattcaccgtattctacaactctatatttcccaattatatgagacttccacgaattagaatcaatttttacagagttccagtctacagctagttatttgtattattattatcgaagaatcttaaagacaaagtgaaataggaaaaggattttttatagaatgcacctaaattgcaaaacccatttgcttactaacatctcgatctaattacaccggcaaagaaaacccgttccaggagtcccacccaattttcatcaaaacattgttgtcacttcgaacgaaaaacgttaaaaatatcgcattcatcgagcacacgagcccccgaaagtaaacaattatccaaagtggcaactgaaggagcataccctaatactggtaaaaacaattatgtaccagaaatgcaatcacagtatacaaaataacactttccctaatatcaatcacaaaattcttttcaataattcctaaaaagaattcaattataacacaattaattagtgcgcaaaccgaaccgaaccgaacctgctcagccnccccgagaccggtgccttccttccatccacacttcttcagcagctgcacagatcagaaaatcatatttagagggagtaacaaatgatcaatcaagaaggacagattcaaaccctaataaattgggaagcaaaagcaaaagcgcgcaagcagaacggaacgggaacctggaatccaacgttggacgaatcgatggctctcgggctgcatcccacctccgcctccatctccatctcccccttcttctccccgatgattttactgcaaattcccccttctctcttgactgactcggcttttttttttgtgatccgattcgattcggcgagtccggtccgagtccgaagacggacggagggaccatacaccgcgcggaaagcaaaacgagtcggagtcggtgggaggaaatggacccgaatcgaaagagaagagaatagaaggcccaatgggctgactaaaactatgaattggcccaaatgggagcatgcatttatctttgatcaagttctgttcaaccaaaatgcgtaaaataaaatgtaattgtaatgattttttttatttttttcgcttgcagctaagttataatgcagattgacctcaactgaattccctcttcatatgtcctccgattatttcctttcttgaagttacacttgtaccatatattcattctgcattgttaatctgcactttctattgagtttcttaattgcacaacagaccttatagttactccaaacatcggtagtctttgaattaatcttcttactatggtactgcacaaataattaagttatgaatattgcagttccaattctttccaaaatatataaatcttttagcacaatttagtggttcagtaaaactcaatctattaatatttcagctgttaaattcaactattacactgtatgtaattaagtgacagaaaaagttgctgatacacaccataacacaagccagcaaaccttatttcatatctttgtaatttattcatttcctatcacaaacttttatattaacttctatcttaaatcatttcccgtacttggccttgtagtcgctccacagttggtcgaccgtcttcccgagcagctgcatgaagaagtcgttactatacccgtccttcatcttcgcgttaagttgcgcgacaaagccgcttttgagcccgttgcagtagtccaagaaatgtgcggtcacgtcgtagccctggtcccaacggtcaccctggcctggcttcacccagtgacccggtgcatatcccgccttcaacctcacaaaatcagcaatacctgaaatttcatagtataattaaattataaaattacaagaatcagtttagttgcatgtttacaaataagtaccttcaatcaggccaccgggggcattgccttgtccgttccactgccacacatgcgtcatctcgtggtacagcacgccggtaaactcggtcttgacattgccagaataacccgcgatgtaacttgcactgacatggatcccgttgttgctcgtatacgcgacgccgtccattgactcaacaacaagggtaacaaggttgacattcttcctgtcggccggctgctgcttgaatgtgttccatatgaagttggaggaactggacatgacttgtttggtgtacccaacaccgatttcccggtcgaaacggttcccgccggaagtgcccttggcgttgttgcttgcttggaactggacagcatttgcagtagcggtgctagatgctaaaacagctagaactagaataggtgcaatcaggaagagagttctcatgattctaactactgtttccttaattcttgctgaaacagaatgtgaaattctcagtggaagatgagtgaaatttcagtgaaattgaagagcttatataatgcaaagaaattaatagtggtggacaggatagattagataaggatcgtctttttgacttggttggttagtcaactgactttgaccaggtacaatttgttgaatggtcggttaattatttacttcacgccatgctgcaatgaccccaaaaaaaaaaaaaaaaaaaaatgggaatta

SEQ ID NO: 640 - DNA, 489 bp, Digitaria sanguinalis
agttagtacacaggatgcagccttcaaagcagagctctgtgacttgtatgccaggtatgtttactcagtacttcctccagcagatgaagatctcaaaggtagcgaggttcaggctattataaaattcaaaagagctcttggacttgatgatgtagatgctgctaacatgcacatggagatcggtagacgcatatacagagagaggctggaaacaagtgaccgtgatgctgacatggaacaaaggcgggcatttcaaaagttaatttatgtgtcaaatcttgtctttggagaccaatcagtgttcctacttccatggaagcgtcttttcggggtgactgattctcagattgaaattgctatgaggaaaatgccaagagtttatactcgtcacagctcaagtcaattgggagaggtcttgacataggcacgctcattgatgcaaggagagctcaacttgcatataaactttctgatgagattgctgccgag

SEQ ID NO: 641 - DNA, 805 bp, Digitaria sanguinalis
aaccggtgaagtgacgcgggtcccatttggtgctcaaataaccaccaaaaaagacgattctgaatacgcttttctaaaacagctagggggtattctagggttgaccgataaagaaattgtggaagtccatagaagcttagctgaacaggcttttacacaacaagctgaagttatattagcagatgggcaactaacaaaagctcgtgttgcacaattaaacgagttgcaaagacaagttggtttgccatctgaatatgctcaaaaaataataaagaatataacaagcacgaaaatggcagctgctcttgaaactgctgtgggccagggtcggctcagtataaaggaaatccgtgagcttaaagggtcggggattgagttagatgtgatggtgtcacagagtttaagacaaaatctttttaagaaaacagtggatgatatattttcttcaggaactggtgagtttgatgaggtggaagtttatgagaagattccagaagatcttggtattgatgctaacaaggctcgagatgttgttcatgaacttgcacgaactcggttggcaaattctttgattcaggccgtatcgttattgaggcagagaaatacttcaggggtggtttcttctctaaacgacttgttagcctgtgacaaagctgtacccgcctcaccattatcatgggaagtgcctgaagagttggcagacctgttttcaatatacatcaagaatgaccccgcgcctgaaaagctgtcacggttacagtacctgttgagcatcgatgatgcaaccgcagaagcattgaaagag

SEQ ID NO: 642 - DNA, 520 bp, Digitaria sanguinalis
ggttttgggtgctgctagtgccggtgcggtttacgcggttaattcgtcggttgttccggagattgctgctgtgagtttgcataattatgttgctggttcggatcctggggcggtgaagaaggaagatattgaaaacattgctagcagatatggtgttagcaaacagaatgaagctttcaatgctgagctttgtgatatatactgccgatacgtgttatctgtacttccttctgatggtgaagatttaaagggtgatgaagctgatattattattaagttcaaaaattcattgggaattgatgatccggatgcagcagccatgcatatggagattggtaggcgtattttcaggcaaaggttagaaactggtgatcgcgaagcagatgcacaacagcgtcgggcatttcagaagctgatttatgtttcaacactcgtgtttggagaggcttcaggttttcttttaccttggaagcgtgtatttaaggttaccgaatcacaggtcgaggttgctataagggac

SEQ ID NO: 643 - DNA, 1111 bp, Digitaria sanguinalis
aaatttacagagagaagcttcagcagtttgtagctgatggagagttgagcaaggaggaagtggaagctctgatggcattccaagtgcggctttgcatccctcaagaaactgtggatgctgttcatactgagatttgtggccaattgttcgaaaaggttgtcaaggaagccattgcatctgttgatgggtatgatgctgatagacgagaggctgttaggaaggcagcacaaagtctaaacttgaaaaaggaggctgccatggcgatcttcggtaaagcagtacggaagttgttcctgacctatattctgagagcaaaagaagctgcgaacaccattgaaactgcaaaagagctgaagaagctaatttcgtttaacacggttgttgttagcgagcttttagctgacattaaaggagagctgtctcaaactgctgaaactgaagcatcaagcacagcctcggagtctgagggagaggatgatgaatatcaatgggaatcattggcgacattgagaaagactagacctgataaagagcttaaagaaaagctgagaaagtcaagccagaatgagataaccctcaaggatgacattccattgagagacaggactgagctgtatgagacatacttgaaattctgcatcggtggggagacgacgaatgtatcatttggaacagcaatctccacaaaaaaagatgattcagagtttttaatgctaaggcagttgggtgacatacttggtttaactcgcaaagaagttcaagatgttcacattaagtttacagagaaagcttttgtgcaacaagcagaagtaattcttgctgatgggaaattaacagaggccaaggctgaccagctcgcgaagattcaaaagcagtttggtttgcctactgaaaatgcacagaaaatcattaagggcatcacaaccacaaagttgtcttctgcaattgaagcttctgttgctcggggtcagatcggtatacagcaggtcagaggattgaaagacgcaaacttccaacttgatagcttgatttcagaaccactgagggaaagcatttacaggaaaactgttgaggagatcttttcatcgggcacaggtgattttgatgaaga

SEQ ID NO: 644 - DNA, 991 bp, Digitaria sanguinalis
gttcactattctaagattcatattcaaatggtcaggtacggaagttgttcctgggctacattcagagagcaaaagaaggtgggaacaccattgaaactgcaaaagagctgaaaaagctaatttcgttcaacacggtggttgttagcgagcttttagctgacattaaaggagagctgtctcaaactgctgaaactgaagcatcaagcgcagactcggaatctgagggagaagatgatgaatatgcatgggaatcattggcgacattaagaaagactagacctgataaagagcttaaagaaaagctgagaaagtcaagccagaaagagataaccctcaaggatgacattccattaagagacaggactgagctgtatgagacatacttgaaattctgcatcggtggggagacgacgaatgtatcatttggaacagcaatctccacgaagaaagatgattcagagtttttaatgctaaaacagttgggtgacatacttggtttaactcgcaaagaagttcaagatgttcacattaagtttacagagaaagcttttgtgcaacaagcagaagtaattcttgctgatgggaagttaacagaggccaaggctgaccagctcgcgaagattcaaaagcagtttggtttgcctactgaaaatgcacagaaaatcattaagggtatcacaaccacaaagttgtcttctgcaattgaagcttctgttactcggggtcagatcggtgtacagcaggttagaggattgaaagacgcaaacttccaactggacagcttgattgcagaaccactaagggaaagcatttacagaaaacatgctgaggaaatcttttcatcaggcacaggtgattttgatgaagaggagatgtacgtaaagatccctgccgatctcatcataagtgctgagaaggccaaaacaattgttcaggatattgcaaaggttaggttggagaactccctcgttcaggctattgccttgcttcg

SEQ ID NO: 645 - DNA, 244 bp, Digitaria sanguinalis
aaggaggaagtggaagctttgatggcattccaagtgcggctttgcatccctcaagaaactgtggatgctgttcatactgagatctgtggccaattgttcgaaaaggtgatactgaatagttctggttgcgccttttgttcaactactctgcatatgtttagatttccttccatatcttgtagcaaagttgatggcttgttttatatcggtgttcttaaatctgtttggacattacaggttgtca

SEQ ID NO: 646 - DNA, 3213 bp, Digitaria sanguinalis
gaccttctgtaaaatgctataccacacttgcctagagaagacacatgcggctagcagatggtcaattgtttcttcagcttgatcacatagcgggcagcattcagggtgtggcaaacctcttctagccagtccaacatcgattatgtgctactaaccacataaagaacttgcatttgcctggggcccaactcttccatattctctcccatggtccaaactgaatagccccagtaaaaaatccctcatatgcagatttagcagtgttttacttgattaaatttctacttgtttgtgaaaaaaacaacttgatcggaattaggatcacgccttaaaattacactacgagatgtcacaaacttgatttagtaacttatatggttcgttctaattggcactattaggtggcataactggcgttttgctacttactgttcactgcatgctgcctcctccatcccattaccattttaccagttggaggcatgaagggtgctgcaaacatttgcaagaaaagggaataactacaatcttctagctattgactatacagcaaggatcaattagtctctgaaggtttgaatgtttttaatcatactaggtgattgaggcaactaaatatcagttaccaaaacagatgtgcaattaccagctgcccaagttgatgtgtacgctggtgtatattgcgataactgccacccataggagggaggtttgaatgtttttaatcatactaggtgattcaggcaactaaatatcagttaccaaatgtgcaattaccagctgcccaagttgatgtgtacgctggtgtatattgcgataactgccacccataggagggttgataacatcgcttgaaggggttgaaagaggtactagaccatggattgagatgagggaactagagtggtccagagatgcaaatagagtactatcttactttcctgatactgatattcagtgtacgcccttttatagtggacattcttgctcctttcctagctgtttactctgatataacttccatattctcatgattctgttatttgatacaaatcatgctctctgaccaactaaaatagtacgtctattctgctgtgagagcgtccaacatggacgccactctcctagaatccttgttgttgttggacgtggactttacatgcgtattaaggtgccagatgctgctgtacttgttggcttgttgcactggccttcccagctttgcaatgcgggcactggaccgctgttgtgctttgttctcttaaccattgatccacattttcatcgtacattcctactgtgccaaaagctaagccctcatttgatttgatagagcttttgagcctgcttttgcaccagcttatgcccaagctctaccaaacgcaccaaagcaaaaccggcttcaccacacaaactggtcagaagttgatcaggaaaatgaagtagcgattgtgagcccaaaaaactggcttgcccccggcttcaccatgtccctacagtatgaacctatcatattatccctaagtctgcgataatcaccaggaaatgccatcgtcttccttctcgcgtctctatctcgtgactagcggcggcgagtgttgtggtggccggcgagcaaaacgatgaaggaaggattggagccattggagcctaccttggtccggcgaagcagcgccgtgcagatggcacttgttcaccgtgggctccagaggtggtgcggcaccggggaggagatgcagcagcaggggaccatcgctggctcaggcgtgggtgcgagcgctggcaacccctggccttggggtccggcgctagagaaaggggaaaatgagaacggacaagaaggaagggagaaaataaacgaagaaaaagaacgggctgtgaagcaaatgggaaaaagaaagcaaggaaaaaaagaatgaaaaggaaataggaaaaaataaaagaaaaactaatacgaagaaaagaaaagaactttaaagaagaaaaaaaatagatatgggcattatggacatttccaatcttatatctatttttttaaaaaagtagaagaagccgttttactaaatgtattcattgaaaaagcgaggggcaaaaaaagctacttcactgaagaagccagagccagagctatttacgcatgagcttaagccgtgccaaatgggctctaagttccacaacagaagcaaatactaagctcatttggtggtgttactagtgatgtttgtatctgagcattgggtggggcctccaactttgaatggtagccttccggtttcatggacggaagtcaataatctcgccatggatgcacctgaattcatccattagagtatcacaaaaataaaaagaaaaaaaactgtataatgctcaactactcacgcttcagcattttggtcacagcattttattcctcttgacccttctgtacatcagttatttgctaatccttgtcctggctgtgctttcaggtatgtttactcggtacttcctccaggagatgaagatctcaaaggtagcgaggttcaggctattgtaaaatttaaaagagctcttgggcttgatgatgtagatgctgctaacatgcacatggaggtattgtctcgtgatcaaaacccttttatatcttatcatctgtctccatatgttcttatcctttcgcctctgtttcccatgttcctgttttatgccaatttatacccttccctcttatctttgctctgtgtactagattggtagacgcatatacagggagaggctagaaacaagtgaccgtgatgctgacatggaacaaaggcgggtaagtgtttttgctttatacataaaaacgatacaactttctgttgacccagattataaccatgtcaaattctttgcaggcatttcaaaagttaatttatgtgtcaaatcttgtctttggagatcaatctgtgttccttcttccatggaagcgtcttttcggggtgactgattctcaggtactttactataaaatagatgttatcttctgcataccttctctcagttctatgctttgatctctcagagaaaattatttgttctgaagtttgaagtctagttttgtccaggtcggacaatattgcttcagtaattatgaaaaatctattgaagtattatgaacttgctctttgcatagtgtcgcactagtcttgatacagtagatattacagagaatgactgttccaaaagtgttaa

SEQ ID NO: 647 - DNA, 3454 bp, Digitaria sanguinalis
acaagtgagttggtcttgtttcctgttgccacattgggtttattatagctcgagtggttcgtactactgaaattatagggtagtcctggtatttttgtcagcattgttagcttagctgaatggatggtcgccaatctaatattagatggtggatttggtaggcatttggttccaaagaacttcaccttagttgtgtactagatagttatattcgcagataagtaccagcattttgatttgctcaaacctcttattgctctacgttttgtctagttgtctggcatgcctgtttatatgggcacttacttttgaacctcccgtggtcccatgtgttgttggaatgctagtaaattttagtttagctagttatttgttattaaaggaagctacatgtaattttaatgtgtggaatctaatattttcttttgggaaagtaatcagagatatcaactgctattcttttcttttcttttcttttcttttggaagcttattgattctgccgttcctcctttctccatggtcttacgatgtatactttcgttttaggtatggagttagtacacaggatgctgccttcaaagcagagctctgtgacttgtatgccaggtacggttctagacccccttgctgtttttcagctggcacctatgcttgtgaacatgggtatgcatgtagctgccatatagtattgtttcagcataattgtatatggcattaattctgttgtgatcgagttgctgaaatgtttggagcaaacacttggttattatccctactgtgttgcccctaaaggggattatttagactcccttggtagcaatacaaaagttgtgttttacctatcacacttaatatattaattttgcaatcgatatttataacaatatgttttcaatgcactgatatacaatattatgaaaatattcttcacatacgtactcatatgatgctcatatggagatttagcaacatattgttgccacatgtgatggggatttaacaatacatctgacacctcctaaatcccataaatgaaacttccatgtggtcttaagagtagttttattggtactaaatcaatccatattcattgaatgaacttccatcttttggccattgtcagtcactcgtacattttcatgggtgttgatggttaacttctgttgtaggctggcaatattcttttacacttctcatataaagtttttgtttgtcccaacttgcaatcaaactttcttcccactccaggccagttaaaagtatctaaatgctattctttaactaactatgtatttctttgtgaaataatgctcattatttcactaaatgattcttcgttgcatgatgtccagagtccagtgcaaattttgggtatgaaatatttagttgagatataaatgattgttttacttgattaaaaatttctacttgttgaaaaaaacaacttgattggaattaggatcaccttaaaattacactaagagatgtcacaaacttgatttggtaacttctacagttcgttctaattggcactattaagttgcataactggcgttttgctactcactgttcactgcacactgcctccatcccattaccattttaccagttggaggcatgaaggttgctgcaaacatttgcaagaaaagggaataactacaatcaaataactacaatattctagctattgactatacagtaaggatcaattagtctctgaagttttgaatgtttttaatcatactaggtgattcaggcaactaaatatcagttaccaaaacagatgtgcttaccagctgccgaagttgatgtgtacgctggtgtatattgcgataaatgccacccattggagggttgataacatggcttgaagggggtgaaagaggtactagaccatggattgagatgagggaactagagtggtccagaaatgcaaatagagtactatcttactttcctgatactgatattcggtatacgcccttttatagtggacattcttgctcctttcctagctgtttactctgatataacttccatattctcacgatactgtattactgttatttgatgcaaatcatgctctctgaccaactaaaatagtacgtctattcttctctgagagcagtccaacatggacgccactctcctagaatccttgttggacgtggactttacgtgcgtattaaggtgccagatgctgctgtacttgttgcactggccttcccagctttgcaatgcgggcgctggaccgctgttgtgcttcgttctcttaaccatgatccacattttcgtcgtacattcctattgtgcccaaagctaagcccccatttgatttgatagagcttttgagacggcttttgcaccagcttatgcccaagctctaccaaacacaccaaagcaaaaccggcttcaccacacaaactggtcagaagttgatcaggaaaatgaagtagcaattgtgagcccccaaaactggcttgcccccggcttcaccatgtccatacagtatgaacctatcatattatccctaagtctgaggtagtcaccggaaaatgccatcgtcttccttctcgcgtctctatctcgtgactagtggcggtgagtgttgtggtggccggcaagcaaaacgatgaaggaaggattggagcctaccttggtctggctgcttggtgtcctggcgaagcagcgtcgtgcagatggcactcgtccaccgtgggttccagaggtggtgcggcactggggaggagatgcagcagcaggggaccatcgctggctcaggcatgggtgcgagcgctggcgacccctggccttgggtccggcgctacagaaaggggaaaatgagaacgtacaagaatgaagggagaaaagaaaggaagaaaaaagaacgggctgtgaagcaaatgggaaaaagaaagcaagaaaaaaaaagaatgaaaaggaaataggaaaaaaaataaaagaaaaactaatatgaagaaaagaaaagaactttaaagaagaaaaaaatagatacgggcattatggacatttccaatcttatatctattttttaaaaaagtagaagaagccgttttactaaatgtattcattgaaaaagtgagggccaaaaaaagctacttcactgaagaagccagggccagagctatttacacatgagcttaagccgtgccaaacgggctctaagttccacaacacaagcaaatactaagctcatttggtggtgttacaagtgatgtttgtatctgtgcattgggtggggcctccaactttgaattgtagccttacggtttcatggacggaagtcaataatcttgccatggatgcacctgaattcatcgtttcactcacgcatcagcattttggtcatggcattttattcctcttgacccttctgtacatcagttatttgctaatccttgtcctggctgtgctttcaggtatgtttactc

SEQ ID NO: 648 - DNA, 634 bp, Echinochloa colona
aagttgtcttctgcaattgaagcttctgttgctcggggtcagattggtatagagcaggtccgaggattgagagcagcaaacttccaactggatagcttgattgcggaaccactacgggaaagcattttcaggaaaactgttgaggagatcttttcatcaggcacaggagattttgatgaagaggaagtttatgtaaagatcccagctgatctcatcataagtgctgagaaggccaaatcaattgttcaggatattgcaaaagttaggttggagaactcccttgttcaggctatagccttgcttcggcagaagaagagagacgaagtgctttcttctctgaatgacttgctggcatgcgacgctgctgtccctgcatcacaacctctgtcatggcccacaccgggagagctagatgacctgtatgccatctacctgaagagcatcccgaagaccgagaagctatcaaggttacagtatcttcttggcataagccaagagaaggctaacaagatcagggatgcggcttcggagggaacgctgccgattgcacctgaagagaaagaggagttggcgttctaggtaaggggcgcaattttgttagggtagccagcagagttgaggtcccttgccaatg

SEQ ID NO: 649 - DNA, 2799 bp, Echinochloa crus-galli
aacctggagagcggcgaggtggaggccatcgcgaagaaatatggagttagtacacaggatgcagccttcaaagcagagctctgtgacttgtatttcaggtatgtttactcagtacttcctccaggagatgaagatctcaaaggtagtgaggttcaggatattgtaaaatttaaaagagctcttgggcttgatgatgtggatgctgctaacatgcatatggagattggtagacgcatatacagagagaggctagaaacaagtgaccgtgatgctgacatggaacaaaggcgggcatttcaaaagttaatttatgtgtcaaatctcgtcttcggagatcaatctgcattcctacttccatggaaacgtcttttcggggtgactgattctcagatcgacattgctatgagggaaaatgccaagaatttatactcatcgcagctcaagtctattgatagaggtcttgacataggtacactcattgatgtaaggagagcgcaacttgcatataaactttctgatgagattgctgctgagatgttccgagagcacgcgaagaagctagttcaagaaaacatttcatcagcgttggatgtcttgaagtcacgtatcccggatagtctaacccaggctgtgaacgaagtgaggagtgttattaaatttaatagtttgcttactatattaagcaagcaccctcaggctgatcgatttgctcgtggtcttggccctatctcgttagctggggagtatgatcatgacaggagagctgatgatctcaagatactctacaaggcctatgctactgaaatactttcagacggaattgttgatgatgagaagcttgctcctttgagtgaactgagaaatatatttggactggggaagcgtgaagcagaaggaattttgtctgatgtcaaagctcacatatacagaaggacacttgttaaatcgtttaacactgaattggcatcagtgcctagcaaagcagcattcctccaaattctttgcgaaaagttacaatttgatcctgaacttgctagcaagatgcatgaagaaatttacagacagaagcttcagcagtttgtagctgatggagagttgagcaaggaggaagtggaagctctgatggcattccaagtgcgtctctgcatccctcaagaaactgtggatgctgctcatactgagatctgtggccaattgttcgaaaaggttgtcaaagaagcaattgcatctgttgatggatatgatgctgacaggcgagaggctgttaggaaggcagcacaaagtctgaacatgaaaaaggaggctgtcatgaccatctttagtaaagcagtacggaagttattcctgagctacattcaaagagcaaaagcagctgggaaccccattgaaactgcaaaagagctgaagaagctaatttccttcaacacagtagttgttagcgagcttttagccgacattaagggagagctgtctctaagtgctgaaactgaagcatcaagcgtggcctcggaatctgagggagatgatgatgaatatgaatgggaatcattggagacattgagaaagactaggcctgacaaagagcttaaagaaaagctgagaaagtcaatccagaaagagataaccgtcaaggatgacattgcattgagagacaggactgagctgtatgagacatacttgaagttctgcatcgctggcgagacgacgaacgtatcatttggaacagcaatctcaacgaagaaagatgattcggagtttttaatgctaaagcaattgggcgacatacttggtttaactcgcaaagaagttcaagatgttcacattaagtttacagagaaagctttcgtgcaacaggcagaagtaattcttgctgatggcaaattaacagaggccaaggctgaccagcttgcaaaaattcaaaaacagtttggtttgcctactgaaaatgcacagaaaatcattaagggtatcacaacgacaaagttgtcttctgcaattgaagcttctgttgctcggggtcagattggtatagagcaggtccgaggattgaaagcagcaaacttccaattggatagcttgattgcggaaccactacgggaaagcatttacaggaaaactgttgaggagatcttttcatcaggcacaggagattttgatgaagaggaagtttatgtaaagatcccagctgatctcatcataagtgctgagaaggccaaatcaattgttcaggatattgcaaaagttaggttggagaactcccttgttcaggctatagccttgcttcggcagaagaagagagacgaagtgctttcttctctgaatgacttgctggcatgcgacgctgctgtccctgcatcacaacctctgtcatggcccacaccgggagagctagatgacctgtatgccatctacctgaagagcatcccgaagaccgagaagctatcaaggttacagtatcttcttggcataagccaagagaaggctaacaagatcagggatgcggcttcagagggaacgctgccgattgcacctgaagagaaagaggagttggcgttctaggtaaggggcgcaattttgttagggtagccagcagagttgaggtcccttgccaatgaacttcgaacgaacttggtgctgtggacctgtagccaacagctgctattgtagctaggcgcatacattttttttggaaaaggaaagcgacgcctcatcctgacatgcataactatctgtatagacaagtctctgacaccaaatttggtgacactctttttctgctgttgcattcttccagactac

SEQ ID NO: 650 - DNA, 2654 bp, Euphorbia heterophylla
gacgagacattcaatgcggagctatgcgatttgtactgtcggtttgtgtcatctgttctacctcctggaagtgaagatcttagaggaaatgaagtgcaaacaataattaacttcaagtctgcattgggaattgatgatcctgatgctgccaacatgcatgtggagattggtcgacgaattttcaggcaaaggcttgaaactggagatcgcgaaggtgatgtagagcagcgtcgggcatttcagaagttaatctatgtctcaactttggtttttggagatgcatcatcgtttcttttaccttggaagcgtgtattcaaagttactgattcccagatagagattgctatccgtgataatgcccagagattatatgcttcaaagcttaagtcagttagcagagatgtagatgtagaggagcttttaagtcttagacaagcacaacttcagtatcgactatctgatgagcatgctgaggacttgttcaggcagcatgcaagaaaattggtggaggaaaatgtatcatctgcattggataatctgaagtctagaactaaagctgttaaaggtgtcacgcaagtggtggaagaggttgataagatactggcgttcaacaacaaattgattacgttaaagaatcatgttgaatcagattcttttgctcgtggagttggtccaatctctttgctaggtggcgagtatgataatgagaggaagatggatgatttgaaactcctttacagagcatatattacagatgctatatctggtggtcgcatggaagaaaataaggttgcggcattgagtcaattgaggaatatatttggtttaggtaaaagggaggctgaagcaattacacttgatgttacctcaaaggcataccgcaaaagactttcgcaggctgtctccagtggtgatttgggtgcagctgaaagcaaagctgcattcttgcaaagtttgtgtgaggagttgcacttcgatccagaaaaggcaactgagattcatagagaaatttaccggcaaaagctccagcaatgtttagccgatggagacttaagtgaggaggacgttgctgcgttgaaccgcctgcgagtcatgctttgcattcctcagcaaactattgatgaagctcactctgatatctgtggcggtttgtttgagaaggtggtgaaggaagcaattgcttctggtgttgatggctatgatgagttattgcagaaggcagtaaaaaaggctgctcatggtttacgattaacgagggaggttgccatgaatattgctagcaaagcggttcggaagattttcataaattacatcaagaaagcacggagtgccgcaaaccgcactcaatcagcaaaggagctaaagcaaatggtcgcattcaacacattggtcgtaactcaattagtggccgacataaaaggcgagtctttggataccccgcccgaacaaccaatcaaggaacaagaaacccaaaccgaagacgacgatgagtgggacgaagaaggctgggaatcaatcgagtcccttcgaaaactaaaacccagtgaagaaattgccgccaaaatgagaaaacccggacaaaccgagattacactcaaagacgatcttcccgtgagggacagaaccgacctctacaagacctacttgctctactgcctaactggggaagtaacaacgcttgcatttggcgctcaagtcaccacaagaaaggacgattctgagtacatttacctaaaccaactcggcggaattctgggtttgactgggaaagaaatcgtggaagtacaccgaggccttgcagagcaggcatttaggcaacaagccgaggtgattttagcagacgggcagttgactaaagctaggatcgatcaactcactcaagtacagaaggaagttgggttacagccagagtatgcacaaaaaataatcaaaagtattacatccacgaaattggcggctgcccttgaaactgctattagtcgcgggaggcttaatatacagcaggtacgagaactaaaggaagcgagcattgacttggacagcatgatatctgaaaggttgcgggaaaaccttttcaagaaaaccgtcgatgaaattttctcgtcaggtactggagatttcaacgaggaagaagtttacgagaaaatcccggcggatcttagcatcaatcctgaaaaggcgaaaaatgttgttcacgagcttgcaaggagcaggctatcgaactctctgattcaggcagtggcattattgaggcaaagaaatcatcaagcagtggtttctacactaaatgacttgctggcatgtgacaaagctgtgccttcagagccattgacatgggaagtagcagaggagctagctgatttatttaccatctatttgcaaaacgaggcacccccagaaaaggtatctcggttacagtatctgctgggcataagcgattcggcagctgctaatcttcgggagatgaaagatcgattaccatcggtcggggctgaggaagaaaagtttgttttttaacttgttttcgttatgtcgactgggaattatgtgtgatgtaaaacatacgattgtgaaattttgataggcattccttgatggattaggtatttttatcttgtactattttactttattatgtgttctatgattttgac

SEQ ID NO: 651 - DNA, 1996 bp, Euphorbia heterophylla
agcgccttgacaactatgggcttcagttacacgatcgatttttgcatgtggataattttcaaagtggggtgatgtgatgggaaaattagatgataaatttgatttattttctctgctaattgggattgggtgtctttttactgatgagtgtgggtcggtgtgatactaatattcttctttctatatttttagaaaatagatgataaacgtcactaatatgtagtttttaaaattttttttgcctcgtcgggcttacaataataacaaaaaataaccccaccccacctgtatgtgctgtgacctaaggctcaagctcaaccactgggctaagaccttagtattctacttgagtatttggtaactttttattgtttaactttttctaccatttgttacattttcttagtgccccgcccggggagcaaatttttgtgctattgtgaaggtccagggataaattgctcttttgcataggtcaactgttaccctacagagtacaaaggaacatgtttaactggacttttcttttatataggttcggaagattttcataaactacatcaagaaagcacggagtgccgcaaaccgcactcaatcagcaaaggagctaaagcaaatggtcgcgttcaacacattggtcgtaactcaattagtggccgacataaaaggcgagtctttggataccccacccgaacaaccaatcaaggaacaagaaacccaaaccgaagacgacgatgagtgggacgaagaaggctgggaatcaatcgagtcccttcgaaaactaaaacccagtgaagaacttgccgccaaaatggaaaaacccggacaaaccgagattacactcaaagacgatcttcccgtgagggacagaaccgacctctacaagacctacttgctctactgcctaactggggaagtaacaacgcttgcatttggcgctcaagtcaccacaagaaaggacgattctgagtacatttacctaaaccaactcggcggaattctgggtttgactgggaaagaaatcgtggaagtacaccgaggccttgcagagcaggcatttaggcaacaagccgaggtgattttagcagacgggcagttgactaaagctaggatcgatcaactcactcaagtacagaaggaagttgggttacagccagagtatgcacaaaaaataatcaaaagtatcacatccacgaaattggcggctgcccttgaaactgctattagtcgcgggaggcttaatatgcagcaggtacgagaactaaaggaagcgagcattgacttggacagcatgatatctgaaaggttgcgggaaaaccttttcaagaaaaccgtcgatgaaattttctcgtcaggtactggagatttcaacgaggaagaagtttacgagaaaatcccggcggatcttagcatcaatcctgaaaaggcgaaaaatgttgttcacgagcttgcaaggagcaggctatcgaactctctgattcaggcagtggcattattgaggcaaagaaatcatcaagcagtggtacggaatccccgaaaatacaactcataaccttggtttttgttttatttaggcttaatgcatctccatggatcagaaaaacctattgcccccatgaactttcaaaatgaccccgtaggtcactaaaaaaaaattgcaaccttgaatgccacgtgtcagcttcaaattggtgcacttttcaaaagtcgagggagctatggggcactttaaaagttcagtgggacatttttttgaaagaagttcagttacctggagatgtgttaggcctataatatataagggtaaactttaaaaatataccctgttgtttggtcgttttgcaaaaagatgcctatggaatttttttttcaaaaaatacttgtggtttaaaaaatttgcaaaaagaggatttccaaaatttaaaaaccacaattttgaaggctaatctagttcattttgaagtgaaattttgtagcttagttaatgacaatataa

SEQ ID NO: 652 - DNA, 5192 bp, Euphorbia heterophylla
tttcgttaaaactaatcatctgacttgaactctggtctttataggtttgtgtcatctgttctacctcctggaagtgaagatcttagaggaaatgaagtgcaaacaataattaacttcaagtctgcattgggaattgatgatcctgatgctgccaacatgcatgtggaggtattgttacattaacactttacttgcatgttaaaacatgactatgattgtggttgcatatcgcggtttagctttctttaagtttctatttctcttcgttgtagattggtcgacgaattttcaggcaaaggcttgaaactggagatcgtgaaggtgatgtagagcagcgtcgggtaggtcattcgtatgttagttcctgcgtgtctttattcttcatctataaagtcttatatgaacaaatgagtggaaatccggaacttgaccattactacaatttcttcagtgcaggcatttcagaagttaatctatgtctcaactttggtttttggagatgcatcatcgtttcttttaccttggaagcgtgtattcaaagttactgattcccaggtattttttcataggacttgtatcttctagtacttattttcatgtggtttgaagttgctgatcttgtcaggaaattcagaagtgatggattttctgattttcttaagcatgtttctgtcatgtttggcttcgtttttcattctatacaattctcaagatcttgtatcttttgtgataacttacttgttctttcaatacttataccctgacagatagagattgctatccgtgataatgcccagagattatatgcttcaaagcttaagtcagttagcagaggtaagacacaggtccataatatcgtgattttactgttatagtttatccgtgtgattggcaaactgttagcttcaaatgcttaagggtttttttgcaatatttgaatgcaatcttttgtgggaagggtgctatatactctttcttttatgggatgtgtgtggtaatatttctatggtgtctttattttgtaatctcaactattatgtaattaattatgtattccaaaaaaaaaaaaattttgtatttcacgcgtcaaaacaatttatctgctatttttggacttgtatagtttatacaacattttcatgtagcaaaagatacatgttgaagggctgccaattcctgaaccatttttcctttttattttcgagatgggctaatgttgactcacttacaatatccatgttttgtcgtttgctgtgtcgttatgaatttttttttgctactggttgaaagagggcgtattttcatgacttacacgaatgaactcttgttttcatatagatgtagatgtagaggagcttttaagtcttagacaagcacaacttcagtatcgactatctgatgaggtacattcttcagacagatagtttatttcaatgtctgtagctgtacttttatatggtttattttgtttcatacagcatgctgaggacttgttcaggcagcatgcaagaaaattggtggaggaaaatgtatcatctgcattggataatctgaagtctagaactaaagctgtgtacgatactttcactccaatgaagctttatgttacttgagtcttagttttggaagaacttatgtagtctaatttcgaacttatatatcggcataccctctcttttgttatggtggtcaatcaaaccatataatatatatcaatttttacagtaaaggtgtcacgcaagtggtggaagaggttgataagatactggcgttcaacaacaaattgattacgttaaagaatcatgttgaatcagattcttttgctcgtggagttggtccaatatctttgctaggtagtgatgttattggtacattttttcttctaattatcaattatgaaaatttttgctaattattctctgtgacctaggtggcgagtatgataatgagaggaagatggatgatttgaaactcctttacagagcatatattacagatgctatatctggtggtcgcatggaagaaaataaggtgaactgattattgcacactctatgctactaattgatttctctcatggaattttggcattgatttaaacattaattatctggtaattgaagtgataatagcatcgatagctccttgaaaatatggaattgattacaccatggagagtaaagatttatttgtttttatagttttatggatgcctcatgtagaagagtttgggcaattagaaatcaataatcaggcacaaagagaatgggtatggtgagtaacctgaacaaaaggcaaaaactagtatttgaagaaaatcttttaattaagtttctaaattggggaaacattaataatattatattggtgtctattttgtgttgaataactagtattttgtgttgaaaaattagtcttttgtgtttattttgtgttgaataacaatattaactagtgttttcttttcaagcatatatttaaatttagattactagtctccttatgccattgctctctgtatgccttttcaaaggactgcttatttgcaatttatttgcgagttcattttgcatcatacttctttcattgttatatgggattaattcttttatgtatatacttattgtaggttgcggcattgagtcaattgaggaatatatttggtttaggtaaaagggaggctgaagcaattacacttgatgttacctcaaaggcataccgcaaaagactttcgcaggctgtctccagtggtgatttgggtgcagctgaaagcaaagctgcattcttgcaaagtttgtgtgaggagttgcacttcgatccagaaaaggcaactgagattcatagaggtaatattgaatgtttgaaaccaaatcgattggcatattgtgatgttttatgattttcctgtcattctgtgtaatatgttcatgtatcagttattacttgtgtattatattggataagagagtgtgaataaatcctgaattggttttcagaaatttaccggcaaaagctccagcagtgtttagccgatggagacttaagtgaggaggacgttgctgcattgaaccgcctgcgagtcatgctttgcattcctcagcaaactattgatgaagctcactctgatatctgtggcggtttgtttgagaaggtaacttgcattttcctatgatacttgtattggagagagcagcttttgaactagtttttatggtcaatttgtgttttaaattggaaatgggatgatagcttttgtctttggacatcacacaattatgatattttccttgagaaattttagtagggttattttttcctaattttggctatatgctttgatcctataatttctttctcaaaatcacttccatttttaggttcttattcatttcactagcagaaaggcactgagtaatgttaaggctcatattgctaaatgccatatccatattaagctgaaactatatagtaatgtcagaagaattttgttttatacttgattcttgttgggatatattttcctggaaatttgttatgggttgttgtggacatggtacgaggcattagggagtgggccttaatatcttaggtgcatggtactttgaaggcttgccttctgatttatgaacatgcttagatggcatgttggcagatgattgaagtgatttctttcgccgaaaaagtcagacatgttgcaaaccatcgatgtcttttttgaaactgtctgatcttccagaaatcaatttcaacgctctaataatgcttcatcttgagagaagaccactactgctggagtcactagttaccaaacttgcttaattccgtcaaccatgtttcgcaattctatccttgatttggatttatttttatttccctcttctctcttttctcgtcttttttatctgttgggttgggtttgtggtgatttttcggtagtcttcaacttttcatctatagtagtagtcttcgacttttcatctctattcatacatgttagtgcttgtcttcctatttccattgatctcctttgttttctttttctcccaggttaatattaactatgagttttggctttgtttatttagttacttcggaatttaaccaaggctcataagttcattgaagttgttaactctacaataatgtagaaattaatactgctataaacctaaaaccttactcaaggggagggagtttttaacaccacagctgacatgttggtttctaatacatctttatatattctattaagttctctactatctacaattttctacagtagatattttttcgtattggatttagcctcttatctctatcatccatacgtgtgcttaaactccacatctttgttttgtgagcttcatgcctcatcaagtattgtgtattttttatgtaggcagtctgcagtttagacttattttcctctaatgacgactacatgctaaatgattcctatgttaatgtgcagatttttttatggcttgttcctgaaagttggttgaattatgctgaccaaatatgtcacttgtatcaggtggtgaaggaagcaattgcttctggtgttgatggctatgatgagttattgcagaaggcagtaaaaaaggctgctcatggtttacgattaacgagggaggttgccatgaatattgctagcaaagcggtgagcatttgttctgattcctccactcttggaaaatatagattagggtagtgttacaaagattcccattcccctgacggtaaataaaagggagtttcttagctcaaccttacaagtaacgcaacattgaccttatgttagacaataaaacaaaaaatatcctctatgggatccagacttcatgtggtctgttagaaatgttgactccacgtcatcaaagctaaggtagtcaaccagcaatgactagctgtttagcgaggtggatttcaaccctgacacctcttcaaccccaacgttgggcggcttcagcatatttttcaaagtattatcatactttaatatgtattttccatctattttcaagagttttaacaatagtttaaggctatatattcctaactcaatttatacttaggctagatattcatagtgcaatatataaattttacatacatatttacatctgaaaatttcttatttctttatttttggtattgttgttgcatatgacttcgcttttcaagaattt

SEQ ID NO: 653 - DNA, 889 bp, Euphorbia heterophylla
gtaacactgttattttgaaaccaccatggcccttttgaaaaaaaaaaattccacaggcatctttttgcaaaacagccaaaccacagggtatgtttatgaagcttaccctataatgaagtattttaaatagatgtacagatttgttggagtggttgattcgaggtatttgttgcggttatgcaggtttctacactaaatgacttgctggcatgtgacaaagctgtgccttcagagccattgacatgggaagtagcagaggagctagctgatttatttaccatctatttgcaaaacgaggcacccccagaaaaggtatctcggttacagtatctgctgggcataagtgattcggcagctgctaatctccgggagatgaaagatcgattaccatcggtcggggctgaggaagaaaagtttgttttttaacttgttttcgttatgtcgactggaattatgtgtgatgtaaaacatacgattgtgaaattttgataggcattccttgatggattaggtatttttatcttgtactattttactttattatgtgttctatgattttgcaataaaatgctcatctgaaaatggcattttcactatggattgtttgatatatcgaattggaactgtaacatgtgggaactcacggaaaaatttagacagtattggatgtggcagtacttaaccgacaagaaaatatatataactatatacataaaatatatagttgtagactttatctcgttgatgtattatttacaacttgtgttgaaaaatcttgcagcagtacagttgcaacctcagaaactcctcgaacaatgggttaatatttcatgtgcttgatggagcatatattggtaggggcaggataaatgtgtccacagaactgcaa

SEQ ID NO: 654 - DNA, 1157 bp, Euphorbia heterophylla
ctagattcaggtaaaaataagcaattatcattacatatatggtttcaaaattgagtgtacatattgccattgccaatatagaaatgggactcaaaaatttgtatgacaacatcaatatggggcgaaatgtgaaaattacgagactgccatgaatgctacaacaaaactatactattatcatcgtgttctatctaaaacttgctctttatcttcttcgtcttgctctctcgttaaaccctataaccaccacctcttcgccgtttccgattgaatttcctcctctctcacggcggagagcctagcctagccatgaatccttctcttctcacctcctcctcttcaatttctccctctctccgtctcgcccctccctcctctctttccctccctaaacgccgccgtttcagagtttccgtcccccgctgctcctcagattcctctgtggaatccacatcttcttcggatgtttttggcggcaagcgcgagctctccggtgtgcagcctttggttgctgcgctcccgcctcctgttagattggccacttccgcaattgtttttgctggtgctcttgctgctggttatttcttggggtttaagttcgggaaatcgaggaatttggctttgggcggcgctgctgccttgggcgctgctggtggtgctgcggtctttgccttgaattcgtttgttcctgaagttgcggctactgagttgcataactatgtggctgctttcgatgatcctttttccattaagaaggaggatattgaacttattgccaagaggtttgacttttttatttcttcagctgcttcatactcttagttttgatgcagttttatgaattgaactaggatatatatgtgtatatgcattttagtttaaaatttggaaccatttcgtttgtttattgtttgaagactccttttacctcgtttatacttccttaaaatgtgagaatttctaggtcttattctaccttgttttgaatgccttaaatgttttcttccctgtcgtgaattaattttaaattttgatgattgaactctaagttcagaattccatttttgatatcacagatatggtgtgagcaagcaggacgagacattcaatgcggagctatgcgatttgtactgtcggtgagatgcaattgacttata

SEQ ID NO: 655 - DNA, 504 bp, Festuca arundinacea
tttcattcgggacagcaatctccacgaagaaagacaattcagagtatatgatgctaaagcaattgggaaacatacttggtttaacccgcaaggaagctcaagatgtccacattaagctggcagaaaaagcatttgtcgaacaggctgaagtagttctagctgatgggaagttaacagaatccaaggctgaccagcttgcaaagatacagaagcaggttggtttgcctgccgagcacgcacagaaaatcattaagagcatcacaacaacaaagttgtcttccgcaattgaagcttctatagctcgagggcagattggtatacagcaggtccgaggactgaaggaagcaaattttcagctggatagcttgatttcagaaccgttgcgagaaaccatttacaagaagtgtgcagaggagatattttcatcaggcacaggtgattttgatgaagatgaagtgtatgtaaagatgcctgctgatcttatgataagtgctgagaaggcca

SEQ ID NO: 656 - DNA, 351 bp, Festuca arundinacea
ggttataactaagggaaatatttcataggcgttccaaaaattaatttttgtgtcaaatcttgtcttcggagatgcatcagagttcatacttccatggaaacatcttttcgggatcacggattatcaggtaaatagtataagacattcgtcattcatttactactatgcatagcatcaatttatgacttcatttatggagaaagcagagagctacctccattatgatattttgatcacttgcactcaacttagtactgtgactgcacctactttttaaacattttccaccttgagaagcctcttaaagcatgctgagcatgctcagcatagtattgtgttgttcatgataca

SEQ ID NO: 657 - DNA, 518 bp, Festuca arundinacea
ttatgataagtgctgagaaggccaaatcaatcgttcaggatattgcaaaggttaggttggagaacgcccttgttcaggctgttgctttgcttcggcagaagaagaaagatggtgtggtatgtactgtatcccttgtctacttgattcgtcaaaatttacataattgctcctagagatataggttcgaggaaacaatcatatacagatctcaaagtattttcaaggtgttggtaaccttaaagcacatctggataaaatttattcttcatcactgaaacaataggttgatgggaaattagccagactctggaaaattctgattgcattagattaaatgtataatctattatataaactactttatacaacttttattttatcctcaagcttctgttgaaacttatttattgcttctatgtctaacaccaattcatatccgatgcagatctcatcgctgaatgacttactcgcatgtgacgctgccgtccctgcttcaaagccgttgtcatggcccacac

SEQ ID NO: 658 - DNA, 937 bp, Festuca arundinacea
ggctataggatttggaaaatacagcctggattttatgtagacaaagtaagtctagtgaaatctttggattgccgacaacacagtctagatcatgcagcttgtactgctatggctggcactgaaaactgaactgctgtctatgtcacacttcttctttcttgtatttcactttatgttgttcacatcatgttagatgctgaactaaacaaatataagtgttacatgttactattgttaagcaataataatttgtgggtcctagggccacacatcagtacataacttaggaatcttatcgtactcttcagcgtgaacctttcattttagtccataccaaattggcaagtctatcaatgttatatggttgtatcttaacataagtcttgttttgatacaaaaatgcagcttactcctttaaatgatttacgtaatatatttggattggggaagcgtgaagcagaatcgatcatctccgatgttaaatctcaagcatacaggaagagacttgcaaaatgctttaacagcgatttggctgcggctcctagcaaagcatcgttcctccaaaatctctgtgaagagctacattttgatcctgaactcgctagcaagatgcatgaaggttgacacttactttttattgcatcattatttttacatcataggtctatattagctattgtgattatcaagttgtactaatgccacttcatacttcagacatttacagacagaagcttcagcagtttgtagctgacggagagctgagcaaggatgaaacagaagctttgatggcattccaagtgcgtctttgcattcctcaagaaactgttgatgctgctcatgccgacatatgtggccagttgtttgaaaaggtgatgtattttatggtgcctttcatttaacagactgcataattcaagttctgttccagatctgc

SEQ ID NO: 659 - DNA, 266 bp, Festuca arundinacea
gagggagaggatggtgactatgaatgggaatccctggaaacattaaagaagactaggcctgataaagagctaaaagaaaagcttgagaagtcaagtcagaaagacataaccctcaaagatgatcttccattgagcgacagagctgagctgtaccgaacatatttgatgttctgtatcaccggggagacgaccaatgtttcattcgggacagcaatctccacgaagaaagacaattcggagtatatgatgctaaagcaattgggaaa

SEQ ID NO: 660 - DNA, 390 bp, Festuca arundinacea
gcagctttctttactcagtacttcccccgggagatgaagatcttaaaggtaatgaggtggaggttattgtaaaatttaaaagaggtcttggacttgatgatgtagatgctgcaaatatgcacatggaggtattatctcataatccaagcctttttattatatgttggtgtttgtctcagatgttattattactttagtcaccattttcacagttacacagctttctctctccgtccttatgccgtttaccttgcccattacaatagattggtagacgcttatacagagaaaggctggaaacgagggaccgcgaggctgacattgaacagcggcgggtaagtgtttctgcttggaagtaaatacatggctacttacaaccctctgtagacc

SEQ ID NO: 661 - DNA, 1800 bp, Festuca arundinacea
caacatgaaacctgaaaagatgtcaccaacaatctaattattttagagaaggacgcagacatttttttttgggctaaatctgatacatgtagttttaatgtatcaatataacagaggcaaatagattgtacatagcagttataaataatgtattttcctcccttgttcccattcaagaggttatccataacgtgtcacctttcccacacataggcctgtcctgttcttggagttgcaggctttaagtattgtttttctattctgaacaatatcatttatacacaaaccagttcatagaagttattagacttatattttatggatatatctgctttcactaatagagtgaccttaacttccatcgtggagctatctgccttctaagggaatgtgagaagaccaacaaaatacttgagaaattgcagaagtttttcttgatcaatatttagaaaatatattattctgttggagaagtggtcaatccatctgaatcctcataaacttggattttatcattgtataacatgaacaaaagtttacattgatactaaaccatatgatgactgattacagggacatcccaaaacaggttgttgatgaagtgaatagtatacttgcgttcaatagttcgctaacagttctaggcaagtttcctgacggcgatcgatttgcacgtgggcttggacctgtttcgttaggtaataaagttgtaatttttactatattcatatgttctttagttggacctctcttaagaatggttcttgtgcataggtggagagtttgatcatgataggatggttggtgatctaaagatactctatgcagcctatgcaacagaactactttcagatggaaaccttgatgatgagaaggtagttttacgtgtcttcgcatctagttttttaaacttatgctgcttttgatttgataacctgaaatgggtttgataattctgtagatttatgaaatgacctatcagaataaatcaccataacatcttgatttaagttgcgtaggccgaattagaaaggccacggaatcttaaatatatctcgattttgggcgagaaaaattaatccattgaattcggagcattgtagaccaacagtataagatcatgcggtgttgttgctatgtacgcccacagcctctgccttgtattttatcctatattttgacatcctaatggtgtgcagctaggagataatatattacatgctgaacttaacaagcccaacccatcccggctacctactagtattaagaaatattaacagcagaaggatcatgcttcatctatttagagcatcagtatttaccgaactcaatctggtctcgacaggaccatagtgagcgtttgataagctgtgataaattatgcttatggtcagactgtgaattatgtcttccccgcaaaaaataagactgtgaattatgtctggatttagttcatggcttgagtcagagattagcttaacccaaatgatttattagtaaacatagtttaaaaccttattttctccttcatcggtaaaccaaatgatttattagtaaaacatagtttaaaaccttattttctccttcatcggtatgtaaactgcaatacagaacttgctaacttggaaagtgtattctagcggtttatgatattggttgttcagcgtcatcttatagctttatcacattattgtctatataatatggttatttgttctgtggggtagcatcttaacagaatcttttcctttatgtgattaaaaaatgcagcttgctcgcttgagtgaattgaggaatata

SEQ ID NO: 662 - DNA, 1031 bp, Festuca arundinacea
attagattaaatgcataacgcattaacggatacaaagctactttatacaactttttatcttatcctgaagtttctgttgaaatttatttcattgcttttatgtgtaacaacattcatatccaatgcagatctcatcgctcaatgacctactcgcatgtgatgcggccgtccctgcttcgaagccattgtcatggcccacactgggagagttggatgacttgtactgcgtttacatgaagagtatcccgaagcctgataagctatctaggttgcagtacttacttgccataagtgctgagaaagctaaccagcttcgggatgccgcaacagcaggcacgctgccagtcacagctcaagaggaggaagaattggcgttctaggagggatgtgaagacacttttttgttaggtagccagcagagtcgagctcctgccacacgaggtgctgtggcgccaacatctgctgttttagctagggcatggttttgagaagcaacttataatcctgagatgcataaattatttgtatagacagatttgacaccacaaggtgacagttttctgctgcattcttttaaaccatactgagaccattttctgtatgtccttttggtcgtgtaccactgcaaatcccttgaaataaatgtggttttgttgtaactcatgtgtcagaggatgctgttctctctttcccacgttgcaccaaatcgtttgacaaaaataacaaataaactgactaaaactcatcaaatcaaccacgaagcctaagacagaagtcatagagagccctgatgtgctgcgtagctaagctgtcaactgttttctttaccagtaacaaagcatgggcatctctagtagtaaaaaaaatcagctacactttgttcagtgaacgaaacatttgttacaacatctctctgcaggcacaaacatctacagccgtaatactttgaccagaattggtcagaaaagtttgaaaggtaggtgcaaattgcagaagcatcgacaaactgtacagtagtgccaacaggtgca

SEQ ID NO: 663 - DNA, 3180 bp, Ipomoea hederacea
ccgcgtcgcgcaaccgctatcacttccggtatcgaatctccgccgttagctcctcttccgatcagccttcaacatcgattagttcttccgccggcactgccgctgctgcaattcctgtccagccggatgtgttcggaggtaagagagagctgtccggcatccaggcgctggtggattccatgtcgcctccgattagaattgcgagctcggctattatcttcgccggcgccgtcgctgctggttatggactcggattccggttcggcgggtcccgcaatgccggcttgggtggggctgtggcgcttggagctgccggcgctggcgcggcttatgctttgaacgcttgtgctcctgaggttgcggccgtgaatttgcataattatgtggctggctgtgacgacccggcagctttgaagaaggaagatattgacgctattgcaaacaagtacggtgtcagcaaacagcacgaggcgttcaatgcagagctgtgtgatatatactgccggtatgtaactgctgtccttcctcctggaaatgaagatcttagaggcgacgaagtggacactatcattaaatttaaatgcattgggcattgatgatccagatgcagcagctatgcatatggagattggtaggcggattttcaggcaaagacttgaaacaggagatcgtgatggtgatctagaacagcgacgagcattccagaagctgatatatgtttcaaatattgtatttggagatgcctcttccttccttttgccttggaaacgtatgttcaaggtcactgatgcccaggttgaggttgctgttcgggacaatgcgcaaagattgtatgcttccaaacttaaatctgttggccgagatgtcaatgtggaccaactggtcagtctcagagaagcacagctttcgtatctactttctgatgagtttgcagaaggcatgtttagggagcatacaagaaagcttgtggaagaaaacatatcaagagctgtctccatattgaagtccaggacaagagcacccggggaagctacacgtgtcactgaagagcttgataagattttggccttcaataatttgctaatctcattgaaaaaccatcctgatgccagtcgttttgctagaggtgttgggcctgtgtctttgtcaggcggggagtacgacagtgatagaaattttgatgacttaaaacttctttaccaagcatatgtaacagattctatagcaagcggtcgcatggaagaacagaagcttgctgcattaaatcaattgaggaatatatttggtctaggcaaaagagaagcaggagcaattacattagatgttacttcaaaagtataccgtaaacgacttgctcaagctgtacgtacgggtaatttggcagctgccgatagtaaagcagcatatcttcaaaacctttgtgaggagttgcattttgatccacagaaagcaattgagattcatgaagatatatatcgacaaaagcttcagcaagctgtctctgatggagaacttagtgatgaggatgtgaattcattggagcagttacagattatgctctgcattcccaagcaaactgttgaaacagcacatgctgaaatctgtggcaatttgtttgaaaaggcggttaaggaagcaatttctggcggagtggatggatttgatcctgacgtgaggaaagctgtgagaaaggctgcttatggtttacgcttaaccagggaagttgcaatgtctatcgctagtaaagcggttcggaagattttgttaacttacattcagcaggcccgaggagctgatagccgcactgaatctgctaaagaactgaaaaagatgatattatttaatagcttggttgtgactcaactagttgctgatattaaaggtgaagatgaatcatctgattctctgcaagaggagcctatcaaggaggaagagaagcaaacatttgaggaagaggaatgggaaactgtgcgatcacttcagaaagtaaaaccaaacagggaaaatgtaaaaaaacaaattcagactgagattactctgaaagatgaccttccagacagagacagaactgatctgtacaaaacatacttgttgttttgtctaactggggaagtcaaaatgatgccttttggtggccaacttagagtgaagagggatgatgactccgagtttgttctattaagccaacttgctagcatccttggcatgagcaataaggagattgttgatgtgcatcgtggcttggctgagcagacatttaggcaacaagcggaggtgattttggccgatggacagattacgaagatgaggatggagcaactcaatgacttgcagaagaaagttggcttgccgcccccttatgctcaaaagattatcaagaacataacaacttctaagctgtcgggtgtcctcgaaactgctgttggtcagggaaggataagtatgaaggaaattagagaattgagggaagctggagttgaaataaacactatggtctctgaaagcttacgcgaaaacctgttcaaaaaagcagtggatgatatgttctcatctggtactggtgagtttgatgaagaagaagtgtatgagaagatgcctgcagatctgagtattaatgctgagaaggccaaagcggttgtgcagcaactcgcacgaactagattgtcaaattcacttgttcaggctgtggcacttctaaggcagagaaaccagaaaggagtggtttcctcgctcaataacttgttagtctgtgacaaggttgtaccttcaaccccattatcatgggaggtgcccgaggaacttgatgatctcttcctgatatatctcaaaagtgacccagcacccgagaggctctcgaggttacaatacttgctggatataagtgattcaaaggcggacactctaaaagagttgaaggatagagcagtgccaaacgaagccgaagaggaagagtttgttttttgaatctgccatcactttagcagcagagaactagtgttagtagcatgaattgtttaccaccagatgtcacatcacagttttgtaatataacactaggatgctgttcttaattttcaccgattcctctttttcaatttcgtgaagaaacatttatgtttgtttaaaatgatagattgtaaggagccattgatgtttcaatatataataaattttcttgtc

SEQ ID NO: 664 - DNA, 953 bp, Kochia scoparia
gtaaaggggttgtttagacaaatcaattcataaatttttaaaattcattaagggcataaaagacatttaagagggggaacaccatcttcctccccccttcccttatataatagagataactcactaatttactcatcataatgtttgtaatctgtcttctctcttctagaaatatatcgacaaaagctacagcaatgcttagctggtggagagttgagcgaggaagatgttaaagctttgctacgtgtacgggtcatgctttgtgttcctcaaaatgttgttgaagcagcccatgctgatatctgcggcagtttgtttgagaaggtatgtaattgaagcctccctcattggatctcatctgttttgctgtgtgatatatgtggatttgtttatacttagttaaatagatcgtactgttgtgatttatgcttagtttgatggattgtaatgttgtgatggacctagtaaagcttaatcatttcagtagtggtggctaaggaacgtgtaaggttgttaggtttgggatcgcactttggatcgatgtgagtcgtagaataaaatcggggatcgcgtaagatcatactaaattacgaaaactcagcaatcatgttcatttgcaatgctctataaacacttttttttttttgtattgtgtagacaaggtaaactagtgtatttctagttattcaactagttaaaagcttaaataatgggagggagggaatcttggtcgctgatttttgagatagacgaccaagatgtgcataagtttaatagtaaatgtgcaaattttcgtacataaatgtgcatatttttttagtttttgcacatttacatgaaaattattgcacagttatgtacaaaaaagtgtgagaagcaatcttgattgttggattttgaatagagggtcaaaatttattttgtacataaatgtgcacgaattttcccgtgaa

SEQ ID NO: 665 - DNA, 2524 bp, Kochia scoparia
tatcctctcggattcaatctctccaagaataaaaccttcacgaaaagaacttcttttcacttcacccctctcttcttctctcctatcatctttcatgccattatatcattttcatcatcttcttcaacttctctaacaaccccactctcactcctccttataatcctcttcgctaaaacccttcaaaaatcccattcaaaattgagagagaaaacaggggtcaaactccattaaaatgaataccactcttcctctttcttcctccaaatccccacttatcccctccactttcactcaacctaatcgaatccccaatttcatccgcatcccaataaatacacccctcaaacgacaccgtttcaagctctctaaactccaatgctccgccgaacaaacacccaccaccaccaccacaaacaacaatagcgatgtgttcggagctccgagagagttatcgggtatccaatcattggtcgatagcctgtcacccccagtgagaattgccacatcggtacttgtggtggttgctgcttctgcggctgggtatgggttaggttctcgattcggcggcacccgtaacgtggctgttggtgctgccgttgcgctcggtgctgccggcggtgccgctgcttactctatgaattcttgtgtgcctgaagtggctgcaaccaatttgcataactatgttgctcagtgcgatgaccctcttgctttgaacaaggatgatatcttagctattgccaataggttgctatttttgaattgattgtcttattcctaatttggaatggtttgttttgctgctggaagtgaagtgaagatgacattgtttgttttttcaggtatggtgttagcaagcaagatgaaaccttcaatgctgagctttgtgacttgtatcttaggtgagtatgaattgatcctattctattttacgtcaatgtgttggacatttacagtgttatgtagtgtcatataattgaattttgtttgatttttgttattttattattttgggatgtctgagaataatggttactttgcctaagacagtgatgaattatgctaggatttataatggtatattgtaaatgagtgagaaccacggcgctgtggccagcgtagtgggagggatacagcgtttatatttgatcagctgggacattaccaggattccttctgatgaaagagagagtattactgtgtttgatacctcaaagaaccacaaaccaaagcctgcatgttgtgatatcatatttacaaaatcttgtgcaaagagggcctttttatctttacctgatgttttccctgattggttgtatagatttgtttcatcagtgcttcctggtgcaactgaagatctcaagggtactgaagttgaaactatcatcaagtttaaaaatgctcttggcattgatgatcctgatgctgctaacatgcatatagaggtatctattttgttagcctgtctacttattggtagtcttttttggtgccaactttgagtagataatggtgccttttctggctgtagcttgctaggcgaattttcagacaaaggcttgaggaaactggagatcgtgatgctgaaattgggcagcgccgggtgagtttttgacatttgtgctatttaaaatcttacccgagtgtgttgacttttctaatgaagatatgtagcttgaccagtttcagtgagtttcagcgcaggcatttcagaagctagtgtatgtttcaactcttgtctttggtgaggcctcagcattccttctaccttggaagcgtgtgttcaaagtgactgattctcaggtaacttctagctcattagcttcttgcttttgtcgggtgtatttgatggaaagaattatgagttcgatccctgttagcagcttttttaaccttaagattatgaaattttatccatgctttctcaccaaagttattcttaatctattcaataggccacacttacttttgtgttcaaagtacacttattcattgatctataatatgccaacccttgtcatatttatgaatcatattcatattggcagtgtttgactaaaaaagccaaatttggcctttttttgcttgaagtgaagggtgtattgagtgtaaaagtgagaattcatttttgtgttgtctgttaggtggaggttgctgttcgcgacagtgctcaaaggctatatgctcagaggctaaaatcaattggcagaggttagtatctactttaaaataaaatctcttttgaggttgctataatgtttttttagtttgattgtgtttttgtaaatgaagtcaaaaataggttggtattatctattatgtcattaagtgtgttatctcccccatttcttcattcagatctggatttgaagcagcttgctgacttaagagaagcccaactttcatttcgtctttctgacgaggtattgccctatgttacttggacttggatgaagtgtcaagtgtcagtgtagttgtcaagcgtcgccattttctttttaaaaaagtagtgtttttagttaaa

SEQ ID NO: 666 - DNA, 12555 bp, Kochia scoparia
  unsure (1)..(12555): unsure at all n locations
ttctcattttaagggtttttctcattggatcttaaccccttatactccttccgtttatttcatcttaaattcgtaactttttttccattttagttaacatatttaatgctaaatgcagcccttatggctacatataagatataaatatactactccatacttaaaatggaaataatttataaattcaagacaaactaatacattaatcgatgcaataaatgatcaattattgcatactatttccactttaagcttcttaaaatcagcccttagggctatatttagctttttgcgtttttttttttttttttatagtataatggccttttattatggtcatcttcatattatatatcgacctttattaactattagcaaaccattagccttgttaataagtgatctttatagtctgattataacattttttttagtataatggccttttattatgatatagtcatcttcatattatatgtcgacctttattattatattgatgtacagcggatgtatactagactgtgtgtacattattaactattaaaaaaataaaacataagagtttaatgtctcatcatttcatgttattagtgcatgtaggattaatttttaatcgtaagattgtggattcttttaagatcccattactctatatttttgtcaagctaggatcgtaagatcctactatcctttagatcatacttaagatctggattagtgtaggagcattagatcccaaaacgggattttaacaactatgcttgtacttcaaatagttcttctttatcataatagatattacatagagaacttgcacacaaattaaatggcacgtgtcaagcctctttcgccaccatggattgctcctagttcatgattgtttggcccattaatgcattaatgggaccccctcgtttttacacattcctgcaaggttgaagtgctttcttgatttcaggttgtgagggatgcaattgcttctggtgttgatggatatgatgctgatgttaaggcttctgtgaggaaagcagctcatggcttgcgtttgactagggaagctgcaatgtcaattgctagcaaggcggtatgtgttctctccccactcaacctttgatcatttagcttgtcttagaaataaaaaatgctggcaaaatcggcaaggtgtagataggcttttgctcaatgtcttgtggtattcaatgtgtttctaattcttaacctcgtgtatcattcaggttcgcagaatattcatcaattatattaaacaagcaagggcagctgggagtcgtcctgagtctgcgaaaattcttaagaagatgattgcatttaacactttggtggtcactgaattagtttcagatatcaaaggggaatcgactgatgctcctacagatgaacctgctaaagaggaagagaagcagacagaagaagacgaggaagagtgggagtcacttcagacactaaggaaaacaagacccactaaagaacttgaggacaaaattggaaaaccagggcagacagaaattactgttaaagatgaccttacagagagagagagggctgacctgtacaagacatatttgttatactgcataacaggggatgtaaccaagatcccatttggtgcacaaattactacaaagaaggacaacacagaatacctctatctaaatcagctcggtgatgtcctagggctgtctcgtaaggagattgtggaggttcatagaagtctagctgagcaagcatttaggcagcaggcagaggtcattctggctgatgggcagttgaccaaagcgaggatggagcaattagatgaggtgcagaaacaagttggcctgccaccagagtatgctcagaaggtgagagagaacattataaattcaaagatggctgctgccattgaaacagctattggccaaggaaggttgagtataaagcaaattagagaactcaaggaagccggtgtaaatattgacaacatgatagcagtgagcttacgagagaatctcttcaaaaagactgtggatgagatattttcttcgggttctggagattttgacgaggaagatgtctatgaaaaaattcctgctgacttgaaaatcaaccccgataaggctaaaggagttgtccatgaacttgctcgaagtagattagctaattctttagttcaagcagtggctttactaaggcagagaaaccgtgctggggtggtatgcttctgaagaccagtggctccttgtttctattttctttctttgtttcctttttattctctttgtcatgagtctgaaattttgcttttcaatttggcaggtttccacactcaatgatctattggcttgtgacaaggctgtgactgcagagccattatcatgggaagttccagaggaattaggagacctttttgccatatatgtgaagagcaatgcagcaccggagaagatttcacgtctacagtatcttctgggtgtcagtgactctacagcagctgctctgagagagagggaagacggaggacctagtgctggttctgaagctgaagaatttgtcttttagaaagatgaaatcgtgctatagtgtagtgcagagaagttatgttagtgaaaattcatataggttttattaagaaaatagcttgcttctacgggttttgtattccttgtacggcaaaggtttctaattgagtttctatcttttgtgttttcgcttccactcttcgtggtgggaggagctttttgatggatgtattctttgcatggtaatggtaaataattttcgctattgatgatttacaagcattttctgtatctgaataccttgtatctgaggccttttgtacactaggttgccatttgttatttcctctgcttcattattattttctttcttttttcttttttcattattattttcgattctgggaaaaatgtttttgcgaattattactgtcaagtttcaagcttttaatgatagttgatacatacgggagctgctgtctcgaatgttgtagaacgtcaacagacttgcattccggatttctgtctgctgtgttctaatctgctacacgatttaacagaacaaaatgatagtgctttaattgtgtattggtaacaactacaaggatcataacaacctagcaaaggaaagaaagaaaaataaaaatcaaagcgagagaagccgaaggacgacgaagtcaaaataactagggtgcactccagtgatagtaacataaagcttcttagtaagcgattaaggcattgagaaggttctgaaattaggtgcgttggggtgggtcgtagggtggtacgctggtcgttaggttgggatgagtcgataggctggggacctggggtgagttgcaaggtgatttgttggctggtagttgcctagttggtggtggggtttttttttcttgatttctttttaagtataaaataataatctttactaaagcaattcatactttaaaaaattttcctcccaagtgcactattaattattgcataaaaaatgttaaaaatatttaatggaggttaataaatgtgtgttgagtaaaagtttatatatttattaatttatatataactataaaaaaaacattttttgtggaaaataaaaccttatttttaaataattaaattttaaaaatataaaattttaatttagtttagaaaaatatgtattttatttaaaaactaagcatatgctcgaagattatcatataaagtaaccatagttaattaattcaatttattttagtgaaataagggcaccactcacaaagtcaagaaaatttaagtgtacgacttagaaattttaaaaaacatgagtacggtttaaaatttgcaaatcttcgagggtaaagggtagaaaaaacgaaagaaaataaagaagtcaaaaaaactagggtgcactacaatgatcgtaacaaaaagctcttagtaagcgattaaggcattgagaaggttctgaaattagggggttttgcaaacaggagtgcttggttctgacctttgtaacagtttgacttagttaaccagattctccactacaaatgtgttcatacactaacaaagcttcttccatttttcaacctacatcattaagtcaccctcaaaatgcctaatctcaccattatgtcaaacactaaacattttcattcctttaatctgatatatttttgtttttcgccaaatcgtacagttgaattctgtaatatttgactaagaatgttgagtgtataattttttttctgtttaaataacattaagctctaagtcttaagtggatgtatcatgtataaaaaggaagccagtaattgatgctcagataacaaagagaaattaaactagtgcatgtacattattttctcttcacattcttcaagtaccatgctcacttgcaatctgacaaagctgattttatggcttgggttgcttctgttaggagcagtcgaagcgcagctttcacctgaccattacgccaagacatgcccaaaagctctctttacaatcagaagtgctgtgcataaagcagttgctgcagaccatcgcatgggagcatctttgctccgacttcatttccacgattgctttgttaatgcatgtccacaactccctcattattcatttaaaagaaccttagaatggtgcaattaacgaagtttaatagcaacttatgactgacttgattcgtgattatatattttttctgtgtagggttgtgatgcgtctgttcttctgaacgatacctcaacattcaccggggagcaatctgcagccgccaatgcaggatctctaaggggattcaatgtgatcgacgatattaaatctcaagttgagagtgtttgccctggtgttgtctcctgtgcagatattctagctgttgctgctcgggattccgttgtcatagtaagtgaagcatcctgataactgcatatatgccacaacaccatctactagctaacttaattacaatgaagtagaagcttaaagtttaatacatgtatcaatagcttgtgtgaattataatgctgcagcttggtggtccaacatggagagtgccactgggcaggcgagattctactacagcaagcttaagcacagcaaacactgacattccatccccaactctggacctcagtggccttttatcttccttctcaaagaaaggacttacagccaaagaactggtggctctatctggtgagttaaatgttcgcgaaagttttcaggatcttatggtttcgatgaaacactatagtaacaggctaacagctaaatgtatctgacttattttcacgcaggagcacatacaattggccaagccagatgtgctgtatttcgaacaaggatatacaatgagagcaacatcgatgcaaaatttctcagctctgtgaaatccaattgcccaagcaatgggggtgacaacaatctaagccctttggacactaccactcccaatttgtttgacaacgagtatttcaaaaatctggtgaacaacaaaggcctgatgcatacggatcaacagcttttcagtggtggatccactgattctcaggtcacttcttacagcaaaaatccttcaacctttgattgggattttgcaaacgctatgattaaaatgggcaacctgagtcccctcacaggaacagccggtcagatcagaactagttgctggaaaaccaactaagttactgggttcctatcgttctgtttggtctattgttcttgggacgctactcaaagcattttagcaacttctaaaatttgacagatttaagctgaaaatgttttcagctttttaataatatatatgtatttcagcgttactgtcattttgatggcaaagctgaagtttatcataattacaagtatattgaatattttttgttcaaagaacactacaatatttacaatcgattgcggttaactggtagacttctgatcaagtatacgttgatagcagctacgtcgaaagagatattggacagtagtaatgtaatggggatcgagaggagtccaactgggtgagctttgagaaaggctagaaggcaaaataaagcatgctatttgcaattagcagttattaataattgatcattttcttgttacatatatggatatatgatgacattaagtgatcacatgttcgctcaacacaaggctgaacaaaaacaatccaaaaatgaaaataaactttcaatcagagaacaaaattagaacattctcaaagctagaatatcgctacaactgccacatccatcagcaaatcattctgagtagaaacttcttgcggaactgagaacaccggaaaccaactccaaaataacaaactcataccaatcagaaacaaggtcttaaatgcagcctcttcctggacctcccatgtaccttctaatcttgtgatcatctgtgaatttatcggaattcctttatttatcactaaccagcccgtgcttttcctcgtatatttccattctttgctgtatttcttctgaattggcaattgcaatccaactaagcatagaatgccaccaaaacccatctccacaacccattttttcatcctgcaatcaaaattctcagtctcccgaaagctttaaccctacaatcaacattaggttgttgaatgataaaaatgaattgtcagcaaggacagcaatatataaatcttggaagcacgaaacttaactcttggaagcatgaatcttcattcttgagaaacgagacagcttgcttcacttgacttcctgtggactgatccatagattataccgccaagtttttcaataactactgatgaacattatctggctaagtaaaactcagatcttactagatgaatcatgattaaattcatttactattggccctatttactgattttttttaaaaaaaaaaacttgccttgcacactttcatgtagccttgaaatactcacaacaggaccctgcatcaggaaaacaggaaaatatttagagctatgtgcattgggtacctacagcaaataaattcgccactgtcaggcatatcaggcaactcatctatgggcgtatttatatggctcacatgagattgggaagaacaagacaatccaattcagtttgacaccataagcaatcttattatttccctcagcatcatcctcaatcaggcgatctgtgatcatgcatccattctccttattgttttccaagtttccacatacgagcacttttaacttcaggcatcatctcataaacttcagctaccaacctaccaaaatttcctggaaatggatagtgcttgttcagcaatgttcgatacctagtctttgtatactaagtaacttcaacaactaagcagcaaacagacaatacacaatgactcttacataagaacccttattcacaaattctgcctcgaaaacagttattataggcttggggagcaagcaaaattctgtcttgaaaacagttatttggtagcatatgtagcatatagtgaatataattgaaagcatgcttcaattcaaaggcagtcatcacttacaaatgtggcaatgaagcggatctctgagattgaagattgaattcaccggaaatttcaatcatccttcctttcatctttgcccataatttgctatgccacaatataacaccatttcacttcaatacagttccgttttgtcagatggtaacccttgcttaaccacacactacaaagctcaaattggttggtcacagcatttggctagttaatggttatccctatctaaagatataatttccaatattgctcagtgcttagtttaagaaacaaatctcagattgcaattgaaaataggagtttcccagcaaactacatcaagtttttgagttagattatccaaaacaattactaaaacatgcaaggcaaatgtgggatttgtatgatacaatttgctatttaactgatgcaaggcttgatgatacagtaaaattgacaccagaaaatttacaaaaggaagatgatgtgactactaaaaagaaaaattaaataagtaaagtttaaggttgatgaatgttgcgaatggcagtcgtgatgcttttacaatcatactccatgactttaatccaattctcgaagtcaccaatttcctaaccaaacacaaacaaatacagtacacaaaatcaacaagatgaatgatgttatcgtagtccaaatttcaattgatcacatactcacaatgcacattataacaagaatctgaaagtttaaatcatataccttaatagcagtgttgagagagctcgaagcggacaaccaaagctgagtctgcttgtgaaaacggttaatagtagcggtaattgatcgaatttcagtttcaatttgtttttgacgaatgaatgattgttgaactccgccattgacagcatcaactagcagttccgacactcgatttccagctcgcatcgcttccttcttcgctttctctgatttgcacattaccaatcaattgattaattgatcaaccaaatcatatgatatttaatcgaagattccagaaacaaaaaatatttttaaaaaaatgtgcaaaatgagaaccagtttgttggcgaagagaggaggaggaaagttgatgttgatgaagtaaatgctgcaaagaagcttctacagtgttgtcatttgcagttgcacctgcaattgatgatgaagaagttgttgttgaagatgatgataatggcggaaatatggcttgtctcgacatcctgaaaatatcaacaattcgattttcttaatctggtgattggagttgcctttttgagaagtagctttgggctattttttggggaatttctaaactatccaggtaatttactggatatgctatctcagtggcatttacgcaattaaccataacgctgataaacttgcacatgctttagacgttaagttatttcacgtcagttaacattacttgttggtactgtacactgattttaaactgcagttaacaatgctgatttattattttaccatggttacagttagttgtgtctttgttgaagtagcaaaagtggcattcgttgggcatgtcagttaggtactaggtagtgtgttgggtacgattcatggaatcgtcgtctctggtaattttttttattgttggattatattgcaatttactcgatctcaattgcaatgacatgtagttcatgtttcgatggtggaagcttattttttaattgttcttattttctgagttctggtattgtcagtgactcaattctaatatggttagaattggattagttcttaaatatgttacttttcgattgcaggtggtagaataatccatacttatgattgaagccttgaaggtggtggtggaatattatattctcgggttgatgcttttgtaaacagatgccattttgatgtgttgttgaatattttggattcaatatattaatcagatcaacattgggtgaaacatcatagatgtaatcatgtaatgttaaagaattcttgtagcttggctattgtactgtggttccgctggaaacatgaatcgaaatcagtagacaatcctctcataagaggatttgtttttgtttttttaattacggagtatctggtcattgacattgtttttttaatcctcataacttaaggggatcctcatccccatccacaataagtaatgctccatatatggtaagtgcaattcatttaaatttggcaaaaattaccccaaatcactcatttcaacactaattattctaacaatgaatattttgtgttcggaaaattttacaaatttcgaaccctttaatttataattttatatgcatttgaaaaaaattaatcaagtgaattgtcaaccaataagggcggtttatacataattgcagataaaaaagctaactcaccccctcattaacagataaatgtaattatagttagagataatcttgggaatcattgatattagtgatatcatgttacttttgaacaaagtgctaataatgttacaatgaaaatatatttttcttttttctttttttaggggaagttacatctaaatattattttatttatttttgtgtaccactcgattcatcttttttgactaatctggattcgagaatcaattttggatggctaaatttcaatcctctctcaattgttattgtggccttgtgggggatcgaactcaaattctcactatcaggtgcaatctcaatcaccactacaccaacaatcaattggattggttctaaatacttcctcggatccgattctttgtatatgcatttgaaaaaattaatcaatttattcttttgcgtttgtaaaattgtacgtcaattaagggaaattagtattttgataaaatatgatggtattacttggaagttatattattcttaatttgtttgatatgtatgcagtaaaattaatgtgaatcttgtcatatgtaaaaatgaatggcgaagataagtttaggtggaagattgagaataatgaggtaataaggggtcatatgagatatttatgcgtaaaaataacattaatgagtaaaaaagtaaagcatgaaaaaaataaacaaaacgtaaataataaaaggaaataccgaaaaaggatacgtaaacaataaattgacgcagatggaatattatgcacgcaatgcgcgtgcaataactttttcatttaacttaggcttttaataatagtgtagtactcaacgagagaatatactataataatgtactgtatatagttgtaaattgttaaaaaatttattgtggttgatacatataaaagaatcagagttgaaaattatttgatagttctactgtttgaatgcataaaactggacttttagttaaattatgtatttattgataatgaactatgatgtttatttaatagaatataagttttaaaatttcaaataaatagcaatttttttaaatctataataaaattatatagatagacgaatagtagtatttcctttgatataaaaaaatcctcgtaaaaaaaaaacaacaaattcaactctttttcatgcattaagttcattacatttaggcttacacgatagctatgtatataacatttttcttacggagtaacatttttttatattatttacctataaaattcaaaagtttttcacacatattaaattgtaattttatatcataaactatcaagctcttgtggataaatttagtaaatatcatacattgcacgggtgttaaactatctcttatacaatataaactttcctgacaaatattaaattagaggtttatttcactctttatagagttttatgaataaatttagtaaataccgcgtatcgcacaggcctaaactagttctagtgaaatgttttctcgttcttttttatttgataaaaaaagtaaaataagattaatcttaattaataattccttgccataaatatttttcaacgtataaaatttcctattatttattaaaacaaatctaaacatacgtcaataaaaaaattgttacggtttatgcactatatatgtactcgtttttatgcacgtgatgcgtgcgggtttctttcgtactataccaataattgttctataaaattgggcattttatgccttatatattgactaagatgatgaacaacacaatatttatagttggatttcatttgactcaattagttttgtaactggagttcatttgactcaattagattttatttgactccaatagctttgagtctttgattttatttgattcaactagctttgtaattggatttcatttgactctatatatttgtagttggatctgattatttgactcaattagctttgtaattggaattcatttgcatcaattagatttcatttgactcaatcgcatttcaaattgacttacctttagattgtcatttgactcgagtagatttgtaattagatttcatcgctacacctatgccaacttaaaattctaatggcagtggttgccaaatgatttaatcaactaaggctctattctcgtcaactgaattttgtttaactgaacttatttttactgaactaaatttattggtactgaactgaactnnnnnnnnnnnnnnnnnnnttattggtattgaactgaacttattttttctgaaaccttaacaaatttcttaaggattgaacttatttttactgaacttaatttatttttactgaactgaacttattgctactgaactgaacttagttttactgaaacttatctaaacaagttgacgaaaacagggcgtaactagtcttgtcaatatgattcgatcacctaacaagattagataatttgattgtttgatttgagcatttgatcatattacttgatcataacacttgtcgatataattcgatcatctaatacaataatcagatgatttgcgtttgatttgagcatttgatcattaataatcgatcacaagtcttgtcaatatgattatattcgatcatctaacaggattagatgatttgatctatcgttcgatttgaaaatttgatcataagacttgtcgatataattc

SEQ ID NO: 667 - DNA, 2964 bp, Kochia scoparia
tcgccattttctttttaaaaaagtagtgtttttagttaaaaaatgaagtgtcaagtgtcggtagtgtcgacacggacacgtgaggtaaatgaaagagtccgagtaacataggccctcctggcattagttcacagatcgtgttgtagtgctgtacgtttaataatattttcgtagtgttaaattagttgttactgatatagttggatttgttttgtacagttggcgggggagatgttcaaagatcacacaaggaaattagtagaggaatgcatatcaaaagctctcgatattttgaagtcccggaccagatcagggtatggttaatgctgatttgcttgcctatcaaatacaggcagaccttgttatttgcttttgcattgaggaaattattaacttcatgatgacagtgcttcagtgtcttttcaccctcagttcatgcatatttcatttttacctttatgtttgacagaggtagtaaagaggttgtggaagagctcaataaggtgatcacttttaatgagatgcttgtttcattaagaaaccatccagatgctgagaatttggcccgtggagttgggtcagtttccttagtaggtaatgctgctctttttcttgtctgtttatatgtttttgtttctgttcatgagctagtactgataccactagtgttcatttgcttatttctgtattggttgtcaggtggtgattatgacactgacaggaagattgatgacttgaagctcctctatagagcatacatcacagatgctttatctagtggccgaatggaagatagtaaggtaataataaatttgttgcaaatcttattgagccacgggttttcccatggtctcaaggaaaaactgcaattgaaaggtcttggacagcctttcttcttggatatggtgaatccattctggatgttaatacagtttgatatatttgtaggcatggaaatgtattctttttcatttgaaagataggataacgaacagttatctcttatacttccaacacttctttttttattttttataattgcacctgtacataaggggagacacgtctgtagatagaaaaactttattgccaaaaaaggaaatgatgcaagcaatttacaacttccaaaaatggaaaatggtgcaagtattaaaaataaaggtggaagtatatttttttcaacttcagtgtaaacctatatttagaaatagaatgatgggaatagagcttttagtaacaaattggaacccctaattttttcatgagatgatggaaggatgatgccatccaatggtctttgtttctacaatttcgcttaagtctagagaatgatgctattgctcgaactcccaaactttttcttgtcttgttacaacaacttccttttcccaacctatagcctctttgttccagagactcctcttgttatcccataaaatatcgtgcttatcacttgttcaagttagtcatctcaccctccatgattcttatgtggttgagctatttgtatatatatatccttatgctttcttttttctctgtagctggctgcattgaatcagttgaagaacatatttggccttggaaaacgtgaggcagaaagtattatgatggatgttagctcaaaggtgtatcgcaagcttttgggtcaagccttttctagtggtgatctggatgcagcagacagcaaagcggcttaccttcagaagttatgtgaccagctgcggtttgaccctgagaaagccagtgcaatccatgaaggtactgctctcttttaaatggctgataaatttgtgatatggcattaatatatatattctaggggtgcgcctatgtgggggacggagagggaaagttttgtggccttctgttttggttttgcctgccaaatcatgatccttctaactatatagccgggttatttcttttgtaccagaagttgcagggctcatattgcttctgagaaggctttagttcatgtgtatttttcctgtggaaactctttataagggagtttataacaattaaactatttaaaattgataaatgatttaaattggaatgagtttatttaaatatattttaaatatatatgttatgatttttgaatttgatttaattgtattctttttaatatatttcctccattctatattactcgcaaggtttccatttcatgcttgccaatgaataatctatgttcctaatatatttagttatgctttgccaaaagtttataaaaattagattataattaagtacacattgatacgaatttaaagagatctcacatgactatttttttacacgtatgatgctcaaacgctagttatatgagtgactttgaacagtagcaaattgcagcagatgacttactattttagtatgtaatttcagtgtaagtatcccattttgaatttaatttaatagtataagattgttaagattaatgattaaggcacgcattgcataaaattcaagttaaaaatattgtgggtaaactaagatttttgtttcctaaatttatttggtatagtttgtgtgttaatttttattcattgattggttgttgttgctgttgctgtgaaattacatagaaaatagagtgggagtttttttgacccaacagtgacatgtgacacttatggtttttgtctttgtaatatattagaaattccgattcttgataaaaaaaaaaggtcgatttgaagagaaggtaaccattatattgtgatggtacttgatttggggattttgtagaatttatatagatagagagcagcgttgcttgaagtttcggaaaatttgaacattctgtataactcactaattttgtagaatttatatagtttagcctttgaattgaatgtactagttttatgtgcacgcgatgcgtgcatagactcgtaaaaattgcattccatgaaaaatggttttataatatatatatatatcaaattaaaa

SEQ ID NO: 668 - DNA, 285 bp, Lolium arundinaceum
ggtaagtgtttctgcttggaagtacatggctacttagaactgtctgcagaccctaatagtaacaatggaaaatctatcataggcgtttcaaaagctgatatatgtgtcaaatcttgtcttcggagatgcatcagccttcctacttccatggaaacgtcttttcgggatcactgattctcaggtacattagtatgcatccgtttaccttgtgcatagcatgcctcagttttatgatttcatgtcatggtaaaagcagaacagtacctccactatggtgtttggtaa

SEQ ID NO: 669 - DNA, 1074 bp, Lolium arundinaceum
caccacgccctcgataagaccagcaattttcaacaaataaaacgagatatacactgattcaagtactgttcacaatgaactaatgcctgggagaattcataatcttataagaataacttacaaaagtctctcgaatgatacccatgctggcccctttgagaccgggttgtctgaaaatttatccatcaactgccgtatttcttaagagtttagttgggatcctaaaactctaaatagatgagacatggactttcacagtatatgcatctctataacagagctatttttttctcaattatataattgggaatactcatgatagattgattagctctacttagttgatttcacagtaacaagtactaaattgcttgagcagtacataacttaggaatcttatcgtacttcttcagcgtgaatctttcattttggtccataccaaattggcaagtctatcaatgttatatggttgtatcttaacataagtcttgttttgatacaaaaatgcagcttactcctttaaatgatttacgcaatatatttggattggggaagcgtgaagcagaatcgatcatctccgatgttaaatctcaagcatacaggaagagacttgcaaaatgctttaacagcgatttggctgcggctcctagcaaagcatcgttcctccaaaatctctgtgaagagctacattttgatcctgaactcgctagcaagatgcatgaaggttgacacttactttttattgcatcattatttttacatcatatgtctatattagctattgtgattatcaagttgtactaatgccacttcatacttcagacatttacagacagaagcttcagcagtttgtagctgacggagagctgagcaaggatgaaacagaagctttgatggcattccaagtgcgtctttgcattcctcaagaaactgtcgatgctgctcatgccgacatatgtggccagttgtttgaaaaggtgatgtattttatggtgtctttcatgtaacagactgcataattcaagttctgttccagatctgcattagcttagcaaagttgatggcctgttctgt

SEQ ID NO: 670 - DNA, 377 bp, Lolium arundinaceum
actattttttgacaagtacatctagattttaacgttacaatcttttgattgacactatcctcatcttaataattttatacaatgtaatctttaaactttgcgtggtttcaccctcctgaacattagccatccgctcatcctttctcctatccattttttctgcagctttctttactcagtacttcctccaggagatgaagatcttaaaggtaacgaggttgaggttattgtaaaatttaaaagaggtcttggactcgatgatgttgatgctgcaaatatgcacatggaggtattgcctcatgattcaagccttttattatatgttgatattcgtttcagatgttattattgctttagtcatcattttcacaattaca

SEQ ID NO: 671 - DNA, 304 bp, Lolium arundinaceum
aggaggctgctatgaccatcttcagtaaagcagtatgcctcttgccctccaaaataacatgctacatcaattgccatatattcttctccattgcaaatccaattaattttctgtattaccaatttcaatgacaggtacggaaaattattcctgaactacattcagagagcaaaagcagctggcaaccgcattgagcaggcaaaggagttgaagaagttaatttccttcaacacagttgttgtaagtgagcttctagctgacattaaaggagagctaacaactgctgaacctgcaacatcaagtg

SEQ ID NO: 672 - DNA, 712 bp, Lolium arundinaceum
ttatccataatgggtcacctttcccacgcataggccggtcgtgttcttggagttgcaggctttaagtactgttttgtctatcctgaacaatagcatttgtactcaaaccagttcatagaagttattagacttatatttgatggatatatctgatttcactagaagggagtatttaacttccatcgtgaaaaacctgagccatctaccttctaagggaatgtgagaacaccaacaaaatacttgagaaattgtgtgagcttttcttgatcagtatttagaaaatgtattatcctgttggagaagtggtcaatccatctgaatcctcataaatttggattttatcatgtataacgtgaacaaaattttaccttgatgctaaaccatatgatcgctgattacaggaacattccagaacaggttattgatgaagtgaatactatccttgcattcaatagttcgctaacagttctaggcaagtttcctgatggcgaccgatttgcacgtgggcttggccctgtttccttaggtaaaaaagtggtaaagttttattaaattcttatgttctttagctggcctttcttaagaatggttcttgtgcataggtggagagtttgatcatgataggatggttggtgatctaaagatactctatgcagcctatgcaacggcagtactttcagatggaaaccttgatgatgagaaggtaattcca

SEQ ID NO: 673 - DNA, 574 bp, Lolium arundinaceum
cctcttcgccccgcttaaacccttcccgctcctccgcttccccccgcggaagcacggcgccttcgcccgcctccggagccggcgggtccgccgcgtggcggcgtcgggagacggagagggcgacgccccggctcgagacgaggaggtgttcggcggccggagggaggaggtgttcggaggacggagggagctcaccggcgtgcagccgctggtggagtcactaccacccgcggcgcggacggcggcggagctcgcggtcgccgcggcggcggtggctgcggggtacggcatcgggctccgcctcggcggtggctcgcgggccgcggcttacgctggcgcggccgtgctcggggcggccagtgtcgcgggggccgtggcggtcaactctatagtgccagaggtcgccgctgtggggctgcacaactacgtcgccggctacgacgaccccaccaagctggaaaccagcgaggtggaggccatcgcgaacaagtgagtttggttttgcctctgtatagctgctgcgttcgttttatgctcgattcgtttataacagctagtagtatctgcttatctc

SEQ ID NO: 674 - DNA, 879 bp, Lolium arundinaceum
gagggagaggatggtgactatgaatgggaatccctggaaacattaaagaagactaggcctgataaagagctaaaagaaaagcttgagaagtcaagtcagaaagacataaccctcaaagatgatcttccattgagcgacagagctgagctgtaccgaacatatttgatgttctgtatcaccggggagacgaccaatgtttcattcgggacagcaatctccacgaagaaagacaattcagagtatatgatgctaaagcaattgggaaacatacttggtttaacccgcaaggaagctcaagatgtccacattaagctggcagaaaaagcatttgtcgaacaggctgaagtagttctagctgatgggaagttaacagaatccaaggctgaccagcttgcaaagatacagaagcaggttggtttgcctgccgaccacgcacagaaaatcattaagagcatcacaacaacaaagttgtcttccgcaattgaagcttctatagctcgagggcagattggtatacagcaggtccgaggacttaaagaagcaaattttcagctggatagcttgatttcagaaccgttgcgagaaaccatttacaagaagtgtgcagaggagatattttcatcaggcacaggtgattttgatgaagatgaagtgtatgtaaagatgcctgctgatcttatgataagtgctgagaaggccaagtcgattgttcagggcattgcaaagcttaggttggagaacgctcttgttcaggctattgctttgcttcggcagaagaagaaagatggtgtggtaagttggtaccctgtctctttgcttcgctaaatttacaaaattgctcctagagatatagtttcgaggaaacaatcatatacagat

SEQ ID NO: 675 - DNA, 750 bp, Lolium arundinaceum
aaatttatttcattgcttttatgtctaacaacattcatatccaatgcagatctcatcgctcaatgacctactcgcatgtgatgcggcagtccctgcttcgaagccattgtcatggcctacactgggagagttggatgacttgtactgcgtctacatgaagagtatcccgaagcctgataagctatctaggttgcagtacttacttgccataagtgctgagaaagctaaccagcttcgggatgccgcaacagcaggcacgctgccagtcacagctcaagaggaggaagaattggcgttctaggagggatgtgaagacacttttttgttaggtagccagcagagtcgagctcctgccacacgaggtgctgtggcgccaacatctgctgttttagctagggcatggttttgagaagcaacttataatcctgagatgcataaattatttgtatagacagatttgacaccacaaggtgacagttttctgctgcattctttcaaaccatactgagaccattttatgtatgttcttttagtcgtgtaccactgcaatcccttgaaataaatgtggttttgttgtaattcacgtgtcagaggacgctgttctctctttcccacgtcgcgacgaatcgtttgacaaagataacaaataaactgactaaaaactcatcaaatcaaccacgaagcctaagacagaagtcagagagccctgatgtgatgcgtagctaagctgtcgactgggttttctttacc

SEQ ID NO: 676 - DNA, 478 bp, Lolium multiflorum
aggctgaccagcttgcaaagatacagaagcaggttggtttgcctgccgaccaccacaggaaatcattaagagcatcacaacaacaaagttgtcttccgcaattgaagcttctatatctcgagggcagattggtatacagcaggtccgaggactgaaggaagcagattttaagctggatagcttgatttcagaaccgttgcgagaaaccatttacaagaagtgtgcagaggagatattttcatcaggcacaggtgattttgatgaagatgaagtgtatgtaaagatgcctgctgatcttatgataagtgctgagaaggccaagtcgattgttcagggcattgcaaagcttaggttggagaacgctcttgttcaggctattgctttgcttcggcagaagaagaaagatggtgtgatctcatcgctcaatgacctactcgcatgtgatgcggccgtccctgcttcgaagccattgtcatgg

SEQ ID NO: 677 - DNA, 575 bp, Lolium multiflorum
ccaggctattgaagaagtaaagagtgtccttgcatttaatagcctgctaaccgtactgagcaagcatcctcaagcgatcgatttgcatgtgggcttggacctatttcattaggtggagagcatgatcatgataggagggctggtgatctaaagatactctatagggcttatgcaacagaagtactttcagaaggactccttgataatgagaagcttactcctttaaatgatttacgtaatatatttggattggggaagcgtgaagcagaatcgatcatctccgatgttaaatctcaagcatacaggaagagacttgcaaaatgctttaacagcgatttggctgcggctcctagcaaagcatcgttcctccaaaatctctgtgaagagctacattttgatcctgaactcgctagcaagatgcatgaagacatttacagacagaagcttcagcagtttgtagctgacggagagctgagcaaggatgaaacagaagctttgatggcattccaagtgcgtctttgcattcctcaagaaactgtcgatgctgctcatgccgacatatgtggccagttgtt

SEQ ID NO: 678 - DNA, 1496 bp, Lolium multiflorum
ggtgcgatcgcccaacctagcaatggagctctcgctcgtctccgccaaggcctcgccccgcgccgccaccgcagccgctgcctccccgctcctcccctcccccacgcgtggccgcgcacgcctcggcggccgggggttccgctgcgtcgcggcggcggccaagggggaggatgtgttcggcggccggaaggagctctcgggcgtgcagccgctagtggaggcgctgccgcccttggcgcgggccgcgcttgagctcgcggtcgttgccgcggcggcgacggcggggtacaccctcgggacccgctacggcggcggcacgcggaccgcgtcggtcgcgggcgcggccgtgctcggggcggccggcctcgcgggcgccgccgccgtgaactccgtggtgcctgaggtcgccgccgtggggctgcacaactacgtcgccggccgcgacgaccccaccgagctggaggccgccgaggtggaggccatcgcgagcaaatatggagtcagtacacaagatgcggctttcaaatcagagctctgtgatttgtatgccagctttgtttactcagtgattcctccaggacatagagatcttaaaggtaatgaggttgaagctattataaagttcaaaagagctcttggacttgatgatgtagatgctgcaaatatgcacatggtggttggtagacgcttatacaaagagagcctcgatgcgttccaaaaattaatttttgtgtcaaatcttgtcttcggagatgcatcagagttcatacttccgtggaaacatcttttcgggatcacggattatcagattgatattgctatgcgggagaatgccaaaagtttatatgcgttagagctcaagtctattggaagaggtattaacattggcacagtcattgatataaggagggtacagcttgcatataaactttttgacgagattgctgctgacatgttcagggagcatgcgaagaacttgatccaagaaaacatttcatctgctttatccatattgaagtctaatcccggttcgacgaacattccagaacaggttattgatgaagtgaatactatccttgcattcaatagcatgctaacagttctaggcaagtttcctgatggcgaccgatttgcacgtgggcttggccctgtttccttagctggagactttgatcatgataggatggttggtgatctaaagatactctatgcagcctatgcaacggcagtactttcagatggaaaccttgatgatgagaagcttgttcgcttgagtgaattgaggaatatatttggactggggaagcgtgaagcagaagcaatcatagaaggagtcacgtcaaatgttacatctcaagtaccggcataatactctgtgtgtgcatcgatgcagattacagaaattacactatttgaaaaccgttttctttgttgaatcatgaagcaaacaaagagaacaatgcaattcgaactgcgccacatccatttgaattgct

SEQ ID NO: 679 - DNA, 414 bp, Lolium multiflorum
gcattaatctaaggatgttgtcttctaacatatctgaacatttgaatttcttgcagattgctgctgacatgttcagggagcatgcgaagaacttgatccaagaaaacatttcatctgctttatccatattgaagtctaatcccggttcgacgtatgagcctacttttttgaaaaacctgatgaaagattttatcatttgacattttgcatgaaaattatactcctttatgacaaaatgaaaacctaaatcagtgttaccgatcatctaattaattgagagaagggcacaaccatgttttttgctaaatctgatacacctagttttaatgtagcaatatataacagaggaaaatagatagtgcatagaagttagaaataatgtatattttcatcccttgttcccaacagaggtta

SEQ ID NO: 680 - DNA, 302 bp, Lolium multiflorum
ctttattcatattgtgcttacaaggtttaactttttcaaacacattagatttagggcagggaaggtagcaatggcatcttctgtaatcgtactaattacctgacatattacttgctccatttcttgaaaattatcatctgacgtatttgtttctataggtattaatattggcacagtcattgatataaggagggtacagcttgcatataaactttttgacgaggtaaccgttttcttatcacaattttactgcttcattggcttcatttggttttacattttgtttcctacttggggcacaa

SEQ ID NO: 681 - DNA, 301 bp, Lolium multiflorum
aagtgattcttcttagaagtacataagcatgttggatacctgaacagtcttcaaatccccgttataactaagggaaatatttcataggcgttccaaaaattaatttttgtgtcaaatcttgtcttcggagatgcatcagagttcatacttccgtggaaacatcttttcgggatcacggattatcaggtaaatagagacattcgtcattcatttactactatgcatagcatcaatttatgacttcatttatggagaaagcacagagctacctccattatgatattttgatcacttgcactca

SEQ ID NO: 682 - DNA, 529 bp, Lolium multiflorum
acagtattggacgtcatagttggcattcactattatgttcacctctatgctgcttttatcctactacaaccaaaatatattgcccaatgctacacatggttctttacctataaaatttatacagcatcatttgctcttgtggtgatgataatgtgggcttgtattcctgtttattaggtagtatgtatttttctccttttcgaagtaaatataaaaaaatcacctatacatagttcacatcttaacaatctggccatgtggtggatattaaccatgcacttatactttctcctatccattctttccgcagctttgtttactcagtgattcctccaggacatagagatcttaaaggtaatgaggttgaagctattataaagttcaaaagagctcttggacttgatgatgtagatgctgcaaatatgcacatggtggtattgcctcatgatcctgtcccttctatatcttagtatctatctcaaatgctcttatgactttactcattgctttcacatttactctgtgatat

SEQ ID NO: 683 - DNA, 973 bp, Lolium multiflorum
gtactgagcaagcatcctcaaaccgatcgatttgcatgtgggcttggacctatttcattaggtaatgttataaagtttttcaatttttgacgctcatgaggtggaccattcttatgaattccctgcatggactccataggtggagagcatgatcatgataggagggctggtgatctaaagatactctatagggcttatgcaacagaagtactttcagaaggactccttgataatgagaaggtgattactactacatgttagttaactgatgctccatatgaaatgacaagctgagttaagttctcaataattccgtaggaatgcaaaatttgtaactcagataaacccctataattgttaagcatattgatttaagtagaccagttggctataggatttggaaaatacagcctggattttatgtagacaaagtaagtccagtgaaatctttggattgccgacaacacagtctagatcatgcagcttgtactgctatggctggcactgaaaactgaactgctgtctatgtcacacttcttctttcttgtatttcacattatgttgttcacatcatgttagatgctgaactaaacaaatgtaagtgttacatgttactattgttaagaaataataatttgtgggtcctagggccacacatcagtacataacttaggaatcttatcgtactcttaagcgtgaatctttcattttagtccataccaaattggcaagtctatcaatgttatatggttgtatcttaacataagtcttgttttgatacaaaaatgcagcttactcctttaaatgatttacgtaatatatttggattggggaagcgtgaagcagaatcgatcatctccgatgttaaatctcaagcatacaggaagagacttgcaaaatgctttaacagcgatttggctgcggctcctagcaaagcatcgttcctccaaaatctctgtgaagagctgcattt

SEQ ID NO: 684 - DNA, 554 bp, Lolium multiflorum
cccctgtacagttcagttgctgcactggtttcacgcttcagttgtttatatcagcagctgtttaatcatctgaagtttttttttatttttgcaaaaacatatcatctctagcttccgttgttctatgcgttttcgtagtctcgcaatgccgtctgttttagtcatttttgaacatccgatttcctgttaggatgctagcaaaattttggtgtacgttttctgagtacaagaagaacttataatatgaggattctcctttgctaatcaggtagaattttatgctggtgatgtagtttgtataatcatacatattaaactttcattgaaatattggatgcctcgctctttctcccatgatcttatcatttacttttcataatcttctagatatggagtcagtacacaagatgcggctttcaaatcagagctctgtgatttgtatgccaggtgagcctcttgaaacctctgatgatactgcattcagttgttttccatgattgtgaacatgctatgcacaaggctgccagataaacactggctttcacgagtaattg

SEQ ID NO: 685 - DNA, 737 bp, Lolium multiflorum
cagcatccctcagcctggcatccgaagctgagcagggtcacacccaacagcactatagaaaccgccttccggattccggtagcacgccctaaccagagcttgctagcagattgtgaataaacgtaatatacatgcacatcctctgccttgtatttttcttctatttggagcgtcaggatatacccaactcaatctggtcttgacaagaccatagtgagcgcgttcgagaagctgtgataaattatgcttatggtcaaattgtgaattttgtctggctggatttagttcatgcctcaaagattagcttaacccaaatgatttatcagtaaaaatagtttatttatttttcctttatcagtatgtaaaatgcaatacataacttgataacttggcaactgtattttagcgtttcatgacagcaccatcttataatttttacctctctatagaatctggtaatttgctttgtggggtagcattttaacagaaatctttatgtgataaaaaatgcagcttgttcgcttgagtgaattgaggaatatatttggactcgggaagcgtgaagcagaagcaatcatagaaggagtcacgtcaaatgttacatctcaagtaccggcataatactatgtgtgcatcgatgcagattacagaaattacactatttgaaaacagttttctttgttgaatcatgaagcaaacaaagagaacaatgcaattcgaactgcgccacatccatt

SEQ ID NO: 686 - DNA, 970 bp, Lolium multiflorum
gcttgcaaagatacagaagcaggttggtttgcctgccgaccacgcacaggaaatcattaagagcatcacaacaacaaagttgtcttccgcaattgaagcttctatatctcgagggcagattggtatacagcaggtccgaggactgaaggaagcagattttaagcttgatagcttgatttcagaaccgttgcgagaaaccatttacaagaagtgtgcagaggagatattttcatcaggcacaggtgattttgatgaagatgaagtgtatgtaaagatgcctgctgatcttatgataagtgctgagaaggccaagtcgattgttcagggcattgcaaagcttaggttggagaacgctcttgttcaggctattgctttgcttcggcagaagaagaaagatggtgtggtaagttggtcccctgtctctttgcttcgctaaatttacaaaattgctcctagagatatagtttcgaggaaacaatcatatacagatcttgacgtatttccaagatgttggtaaccgtaaaggactcatctggataaatttattcttggatcactgacacaatagattgatgaaaccagattgataggaaatttgtgaggtgtgccagactctgaaaaattctgatggtattagattaaatgcataacgcattaacggatacaaagctactttatacaactttttatcttatcctgaagtttctgttgaaatttatttcattgcttttatgtctaacaacattcatatccaatgcagatctcatcgctcaatgacctactcgcatgtgatgcggccgtccctgcttcgaagccattgtcatggcccacactgggagagttggatgacttgtactgcgtttacatgaagagtatcccgaagcctgataagctatctaggttgcagtacttacttgccataagtgccgagaaagctaacgagcttcgggatgccgcaacagcaggcacg

SEQ ID NO: 687 - DNA, 808 bp, Lolium multiflorum
gaaaaacctgagccatctgccttctaagggaatgtgagaacaccaacaaaatacttgagaaattgtgtgagcttttcttggtcaatattcagaaaatgtattatcctgttggagaagtggtcaatccatctgaatcctcataaatttggaatttatcatgtatagcgcgaaaaaaattttaccttgatgctaaaccatatgatcgctgattacaggaacattccagaacaggttattgatgaagtgaatactatccttgcattcaatagcatgctaacagttctaggcaagtttcctgatggcgaccgatttgcacgtgggcttggccctgtttccttaggtaaaaaaagtggtaaagttttattaaattcttatgttctttagctggcctttcttaagaatgattcttgtgcacagctggagactttgatcatgataggatggttggtgatctaaagatactctatgcagcctatgcaacggcagtactttcagatggaaaccttgatgatgagaaggtaattccacgtgtgttcgcatttaatttattaaaatcatgctgattttgaattgataattgaaaatatgggatcgataattctataggctgataacctgacctatccgaataaacccccataacatcttgatttaagttgagtagggcgaattaaaaaggctgtggaatcttaaacatatctggattttatgtggataatttttttggagcaaaccttttggctattcattaagaagaaaagaaaatgatccagtttgtaaggaaaaccggatcgaaaaccatacaaac

SEQ ID NO: 688 - DNA, 268 bp, Lolium multiflorum
aagttcaaaccctctggtgctatgcttaaaaaaatgaatcttatcaatgtagaacatggacatgacttctttgctaaaccatcttatcactgctcacaggaatgacccaacccaggctattgaagaagtaaagagtgtccttgcatttaatagcctgctaaccgtactgagcaagcatcctcaaggcgatcgatttgcacgtgggcttggacctatttcattaggtaatgttataaagtttttcaatttttgacgctcatgaggtgga

SEQ ID NO: 689 - DNA, 4108 bp, Lolium rigidum
ttttaggtatggagttagtacacaagatgctgccttcaaagcagagctatgtgacttgtatgccaggtaaacctcttgatacacctgatcctccatgatagtgaacatgtggatgaacacttgaacagaacaaccagataaatattggcttcttctccagtgctacttgtatactgaacaaaatctactattctgttctaggcactgatttactctggataccccatattctgttagttattagctactagccactgcaatctcactcttcaaagggattgtactatcatcttaggcatcaaggcatctaaatttatctggttaggccttggaaaatgaaccgctttaggcgcctaggcgcgcccgcctaggcgtcgcttaggcgtcagagcgcccccacaccgctctaagaccccttaacgccttcaaaaccatgccctcctgtcccaaaatggtgccacttttgacaacttataaaacagcgcgcagtattaaagtttgtagtataatatttctgtaaaaatctgcagtatggtggaagtgctgtgacctcagacgactatccactatcattttcgtatggtgaatctttaaatttgttaattttgggagacattgctggtccaagtgagcacgattgaactcaaaaatctcgtacaactcttttactatactattttttgacaagtacatctaaattttaacattacaatctttagattgacactatcatcatcttaataattttacaatgtaatctttaaacttgcatggtttcaccctcctgaacattagccatccgctcatcctttctcctatccattttttctgcagctttctttactcagtacttcctccaggagatgaagatcttaaaggtaacgaggttgaggttattgtaaaatttaaaagaggtcttggactcgatgatgttgatgctgcaaatatgcacatggaggtattgccttcatatctaagccttttattatatgttgatattcgtttcagatgttattattgctttactcaccattttcacaattacacagttttctctatgcctccttatgcgttttaccttgcccattgcaacagattggtagacgcttatacagagagaggctggaaacaagggaccgcgaggctgacatagaacagcggcgggtaagtgtttctgcttggaagtaaatacatggctacttagaactgtctgcagaccctaatagtaaccatggaaaatctatcataggcgtttcaaaagctgatatatgtgtcaaatcttgtcttcggagatgcatcagccttcctacttccatggaaacgccttttcgggatcactgattctcaggtacattgatatgcatccgtttaccttgtgcatagcatgcctcagttttatgatttcatgtcatggtaaaagcagaacggtacctccactatggtgtttggtaatttatgctgaaatttgaagcgtaattacagacattgtctaacaatgttgttactgggagagaccttctgaaccatgttgagcatgatctttggctctttgcatagtctttcacccttcatgatgcaactgctggtctttgcatgattgttttatcttggccaattctactacccacatacatacatgattccaagtttgttgtccttattgcggttcatacctgtctaccattaaaaatattatgtggtgaatgtaatgttatccactatcgcacatgcaacatctaacaaaaaaatagacaggctgtaattatttagtgtcattgttttgtgactatcatgatcaaatttctaaagtttgagcagtatagattttaaatatttttattggagtagctgttgtagttgttgaaagggaagagcttttgtgttgataaggatgaggacattgattgctttaacatctacagattgcacatgcatatggctcaaatggtttttgctcataaagcatgtcttttaaactgcctgctcatcccttattactttggttcatagttcctgtgtctgttcttggttgacatgtggttgttttgttacattttcatgatcttttggcagatagacattgctatgcgggacaatgccaaaaatttatacgcgatgcagctgaagtctattggtagaggtagtgctgaaactgtcttttgttggcattagttgtactcttatgttatattgtgcttacaaggtttgtcgttcaagtagattaaatttagagcaaggtagatagcaaaggttattatctcttgttatactaattacctgatatatcacttgttgcatttgatgaatgttctcacctggacatattctgtttccctaggtcttgacataggcacactcattgaagtaaggagagcacagcttgcttgtaaactttcagacgaggtaaactttcagccgggttgctgtatcgtttcatcagcagggtcttcttgcctgtctccaaatagtgtagatctaaggatgttatatacctgtcaagagtagactatggacacaccataagaggtttctatttgattgttgatatcaatctaagtaggtaggaaataacaaatgcatcaatctacgcatactgtgttataaatatcctaatttgaatttctcgcagattgctgctgacatgttcaaggagcatgcaaagaagttgattcaagaaaacatttcaacagctttagacattttgaagtcgcgtaacaaagccacgtatgaagactgcttccctactgactgattttatcatttgatagtttcaatgaaaacatgaactgacatattaactgctaataatctgatggtttttagagaagtgaacatttatttttggtaaagccaacatataggtattctgctcattagaatctctcctgattattataattgagggagttgttattccttaactacaatgatgaatttctcttgttcgtaactaacaatgatgaaatgtctccttgttcacgacaagagttttgctgccttgttggagtttcaagctttcactattattttgtatcagtggcagtgacatatatactcaaactccagttaaaattcttatctgtattattgtacgcaacatgcagtttatattaggatatactatataatttgatggattgatctgctttaaatagtacaacctctgtctggaaataagtgactcacctttatctagatagttaagtcacttccggacggagggagtagtagagtattttactactatgttaaaaaaacttgagctatctggcaatcttttttttaacagctatcttgcagtctggcttaagtaaatttaagaaatactttagaaacataagaaaccccatttgtttcgttggtcaattgtcagcaactatatgaatctctgtcaagaagttcaaaccctctggtgctatgcttaaaaaaatgaatcttatcaatgtagaacatggacatgacttctttgctaaaccatcttgtcactgctcacaggaatgacccaacccaggctattgaagaagtaaagagtgtccttgcatttaatagcctgctaaccgtactgagcaagcatcctcaaggcgatcgatttgcacgtgggcttggacctatttcattaggtaatgttatcaagtttttcaatttttgacgctcatgaggtggaccattcttatgaattccctgcatggactccataggtggagagcatgatcatgataggagggctggtgatctaaagatactctatagggcttatgcaacagaagtactttcagaaggactccttgataatgagaaggtgattactactacatgttagttaactgatgctccatatgaaatgacaagccgagttaagttctcaataattccgtaggaatgcgaaatttgtaactcagataaacccctatattgattcaagtagaccagttggctataggatttgaaaaatacagcctggattttatgtagacaaagtaagtccagtgaaatctttggattgccgacaacacagtctagatcatgcagcttgtactgctatggctggcactgaaaactgaactgctgtctatgtcacacttctccaaacgccaattcttctcgcctt

SEQ ID NO: 690 - DNA, 2791 bp, Lolium rigidum
gggctaagcccctttgtacatcctttacctctatcttgtacatatatttcttttttaataaataaattttactgtcggggcctcccctacagttttcagctcaaaaaaaatgtcacacttcttctttcttgtatttcactttatgttgttcacatcatgttagatgctgaactaaacaaatataagtgttacatgttactattgttaagcaataataatttgtgggtcctagggccacacatcagtacataacttaggaatcttatcgtactcttcagcgtgaatctttcattttagtccataccaaattggcaagtctatcaatgttatatggttgtatcttaacataagtcttgttttgatacaaaaatgcagcttactcctttaaatgatttacgtaatatatttggattggggaagcgtgaagcagaatcgatcatctccgatgttaaatctcaagcatacaggaagagactagcaaaatgctttaacagcgatttggctgcggctcctagcaaagcatcgttcctccaaaatctctgtgaagagctacattttgatcctgaactcgctagcaagatgcatgaaggttgacacttacttattattgcatcattatttttacatcataggtctatattagctattgtgattatcaagttgtactaacgccacttcatacttcagacatttacagacagaagcttcagcagtttgtagctgacggagagctgagcaaggatgaaacagaagctttgatggcattccaagtgcgtctttgcattcctcaagaaactgtcgatgctgctcatgccgacatatgtggccagttgtttgaaaaggtgatgtattttatggtgcctttcatttaacagactgcataattcaagttctgttccagatctgcgttagctcagcaaagttgatggcctgttctgcgcaagtggttttcttaccctgtttaggacattgcaggttgtcaaggaagcaattgtatcagttgatggatacaatgctgatagacgagaggcggttaggaaagcagcacagagtctaaatttgaaaaaggaggctgctatgaccatcttcagtaaagcagtatgcctcttgcccccccaaaataacatgttacatcagttggcatatattcttctccattgcaaatccaattaattttctgtatttaccaatttcaaatgacaggtacggaaattattcctgaactacattcagagagcaaaagcagctggcaaccgcattgagcaggcgaaggagttgaagaagttaatttccttcaacacagttgttgtaagtgagcttctatctgacattaaaggagagctaacagctgctgaacctgcaacatcaagtgcgacgtcagaacctgagaccacagaatctgagggagaggatggtgactatgaatgggaatccctggaaacattaaagaagactaggcctgataaagagctaaaagaaaagcttgagaagtcaagtcagaaagagataaccctcaaagatgatcttccattgagcgacagagctgagctgtaccgaacatatttgatgttctgtatcaccggggagacgaccaatgtttcattcgggacagcaatctccacgaagaaagacaattcggagtatatgatgctaaagcaattgggaaacatacttggtttaacccgcaaggaagctcaagatgtccacattaagctggcagaaaaagcatttgtcgaacaggctgaagtagttctagctgatgggaagttaacagaatccaaggctgaccagcttgcaaagatacagaagcaggttggtttgcctgccgaccatgcacagaaaatcattaagagcatcacaacaacaaagttgtcttccgcaattgaagcttctatatctcgagggcagattggtatacagcaggtccgaggactgaaggaagcagattttaagctggatagcttgatttcagaaccgttgcgagaaaccatttacaagaagtgtgcagaggagatattttcatcaggcacaggtgattttgatgaagatgaagtgtatgtaaagatgcctgctgatcttatgataagtgctgagaaggccaagtcgattgttcagggcattgcaaagcttaggttggagaacgctcttgttcaggctattgctttgcttcggcagaagaagaaagatggtgtggtaagttggtcccctgtctctttgcttcgctaaatttacaaaatagctcctagagatatagtttcgaggaaacaatcatatacagatcttgacgtatttccaagatgttggtaaccgtaaaggactcatctggataaatttattcttggatcactgacacaatagattgatgaaaccagattgataggaaatttatgtggtgtgccagactctgaaaaattctgatggtattagattaaatgcataacgcattaacggatacaaagctactttatacaactttttatcttatcctgaagtttctgttgaaatttatttcattgcttttatgtctaacaacattcatatccaatgcagatctcatcgctcaatgacctactcgcatgtgatgcggccgtccctgcttcgaagccattgtcatggcccacactgggagagttggatgacttgtactgcgtttacatgaagagtatcccgaagcctgataagctatctaggttgcagtacttacttgccataagtgccgagaaagctaacgagcttcgggatgctgcaacagcaggcacgctgccagtcacagctcaagaggaggaagaat

SEQ ID NO: 691 - DNA, 3389 bp, Lolium rigidum
caattacagtattggacgacatagttggcattcactattatgttcacctcgatgctgcttttatcgtactacaagcaaaatatattgcccaatgctacacatggttctttacactataatttagacagcatcatttgctcttgtggtgatgataatgtgggcttgtatttctgtattaataggtagtatgtatttttctccttttcgaagtaaatataaaaaaatcacctatacatagttcacatcttaacaatctggccatgtggttgacattaaccatgcacttatactttctcctatccattctttccgcagctttgtttactcagtgattcctccaggacatagagatcttaaaggtaatgaggttgaagctattataaagttcaaaagagctcttggacttgatgatgtagatgctgcaaatatgcacatggtggtattgcctcatgatcctatcccttctatatcttagtatctatctcagatgctcttatgactttactcattgctttcacatttactctgttttgcccctgtttccttatgtgtttcactttgctcgatgtaataggttggtagacgcttatacaaagagagcctcgatgtaagtgattcttcttacaagtacataagcatattggatacctgaacagtcttcaaatcccggttataactaagggaaatatttcataggcgttccaaaaattaatttttgtgtcaaatcttgtcttcggagatgcatcagagttcatacttccgtggaaacatcttttcgggatcacggattatcaggtaaatagagacattcgtcattcatttactactatgcatagcatcaatttatgacttcatttatggagaaaacagagagctacccccattatgatattttgatcacttgcactcaacttagtactgtgactgcacgtacttttttaacattttctaccttgagaagcctcttaaagcatgctgagcatgctcagcatagtattgtgttgttcatgatacagtggaggctagttgaacacgtcttgttagttgttcctttaccttgtaatggtgtttttgcagattgatattgctatgcgggagaatgccaaaagtttatatgcgttagagctcaagtctattggaagaggtacttcttataaacattcttctgtagggtttagttacactttattcatattgtgcttacaaggtttaactttttcaaacacattagatttagggcagggaaggtagcaatggcatcttatgtaatcttactaattacctgacatattcagctcaaaaaaaattacctgacatattacttgctccatttcttgaaaattatcatctgacgtatttgtttctataggtattaacattggcacagtcattgatataaggagggtacagcttgcatataaactttttgacgaggtaaccgttttcttatcacaattttactgcttcattggcttcatttggttttacattttgtttgctacttggggcacaatgtcacttatatcaaaatattatcacccataaagagttaaactaaagaaggcataataagtaatttaatatttgattgttttcattgatgcaagtatgataggaaatgaaaaaacagcattaatctaaggataatgtcttctaacatatctgaacatttgaatttcttgcagattgctgctgacatgttcagggagcatgcgaagaacttgatccaagaaaacatttcatctgctttatccatattgaagtctaatcccggttcgacgtatgagcctacttttttgcaaaacctgatgaaagattttatcatttgacattttgcatgaaaattacactcctttatgacaacatgaaaacctgaatcagtgttaccgatcatctaattaattgagagaagggcacaaccatgttttttgctaaatctgatacgcctagttttaatgtagcaatatataacagaggaaaatagatagtacatagaagttagaaataatgtatattttcatcccttgttcccaacaagaggttatccataatgggtcacctttcccacgcataggatggtcgtgttcttggagttgcaggctttaagtactgttttgtctatcctgaacaatagcatttgtactcaaaccagtttgtagaagttattagacttatatttaatggatatatctgatttcactagaagggagtatttaacttccatcgcgaaaaacctgagccatcttccttctaagggaatgtgagaacaccaacaaaatacttgagaaattgtgtgagatttccttgatcaatattcagaaaatgtattatcctgttggagaagtgctcaatccatctgaatcctcataactttggaatttatcatgtataacgcgaacaaaattttaccttgatgctaaaccatatgatcgctgattacaggaacattccagaacaggttattgatgaagtgaatactatccttgcattcaatagcatgctaacagttctaggcaagtttcctgatggcgaccgatttgcacgtgggcttggccctgtttccttaggtaaaaaaagtggtaaagttttattaaattcatatgttctttagctggcctttcttaagaatgattcttgtgcacagctggagactttgaccatgataggatggttggtgatctaaagatactctatgcagcctatgcaacggcagtactttcagatggaaaccttgatgatgagaaggtaattccacgtgtgttcgcatttaatttattaaaatcatgctgattttgaattgataattgaaaatatgggatcgataattctataggctgatgaactgacctatccgaataaacccccataacatcttgatttaagttgagtagggcgaattaaaaaggctgtggaatcttaaacatatttggattttatgtggataattctttttggagcaaacgccagctggctattcattaagaagaaaagaaaatgatctagtttataaggaaaaccggatcgaaaaccatacaaacttgattactcccgacatgtggaccactcacaaagcctaaaacaacacaacaatagaaaacaaccttccacacacagcctactacattttcgaccactccatacaaaatttgcttcaactacatctgtcatgtaatctcaatcgccttcttcttggcgctgaccttttcgcctttgggcttcaccttctccatattcttcacaagggagccaagcatcaagatggaacgaggcgacaaaggggccttaaacttgccaataaaggccgcaagggcgttgtcatcgaactcagcgttctcttctaggaggcccacagctcgtgcgagaaactcctgagctgtagcatccttccg

SEQ ID NO: 692 - DNA, 510 bp, Portulaca oleracea
cttattaaggttgtgcgggaggcaattgcgtcaggagttgatggatatgatgcggatgtaagagcatctgtgaggaaagcagcacatggcttgcggttgagcagggaagcagcaatgtcgattgctagtaaggcggtatgtctaccccttgatcacgtgtccaatatatgattttttttaaaaaaattgacaccaatgtccgtggttaatttgctcttgagcaatggcattgtggttcaacattgagcttctacaagttcataaaattggtatccattatggcgttgtggaccttgtggtgtctttgggggcacctttgttttgagtggttctgatatgagttgggatactcttatctgatgcaataacacatgccaaacacgattgttgatatttcttttatgatcagagtggaattcaccaatccattttgaccaaatgttgatatgaattaacctttatttttttttgataggagttcatgaacctttatttttttgataggaattc

SEQ ID NO: 693 - DNA, 1752 bp, Portulaca oleracea
tatatatatataaagatatagtaggtgcggtccacagaaggtattgtaggggcagggtttggtggagaccttgatgatctaatcctaagaagcatagacactgacgcgtgacacgaatacaacattgacacgtggatttttaaaattttaggatatgacattctagtagacttgtaatatgaagcatatttcttccattcttgatgtgtttatgacttaatgtttttcggcattggggagggttgtgtttggatgaaggcagtagcaaatttttcttggtgcatgcactctactaataccaataacaaaaacctatttctttatgttatctctatctttggcatgtctttgagagtgtccacgagcgtcagtgtcccgtacgtgttggacacagatacgtgaagctgggtgaagtgtccatgctttttagatctactatatctgcaggcatggcatgatattttttttttaataagatttgcatccagtctcggtcgagaagtttggtatgtagaagaaataggttccaaatccaatctggtggctcttaacggagtccacatgtctatcccttcagaatttgcactcttcttcacaacaatgtgaccatttacatactcagaagcattcttgggtatgttttctgcttaaattgagtctagaatatatggatatgttgaaagggctactgctatgtgaaaagcaacatgattgagaacttcaaaattataatgtgaaatcccacaaatatcttatttaactacatacaaagtaattatcttaagttgtatgagggttccagcaggtgtgagattcactaccatttgtaggagattcactaccatttcttctttgaactgttactaaatactaactggtatccacatgcacccaatgcattttggggagccagcaagggtacgtcaccctatgctgactccttttgataatatattgcttttctcattaccgagaaaaatcagtcgtaatcaccttcattttctgtgttatgagactttagctttgcttcctgaatatcctattaggttccggatatttgtgtaatattttgatgaacaggctttattgtttattatttgttgatttgttaactgtgatttgaatccaaacaataatgaggacattattaatactctgcactgttctgatatgttactagattcctgtaatatgggtctaataatacgcggaatttaccatttgtcatatatgacatctgttcagacattttcctgaaacctggaaaactgggtagaatggactttatcttggagattccagatgctctgattgtgttaatttcgataatcataaagtaggcatatatcatagatttggaaatgtaattctgggatgcctcccccaaagaacagaaatcattatgctgacatatattaattaccctttcaactttctaagtggatgtaagacattgtgaggaggacttgaacttttgggacattttctgattatgtctgaagttgcgtgaaacaactatacaagtattttttttccttttttccccctgcattcaattagtggcagtgatatttcctattcatgttttatcttatttattgtaattttgatcaggcggggagtatgatagtgacagaaagattgatgatctgaagcttctgtacagagcttatgtctcagaatctttgtctggcggtcgcctggaagaagataaggtaatgtgatctgttttcctaataattagcttctgac

SEQ ID NO: 694 - DNA, 1922 bp, Portulaca oleracea
ccggggaccgtgatgctgacatggcgtcacgtcgggtaagattcttgtaatcatggttggtacctcttaaatgagttcttgagtggctgttgtaggattttgtgatttgaccaacagtcactttagtgcaggcatttcagaagttagtgtatgtctccactctcgtttttggggatgcatcttcatttcttctaccttggaagcgtgttttcaaagtgacagattcccaggtaacagctgagtgctaggatatcagtattttgttcatctaaagtgaatcttctaaaaaaaaaaagctgaaaatattatagagctgttgtttatgttctcaagtttccttctgctgtctgattaaatttagtttcgtcacctttccttcagagtcctgatgtttgtgctactgtattagtgtttattaaccatgtgaaagtgaagttgagaatttgttactggatcatgtcaggttgaggttgctatccgggataatgctcaaaggctgtatgctcagaaactgaaatcaattgacagaagttagtatctgcatcgtagtgcttgattatatgaacttgtatccattgctctggcttatatctttgtgtatggtattatcagtattgctcgttcagtttctgccatctaatctagcagtggtagtttatgtaatcatttcgtactgcgaataatgatttgtgtatccattagatgtggaaccaaagcagcttgctgatttgagggaagctcaaattttatgtcgtctgtccgacgaggtactttatttttggtttaatattactccattcactaaacgaacatatagtttttttttagttcattcatttatttattttttaaaaatgaggatggctctatttcttgcagctggctgaagaaatgttcaaggaacatacaagaaaactggtagaggaaaacatttcgcgagctcttgatatgttgaagtctcggacaagatcagggtatgccatgggctgaaggattgaagcttcttccctcttatctcagaaaacgacagactagccttgtttatttttccttgagataaaaatgatatgcatgcagtctcatgggtgtgcttaatgcacttgaatgtcacaggggaactgctggggttgtggaagagcttaataaggtattagccttcaataatctgcttctgtcactaaagaaccatccagatgctgctagctttgctcgtggaactgggccagtttctctagtaggtaatgctagttattgttttctgcataatgtctctttctatgcaaggatgtatcagggtgtaactgacatagtgcaaactaaattgttaaccacagatttaatggataaaaggtgctgttgaaagaaggaaaaaagaaaaagaaaaaaagaacgtgtatgaaattcaaatggatttatttaacttgttcacgctagaaacaattgaacaatagtcttgcctgacttagccatttgctattaattattcagtgaatttggagttaataattattcagtgaatttcactttctgttattccctgcaccatttctcctttgactggctaatgatatatgacccttatgctggtcaacagtaataatcccaatgaggctactgtctcttattctggtgtcctatcatactccttggatcttacggccatctttctgaattggtattctttattgtgggtatctttattcattctacaaaatgagctgttgtacaattacaaagtttggcctttttgtgtttgtaacttagagggagggaggtaaatgatgggaggacgggggactgtagggttctgatagagggagaagtgcagagaagattgtcttaggactttagaaggatgtttggagcctggaggggtggggagattgtgagatatatatatatattatatatatatatatatg

SEQ ID NO: 695 - DNA, 989 bp, Portulaca oleracea
tatgaaaaaattcctgcagacttgagcattaatgttgacaaggcaaaaggagttgtccaagaacttgcacggagtaggttatcaagatctttggttcaagcagtggcattactgaggcagagaaaccgtgcaggagtggtatgccacttgtgttgtgtgatacatcaaaagttactttagttgggtttcattgcccatgaatgctagaaactaattttaccgtgctattgtgttaaaatgtcacaggtttccacgcttaatgatttgctggcttgtgacaaggctgtgacttcagagcctctgtcgtgggatgtccctgaagaactggtggatctttttgctatatatatgaagagcgaaccagcaccggagaaactgtcacgcctgcagtatctgctagggataagtgattcagcagtggctgctctgaaagagaggggagaccaagtgacagacactggtgcaggagcagaggaatttgtcttttagaggagagtaagtgctgagtacactccgactagtcatcccgtagttacatagcttggcggatacttgtgtaggtgattgggcaagcaagtttgttttttgttagtacaaaaagatgaagattttgaatgaggttaagacatatagcttttcgcccctatcctatttgtggtttggatgggcaactgcttgagttgcatccttgtattcttttgcatgaataagtaattgcagattattatgcgatatgcacctagtagttggattagtattctctactgctgattattgcatgcaaccttagaccgccgatttgcttttatgttgaatcaatgaacaattgtagactgtcataacgcgttgtcagagggttggtttctgtattgctgttaaaagtgcaacaatctgggttgtaacttgtaacccatgcaggtgctgatctttaagggtccgtttggactgcggaaaattgagtggaaaaaaattattttggaaaatgaaaa

SEQ ID NO: 696 - DNA, 1450 bp, Portulaca oleracea
aggccgccactcggtcgctcgctcactctttcagtaaggttatcatctccattcttcaccaacccagcgctacctccctatcctcttctgtcccgttacagaaatccggtttctggaacccccccaaattctacagaaaaggggtgtttgaggaagagaaagaggaggaggaaaatgaaccctacaatgtctacatcttcgtcccaccctcatcttctctcatccacgttcataaatcccgttcatttgagacccagattacccatttccgttaaatccatcggcaaaagacgctcctatcaaatctccggcgtccgatgctttaccgacgacaaagccgccaccagcgccaccgctactaccaccagcgccaccgcaatatttggagggaggagagaattgtccggcgtccaatccctggttgacagtttatctccgccggtgagaatagcgagctcagtcctcgttgttgccggagctttggctgccggctatggcttagggtctaaatttgggggcaataggaatgtcgccattggagccgctgttgcttttggagctgctggtggcgctgctgcttatgccttcaattcttgtgttcctgaagttgccgctatcaatttgcacaattatgttgctcaatccgatgatcctactgccttgaacaaggatagtatagaagccattgctgccaagtacttgcaactaaacactaccatctccttttgttttttgttctttttgtagctatgcattcatttatttcatagtttgaatgggaagttcatatagtatgattatatcatggtggaaacggttgttaatacttgtttgaaccctataatatcaatgtatactacttgggtgctgacttttatcaatttgattttcaggtatggtgtcagcaagcaagatgaagccttcaataccgagctttgtgatttgtatatcaggtaacaggaaaaacacatgcatatgttcgttgtgttttgtgtgatcctctggcagctgcagctttgtttattatatttactcattttgtggaattcatgtcaattcaacttgttattcctagtatccttacgaaatttttatgaaattggtgcgctttattaattgaattcattcagtatgtttgtaactatgaaacattttatctattctgtgcattgttcatataattttgtgcttaaattgtctctcactcattatctaaggccacttttgattgcttttatagatttgttgcatcagtgctcccttctggcaatgaagatctcaaaggtactgaagttgaaactattataaagttcaagaatgctctgggtattgatgatcctgatgctgccaacatgcatatagaggtagttcttgtgtggattttctgacttttgcagcatctcgttaatatgatgaataagcatatcgtgttttttttcttttttttttt

SEQ ID NO: 697 - DNA, 3539 bp, Portulaca oleracea
ttttttttgttttcctgcaaaatagcgatctaattgcgggttaatgctactgttgaacaaaatcctttttgtggaccttttctggagtaggattcctggcaggggtgaggctgtgtgtagtatgtcttgccttccccaagcccagttgagcaggattcctgttgactttggtgtgggtttgtgatacttgtattctgtcataagatggtaaccccctttttgatgcaggtccggaggatttttatgaactacattaaacaggcacgggcagctgggagccgcactgaatctgcaaaagtacttaaaaagatgattgcatttaacaccctggttgtcactgaactagttgcagacattaaaggggaatcaactgctaccactagcaccaccacagaggaggccgttaaagtggaagaggagcaggtagaaaatgaggaagagtgggagtcactccagacacttaggaaaacaagacctacgaaggaacttgaggataaaattgggaaacctgggcagacagagattactgttaaagatgaccttcctgagagagagagggcagacctgtacaaaacatatttgttgtactgtataactggggaagtgaccaggattccatttggtgcacagatcaccactaaaaaggacaacacagaatatctatatctgaatcaacttggtgaaatcctaggtctaacacgtaaggagattgtggaggtccatagaggccttgcagaacaagcttttaggcagcaagcagaggtcattttggctgatggacagttgacaaaagctagacttgagcagttggacgaggtgcagaagcaagttggcttgcccccagagtatgctcaaaaagtgagggagaacatcatcaattcaaagatggctgctgccattgaaactgctattggtcagggaaggattaatataaaacagattagggaactcaaagaagcaagtgtgaagattgaaaacatgatatcagagagcttgcgggagagtctctttaagaagactgtggatgagatattctcatctggcactggtgattttgatgaggaagaagtctatgaaaaaattcctgcagacttgcacatcaatgctgacaaggcaaaaggagttgtccaagaacttgcacggagtaggttatcaagctcattggttcaagcagtggcattactgaggcagagaaaccgtgcaggagtggtatgccacttgtgttgtgtgatacatcaagagttcctttagttgggtttcattgaccatcaatgctagaaactaattttaccgtgctattttgtgttaaaatatcgcaggtttccacgcttaatgatttgctggcttgtgacaaggctgtgacttcagagcctctgtcatgggatgtccctgaagaactggtggatctttttgcaatatatatgaagagcgacccagcaccggagaaactgtcacgtctgcagtatctgctagggataaatgattcagcagtggctgctctgaaagagaggggagacccagtgacagacactggtgcaggagcagaggaatttgtcttttagaggagagtaagtgctgagtacgctccgactagtcatcccgtagttcatagcttggagggttctgttttggccgataattgtgtaggtgaagtttgttttttgttagtacaaaaagatgaagattttgaatgaggttaagacatagcttttcgcccctatcctttttgtggtttgggtgggcaactgcttgggttgcatccttgtattcttttgtatgaataagtataattgcagattattatgggatatgcacctagttgattagtattctctactgctgattattgcatggaaccttggaccgtccatttgcttttatgttgaatcaatgaacaattgtagactgtcacaacgtgttgtcagagggttggtatctatatttgctgttagaagtgcaacaatctgggttgtaaggcatgcggatgctgtagttatgcatatttaaattgttgtaaagatatgtttcattgttttaagtattgtgcaactcataagttacataaaatctattcccgatggtagaagccaccttgggccacgacgtcgctctctaaagtgatccgacgagtccactggaggtcttttgtgcgtcacacagaccgactcacttgtagtcttttcttcgccacacgactgtctgctggtttccgatggccatggttttcctctcctgatcaaccgtacgtacatcagttggcacccatcaatcgtcatcctcgacagcccctaagtggtcgccgtcaactagggagcttgaccgtgtactcgccggaccctgagtctgtcccgtcccacttgtagtcctgactcgggtcaagcaagcaagctcgcacccaacttccctgactcgatcatttttcaaccaaaattaaattttggcatagacttgcattacttgatttcagtagctgattcaatgtggaaatgaaccttcctgccatgtgttggagtggttctgctcagctatgatttagtagaacaaaatgtaggccaacaaataacaatacctttcctcaggaagaatacaggtgagaacagacactgcacacagtttgtatgaatgctaggaagacttcttggacattgtgggagtaaggctgaaccatggcctgattgttgacaacagtgggattgtccccatcaatgagggttttttacccttcacatatttgggtttcccgactcttataagtttggagaacattatccactcttatacgtgcgtgcaatgtttttattaaattatggcgcgtttggtagtttcccgaaaaaaactcttccgggaaaaactttccctagggtcccattggaaaaatgtttactgagtttaaaagtgaaataatgggccccatacaaaaatttttccatctatttgtcacaaccaaacataggaaagcttgtccacctaggaaaattcatgaactttcctgagaaagtttgggaaccaaacgcaccattaaatttattagtttaatgtgaaattaaccccaacttcaaaggctttggcccaacaattagttctttcatttattcccccaaatcttcttctcgtggagccccttgtcctccccagtatcctccctcgttactcatccctgtacagcgcccaccgaccataaggaagacgcaccaccaacgccatgaagcaaccaatcactacaaaaaaagtgacttttaccatcagatggtcagtgacagatatattatccgttggtaaaagtgcttatttactaatagattaaatatatgacggcatgattaataatttacaaacacttatactctctaatggtaaaaaaaaatttataccgacaaatacaaatttaaatgttggtattatcattacagtaccaataattaaaatatatgttgttattgtagagtttttaccaacagataaacaaatattggtattaatctaaggaccacgataaacatcttgcctcaagatgcatcttgaattatctatatttcaca

SEQ ID NO: 698 - DNA, 1817 bp, Portulaca oleracea
ttggggttactattcgaatatatggaaggagtggttgttattgtctgctccttgggctgctaagttgtacagaatcactctgatctgttcgtatttaggtttatgaataattggcttgtccattgaggcatttagctatgctgattacctattctatgaatattcacatttttctgttcttcctgccccaaaaaatcttttaaaggttaccgcgttgacccagttgaagaacatatttggtcttggaaaacgtgaggcagaagctattatgatggatgttgcctcaaaggtgtaccgaaagctgctagcacaggctgtttctagtggcgatttggaagctgcagacagcaaagcagctttccttcagaacttgtgtgaccagctgcgttttgatccacagaaagccactgagatccatgaaggtagtgctccaactgttaccttttcttgtttacggggttatcattatttcatgggagtttgttagttgcgggaaggggggcttttctccatgtatttgtctttccctggcttatcaaaatttggaagtacaaagccaaagttggaaattttcctagttgtcaagctaggtggatgtctgtattttgtaccaacattttcagacatacttactgttcaatttgaatgcctagcaaaaaattatgacgagtaatgctatttaatgctgtttgtgttggtatctttaatacctgctcattgctacctttgtaatgtgcctttgcttatagaaatataccgacaaaagttacagcagtgcttagctgatggagtattgagtgaggaggatgttaaagcgctgttacgattacgggtcctgctatgtatccctcaagatactgttgaagcggctcatgctgatatttgtggcagtatgtttgaaaaggtaccgatggaacagctcttttatccttgtaaacataattgtattcaattgtactctccttgacctttatagtgtgtttggatccaatttagggagagggagtggaagagagggtaaggtaatggaggggaggggagaggaaggtaagtgaggtgattggagttagtcttgtttggatatatttattaatgagggaacagaggggaagtattaaaattcttccctttcctctgtctgtccctcatcttgagggttatgaagaagggttgaatggacaggaataggagttaaagtattcccctccctgcccctcttccctcattttatttccccagtcaaggtgaatggaggctaattatctcccctcccctctattcccctctatacagaggctaatatcagaacttgctaatgtttaatgccatattagtagccccctcccctcctccccaaaaaattgttaaatgctgtcccgtgaaacttactatttactagtctctgaattgcatcgttggatggatcacactatgaattcgcaaatggttccaaaacgatagcaactttataggctcttgaacgctcttcacatgtgaatccttctgtgtaggagatctagatgcgcattcctgtagcctaaataggcagctttaactcatttgcttttggttcccccctccccttctgttttaagttgatccaactcatggacactttcacagacatttttcccctttttttttgtggggggagaaaaaattggaactccattttcttctgctagtgttttggcatgagcattgttttgccatctgcatcttacctttctgttttcttgcttatgtgtgcgaacataagatgtactaattatagtgttactgaatcaccttcccttattaaggttgtgcgggaggca

SEQ ID NO: 699 - DNA, 3498 bp, Senna obtusifolia
tcctcctcttccttcgtccctcttcctccatctccaccctcctctttctcacttcgttaaaccctataagccactctctgcaatcaccttccacgacgtcgtctttggttcctttcccacaaggggccatgaatccctctactctcttcacctccccttcttcccacccccactctccctttcttaatcccaatcctcttcacatcaccactacctctactcttcccaaacgtcgccgtttcagggtctccgtccctcgcagttcatcggcctccatcgaccagcctaccacttccgcgcctcccccatctgccatcagagtccagaaggagctccagggaattgaggttcttgttgacaaattatcaccgccgctgaggttggccacctctgccattatcgttgctggggctgttgctgctggatacgggttgggttctcggtttggtcggagccgaaatgcagccgtcggtggtgctgtggtgctcggtgtggccggaggggctgccgcatatgctttgaatgcgtgtgtgccgcaagttgcagcggtgaacttgcataattacgtggctgggtttgacgacccttctcggttgaagaaggaagacatcgaaagcattgcaaacaagtacggtgtcagcaagcaagatgaggcattcaaagcagaaatttgtgagatatatagtcagtttgtgtcttctgtgcttcctcctggaggtcaggaacttaaaggggatgaggttgataggatcattaacttcaaaaattctctaggaattgatgatccagaagcagcctccatgcatatggagattggtaggaaaatttttaggcaaaggcttgaagttggtgatcgtgatgctgatattgagcaacgtcgggcatttcagaagttgatttacgtgtcaaatcttgtttttggagaagcatcatcgttccttctaccttggaaacgtgtttttaaagtcactgattcccaggttgaagtagccattcgtgataatgcccagagattgtatgcttccaggttgaaatcagttggaagagatattgatgcagaacaacttgttacacttagagaagcacaacgtttgtatcgcctttctgatgagcttgcggggaacttgtttaaggagcatacaaggaaattggttgaggaaaatatttcagaggcacttagtctacttaaatcccgcacaagagcagtttctggagttagtcaagcagtggagaaacttgataagatattggcgttcaataatttacttatctcattaaagaatcatccagatgttgatagctttgcctgtggtgttggtcctatttctttactaggtggtgagtatgatgatgacaaaaagatggaggacttgaaactcctttatagagcatatgttacagatgctttgtctggtggtcgcatggaagataataagattgcttcactaaatcagttaaggaatatatttgggttgggtaaacgcgaagcagaggccatcacccttgatattacatcaaaggcataccgtaaacgacttttacaggcagcttcaggtggtaatttagaaatggctgatagcaaagcagctttcctacaaaatctctgtgatgagttgcattttgatccgcaaaaggctagtgaaattcatgaagaaatttaccgtacaaagcttcagcaatgtgtggctgatggagagctcagtgaggaggatgtttctgctttgttgaggttgcgtgtaatgctctgtatacctcaacagactgttgaagctgctcactcagatatctgtggaagtttgtttgagaaggttgtcagggatgcaattgcatcaggggttgatggatatgatgctgaaaccaagaaagcagtgagaaaagctgcacatggtttgcggttaaccagggagactgctatgtctattgcaagcaaggcagtaaagaaaatatttattaattacataaaacgttctcgagcagctggaaaccgtacagagtctgcaaaagaactcaagaagatgatagctttcaataccttggttgtgaccgacttggtggaggacattaaaggggagtcagctgacattaaaggggagtcagctgatgtaacagctgatgtatcaagtgaagaacctgttaaggaggaagtgacacaaactgaagaagatgaagaatgggaatctatccaaacactcaggaaaataaaaccaaacaaagaacttatggaaaggttggggaagcctggtcagacggaaataaatcttaaagatgaccttccagatagagataggattgatctctacaagacatacttacttttctgtataactggcgaagtgacaaagattccatttggtgttcagataactacaaagaaggatgattcagagtatgttcttttaaatcaacttggtgggatcctgggtttgagtagtaaagaaatagtggaagtacatcggagtctagctgagcaagctttcaggcaacaagctgaggtaattttggctgacggacagttgaccaaggccagggtggatcagcttaatgcattgcagaagcaagtaggattacctccagaatatgctcagaagataatcaagagtataaccactacaaaaatggcagctgccattgaaactgctgtaacacaagggaggctcagcatcaagcagattagggaactcaaggaatccaatgtcgatttagataacatggtatctgagaacttgagagaaaccctcttcaaaaaaactgtggatgatattttctcatcaggcaccggagagtttgatgaggaggaagtatttgaaaagattccatctgatcttaacatcaataaagagaaggcaaaacgtgttgtttgtgagttggcacaaagtagactatctaattcactcattcaggccgtggcactattaagacagagaaaccaggacggggtggttgcctcgctaaacgacttgctggcttgtgacaaagcagttgcagcacggccactctcatgggaagtgcaagaggagcttgctgatttatacactatatacatgaagaaagatccacctccagaaaaattgtctcgtttgcaataccttttgggaataaatgattctacagcagctgctcttagagagatgggagataggttacttgacactaatgtggaggaggagaagtttgtattctgagtgttgccataaaagaaaatttcttgatcaggcatggagaggcagcaaggcccctctccacctacttgcccaatttttctttgcctttttgtttatcggtttaaggtagaaaatcagtgatatattattcttagggaagagatgagtgcagtgttagaagctgaaatcccagatagccataaaattgtgagttctttttaaactgtctgtttcctgttaattaaaattgtttgactgtgtgcctgatatagcaaggcaaaatatttacatggcaatgtttggtatttagtctaggactagattcagataaggatgg

SEQ ID NO: 700 - DNA, 513 bp, Setaria viridis
tccaaattctctgtgaaaagttgcaatttgatcctgaacttgctagcaagatgcatgaagaaatttacagacagaagcttcagcagtttgtagctgacggtgagctgagcaaggaggaagtggaagctctgatggcattccaagtgcgtctctgcatccctcaagaaactgtggatgctgctcatactgagatctgtggccaattgttcgaaaaggttgtcaaggaagccattgcatccgttgatggatatgatgctgatagacgagaggctgttaggaaggcagcacaaagtctaaacatgaaaaaggaggctgccatggtgatctttagtaaagcggtacgtaagttgttcctgagctacattcagagagcaaaagaagctgataaccccattgaaactgcaaaagagctgaagaagctaatttccttcaacacagttgttgttagtgagcttttagctgacattaaaggagagctgtctccaactgctgaaactgaagcatcaagcgcgg

SEQ ID NO: 701 - DNA, 414 bp, Sorghum halepense
gcaatcgcgaacaaatatggagttagcacacaggatgaagccttcaaagcagagctctgtgacttgtatgccaggtatgtttactcagtacttcctctaggagatgaagatctgaaaggtacggaggttcaggcaattataaaatttaaaagagctcttgggcttgatgatgtagatgctgctaacatgcacatggagattggtagacgcatatacagagagaggctggaaacaagtgatcgtgatgctgacatggaacaaaggcgggcatttcagaagttaatttatgtgtccaatcttgtttttggagatgcatctgcattcctacttccttggaaacgtctttttgggtgactgattctcagattgacattgctatgagggaaaatgccaagagtttatactcagtgcagc

SEQ ID NO: 702 - DNA, 528 bp, Sorghum halepense
aggctattgccttgcttcgtcagaagaagagagatggtgtggtttcatcactgaatgacatgctcgcatgtgacgctgcggtccctgcatcgaaacccttgtcatggcccacaccaggagagctagatgatctatatgccatctacctaaagagcattccaaggcctgagaagctatcaaggttgcagtacctgctgggcataagcaacgagaaggccaacaagatccaggacgcggcctcagagggatcgctgccaattgcagctgaagagaaagaggagttggccttctaggaaggggcacagttttgttagggtagccaccagagttgaggtcccttgccaatgaacgaacgaacttggtgctgtggccaacagctgctattgtagctaggcgcatacatgtttttggaataggaaagcgacgtgtgatcctgacatattgcatagctatctgtatagacgagtcaatgacaccaaaatttggtgagtcttcatttgctgttgcattccaccagaccacactgag

SEQ ID NO: 703 - DNA, 4353 bp, Sorghum halepense
ggccagcgtggcgggagcggccgcggtcaactccgtggtcccggaggtcgctgccgtggggctgcacaattacgtcgcgggccacgacgaccccaccaacctggagagcggcgaggtggaggcaatcgcgaacaagtgagttgctcattgctctagtgtgttgctgcggcattgggtttatattggtgaaatggttcgacctactgctgtgctgctcaaattatcgggctagtcctggtaatcatgtttacctcatggtctgaacgaatggtcgttattgttatatttggtagtgacctacctgtatggctgtatccaatgaagtgccccttagttgaggtttttgttttgttcgtaaactaaatattagtacattagtactcgcagtatagataacagtgatttgattatctcaggcttttattgtgatatccactttacccccatagtcttgcacgcttgtttatttggttacttagtttgaatcccccacagttgcatttattgttggaatgcaagtaaatatggtttacctagttatgtgttatgctaaaagaagctatatataatttccacattttttttgtctcttttggaggctagttattgatgctgctgtggctcctcttcatattcttatgatgtgcaattttaattttagatatggagttagcacacaggatgaagccttcaaagcagagctctgtgacttgtatgccaggtgagctttttgttctctttttttcccccagctggcgcattgtatgcattaagttttcttaaattcttaaggcgttatctcgcctcacgctttagttgcttaagcataaggtgttagtcagtcgtcacccctcgccttaccgccttgataaccatgggcataactggtgttgtgctactcactattcactacctgttgccccctgcatactactccagtcggaggcatgaaagtttctgcaaacaattgcaagaaaaaggaataaccacaatcttctagctgcatgctgcaatcatactattccttatatattaaggagcaattggtctctggatgtttctaatctatattaaggaacttaggcaagcaaatcaactattgctattaggcgtggtcactcagtttattctgtgttttgggttcagtatatttggtgagcaaaagtttcagttttcagaatagaaaaaccggagtttctgcctcaaaccaaaacaccacacatttcgctgttcagtgccgtgttgtgtttaccgaagaaacaacatggtagcaaatgctaaacaaataaaggggaaaaatgacgagatgatgcatacctcagatatgaggcaagtttgatatacacaactgagcaagcaaagcattcagaaagcttggcatgggggcctggccatatgcctctgtctgcttgtgtgtgagatggtcatagtggccatggtcgcatacttgtcattgtccgtgcactcgctgtgaggttagcatgctggtgggtggctgttgtcaactcatgcgctcgtcacggccacctgcatgtccatggaggcgtgtgcccttgatgtggagtggattgtgacgcaatgtggtgtcagctggtccggttagggaacaaagtgttgttttctggacagggccaattcacatgcctagtgagcttcctactaaagaaccattaatcctacatattcctcataaattccattctttgactggagctaatgtgcacaacacaagaagataccaagcttgtttggtggtgttggttgtgaaatttgtatttgtgcatttgggtggtaacttttaattacagcctttcgatttcgtggatgggtgtcaacaatcttgcctggatacacctgagctcatgctttattgtaaaaaaaccaagtaaactctataatactcacgtagtcatgttcatgtatcagcatttaggtcagaagagtatattattcctcaaaggtctcacccttctaaatttcagttatttgctcatccttgtcctgaccatgctttgatgcaggtatgtttactcagtacttcctctaggagatgaagatctgaaaggtacggaggttcaggcaattataaaatttaaaagagctcttgggcttgatgatgtagatgctgctaacatgcacatggaggtattgcctccggatccaaacccttttatattttgtcatctatatccctcttattgtttttgtttctgttttccgcattcgctgtgttttatgccaataagtataccttttcctctttgcttgttgtactagattggtagacgcatatacagagagaggctggaaacaagtgatcgtgatgctgacatggaacaaaggcgggcaagtgtctatgcttagatatatgaatgagatacttagaactttctgttggcccatatgttaaccatgtcaaattctttgcaggcatttcagaagttaatttatgtgtccaatcttgtttttggagatgcatctgcattcctacttccttggaaacgtctttttggggtgactgattctcaggtaattaattataaaaatacctgttaattttctgcataccttctctcagttttatgctttgatctcacggggaaagtactttgttcggaatttgaagtttagtttcatcgttttctggcaatattgcctcaatggatgcgagaattattttaaagtatgatgaaattgtcctttgcatagttgtcatgctgctcttgatgcagttgatatttcaaatagtttggacaaatgttcgtaaagtgttaaggtcactactctgcagtccaaataagaacgtcttttttatttaccattgtcttaagtatcattattagatcaatttgacattatgtttgtttctagattgacattgctatgagggaaaatgccaagagtttatactcagtgcagctcaagtctgttggaagaggtactgctagaacacatagttttgtttaggtgttagttcaattctgaagttatactattattaagatttgctttatcaagtacatcatgtagtgtgctgtaaagacagcaatgccattttctgttgttatattcattgtttaatatgtctcttattacatctcaagaacattctgaactcaaaatgctctcgttttaggtcttgacacaggcacgctcattgatgtaaggagagcgcaacttgcatataaactatctgatgaggtaattcttttcttctaaaagtctgttgctgcctatttgctttttcatcatttgggctgaaatctacatcagtactatagaacaatgtcattttatatgcatgctatgatgcatatacactagtcaagactcaagagtttagacaaaataaacagtcactatatttatcattggtgttgatctaagtttgcttggaaaagataaatagagtaatctaagcatgttttgttgttaagtgacattctaaatttcttgcagattgctgctgagatgttccgcgagcacgtgaagaagctagttcaagaaaacatttcatcagcattagacatcttgaagtcacgtattccgtatggaacatacttaccctttgagaaccatgttaccagatttcattattagatgtgcatagaaacctgagtgatgttctaagctagataccctgtggttcaatggagagagcatagccatttttctaaatccggatatattggtttgcaatttggtagatattttggccatataatggagaaaatataccttgtaagtagcaatgggtaataatctgtctttcacaccccatgtttaaaacacaagatgatccatcatgtatttatgcgccaacctttctcacacatggccctgccatgttatgattgtggcattgtcttgtataccataagcaatgccataacattatcaaatctctatttaaaatatgaactttaactccactcatataaactatcaggtaggtgtgccgttaataaatttgatgagtacttttggtatataaatatgcttttactactagagggagtatttaacttccattagtagcagccaagacacctgtgcatttctgatggagcatgaaaagaccatgatgatgcatacaaaattcttgacttctgaccagtaataattagcaaaagcatgaatccagaaaggcggagcttggcagcaagttcagcagacagacagagaaatttgctagattaattaagtaggaaagagcttgctatttttaagctgataagtagacacttaatggacatcacaaatgagcaggaggggccatgacccatgttggtctcaatgaagctctgcccctgcacgaatccttgtgcaggaatggtcaatcctctgaatgtt

SEQ ID NO: 704 - DNA, 2438 bp, Sorghum halepense
gtattcagaatatcatgcttattaattcctcttcaaacttcagaaatttacagacagaagcttcagcagtttgtagccgatggagagctgagcaaggaggaagtggaagctctgatggcattccaagtgcgtctctgcatccctcaagaaactgtggatgctgttcatactgagatctgtggacaactgttcgaaaaggtgactctaaacctttttgattgaactcctttgtagttgtttagattttgttccatatcttgttcaggcaaagctgatggcacgttctgtataagtgctcttacatttgttaggacatttcaggttgtcaaggaagccattgcatctgttgatggatataatgctgatagacgagaggctgttaggaaggcagcacaaagtctaaaccttaaaacggaggctgccatggcgatctttagtaaagcagtatgtatctttcctttgaaaaatgataccaccttattttctcctgatcttctctgatatatgttatgtgtattcttttatatatattccttcagcaaagctagttcactattctaagttgtcacattcaaatgatcaggtacggaagttattcttgagctacattcagagagcaaaagaagctgggaaccgcattgaaactgcaaaagagctgaagaagttaatttccttcaacatagttgttgttagcgagcttttagctgacattaaaggagagatatctccagttgctgaaactgaagcatcaagtgcagcatcagaatctgagggagaggatgatgaacatgaatgggaatcattggagacactgagaaagactagacctgaaaaagagctcaaagaaaagctgagaaagtcaagccagaaagagataactctcaaggatgacattccattgagggatagggctgagctgtatgaaacatacttgatgttctgcatcactggggagacgactaacgtatcatttggaacagctatctctacaaagaaagacgattcggagtttttaatgctaaagcaattgggtgacatacttggtctaactcgcaaagaagctcaagatgttcacattaagtttgcagagaaagcttttgtgcaacaggcggaagtaattcttgctgatgggaaattaacagaggctaaggctgaccagcttgctaagattcaaaagcaggttggtttgcctactgaacatgcacagaaaatcattaagggtattacaactacaaagttatcttctgctattgaagcttctgttgctcggggtcagatcggtatacagcaggttcgaggattgagagaagcaaacttccaactggatagcttgattggggagccgcagcgagaaagcatttataagaaaactgttgaagagatcttttcttcaggtaaaggggattttgatgaagaggaaatgtatgaaaagattccagctgatctcataataagttctgagaaggccaagtcaattgttcaggatattgcaaaggttaggttggagaactcccttgttcaggctattgccttgcttcgtcagaagaagagagatggtgtggtatggtactaagttcccctttatatgctctttgaaaatccagttctggaaaactaatgtaattttggtatgtgcactaactataaaatttcctattgcaggtttcatcactgaatgacatgctcgcatgtgacgctgcggtccctgcatcgaaacccttgtcatggcccacaccaggagagctagatgatctatatgccatctacctaaagagcattccaaggcctgagaagctatcaaggttgcagtacctgctgggcataagcaacgagaaggccaacaagatccgggacgcggcctcagagggatcgctgccaattgcagctgaagagaaagaggagttggccttctaggaaggggcacagttttgttagggtagccaccagagttgaggtcccttgccaatgaacgaacgaacttggtgctgtggccaacagctgctattgtagctaggcgcatacatgtttttggaataggaaagcgacgtgtgatcctgacatattgcatagctatctgtatagacgagtcaatgacaccaaaatttggtgagtcttcatttgctgttgcattccaccagaccacactgagccttttgttttctggtttattgtttctcttttcgttcaacaatgtatcacagctatgactgcaacccttgcttataacctgtatttgttgttaacctacctgggatacttaagattagccatctgttttgcgtgtttcagctcgttagccaaacgaagaatgtgaaatgtgcatggtgtttcagctcgttagccaaacgagctggctagcgaagttggacgcatctatgtagtgagggaagatgccacccgaacactacaatcacactcgaacgacctgatttagggtg

SEQ ID NO: 705 - DNA, 1138 bp, Sorghum halepense
ttttttttggtgcatgtcatgcatagctggagagcatgatcacgataggagagctgatgatctcaagatactctataaggcctatgctacagaagtactttcagatggaattgtggacgatgagaaggtgatttaatttctagtttactgatggtgcttgtttgtgtgatgacaagttaatataacccctttctagttctttttttttgaggggaaatacagtaagggaggccccctactgtgcattttattaaaaaaagaatgaagaggaggcatgcaacaggcagccaagagagaaaaagaacacaaaaactagtcaaatcgagcttagccttaaataaattgaagatctggcaaattggaataggccccatcagaaaatttatcttgattttagtcgatcagttcaatgttgcatcaaaataatagatcaccgtcagcttgtaccagcatcttgtactgtctttcacatgccatctgaccataaagatgctatttattctgtagtatctcaacagaagtttttctgtgcttaaaaaaatgcagctttcccctctgaatgaactgagaaacatatttggactggggaagcgggaaacagaaggaatcttgtctgatgtcaaagctcacatatacagaaagacacttgctaaatcatttaacactgaattggcttcagtccctagcaaagcagcattcctccaaattctttgcgagaagttacagtttgatcctgaactggctagcaagatgcatgaaggtaccatctcagacaaattttttttcttcttgcaacatttacagcacagctgtctgctgtagtaaataaggggttttgctcaatggcaatccgttatacaaggcatctttacactgtaatctctgtgctgtcatgctgatactgctgcattggtgttttagactatatattatgttgtgttttggaaaggtaacttgagtttggttcatattgagtgtatgattatggtcgtggatgaaattcaccaacaaaaaagtacgttacaaatgttttgaccaaaagaagcctcacatctattttcataatactaataatactaatgctaatactataaattgtatgtataagtatattaataccatgcaaactaggccattc

SEQ ID NO: 706 - DNA, 9135 bp, Spirodela polyrrhiza
gagagagagagagagagggctcgaaaccctgacaggcgaaatccggtcgttaaagtctccgcgacgaccgtcaaagtttctcttctggagaacgtccacgtggcgtctcacacgagcgaaaatggagtcgctcgtgccgggacccattcgaggtttcgggaaacaagtcgttgagacggtttaacttaaaaagccgattaatgcattcaaataaatgaaatataatttatttctcccatttcattttccaagtaaaataatgtaaacaaatatgattaatattttttaaatcatacccacgtactaaaacctgttaaattgactaaagttttcatttttttcttcaccccttctttttacatctctatctctatctctctgcacatctttcttatttttaaaccgtgaattatatatttttatgcaatattttgggtgtgtatctatctctctacacacctacttatatacaattagctatataagtaacaatgtttgctaatatttactaatacggtccgggctatcataatctaacgcttccaccctagatttttggaaaataccatcactttaatgtgggaattacgtatttttgggtatatgtccatctccatgcacgtctatttatataactaataatgtttattaatatggtccagttatcatattctgatgcctccactaaagattttaggaaaatatcataattttaatccgtgaattatgtattttatgcagtattttgggcgtatccatgtctttacatgtcgatttatatataattagctatatagctaattatatttaatatttattaatacggtccagctatcataatccgatgcttccactaaagatttttggaaaataccattattttaacgcacgaattatgtatttttccatccatgtccatctccatgcacgtctatttatatataattagctatataactaataatgtttgttaatattcattaatacagtccggctatcataatctgacgcttgcactaaagattttaggaaaatatcataatttttaggtgtgaattatgtattttatgcagtattttgggagtatccctatttatctgcacgtctatttatatatatttagttatatagaaaataatgtttgttaatatttattaatacggtccagctaccataatataacgcttccacccaggatcttgggagaaaaccatcattttaatgtgcgaattgtatttttgggtctatatgtatctccctgcacgtctaattatatacaattagctacataactaataatgtctgttaatatttgttaataaggtccagctatcataatctgacgcttccactaaatttttttggaaaataccatcattttaacgcttgattatgtatttttatgcagtatttttgggtgggttgaactggggagtggtattctttgaaccctagttcaggtttgtttgaggaaaggtgatagcttgggccagtcttgcgccgggcccggtgggagaccccggcagaggaggtctcaggataagccgcatcccttctctcttcacccttctcccctcaaaccctcccggccactgtcagtgccagtctctcccttcgcctctcccccccggagagaggacgccggcgctttaattttcgtcaattctgggggggcttgccgggttctgcagtccatcgcagggcttggtgccgcctctcccggggggaagaggaagggaagaggagatggatcgttccctcctgtgtaccacctcttatccgtcttcttcgccttatctggctgcccagctcggtccatacgtcggccggaatcccctcgtcctcaggttgccacccaagggcggacgggtgcgataccgtgtctctctggttcgaaactcggcttcttccgaggctacggaggagaaggggacgccgtcgagctcgtccgtcttcggaggcaaaagggaactctcgggtgtgcaggtcgtcgccgatgggctgtcccctccggtgaggttggcgagctctgttataattgtcgccggggctctcgccgccggttacggtctcgggctgcggttcgggggcaccaggactattggtctaggggctgccgctgtggtgggagcggccggtagcgctgcggcgtacgccttgaatgcgtgtgttccagaggtggccgccgtgaatctgcacaacctcgtggcaggccacgacgacccgacgaccttgagaaaagaggacgtagaagaagtggcgagaaggttgaattttcttcctctctgggttcatctcccaatctcagggctcgaaaagtttcatattttttgggtgagaatgttctcaattcgatctaaaggcatggagctttagtggggaattagggggagccatcacgcctaatgcggttgctcattgggtgggatggatctcacgtcttcattggcattgctagaatgccaccagagtcgtgagctccattaatatgaatcgatttctcagtattttgcttcggcctgttcggtatcttacctctggcaaccattgttacacagatgggtgccatctgttcttatagtttaggccttacccgcagacgtttctcacatatttttccctgtcctctgcgttaattatccaggtacggtgttagcaaggaagatgatgccttcaagtcagagctctgcgacttgtacagtcggtaagcagtgagcttatcatgcaatgacgataattgaggcattggcccactaagttgcagagacaaatgcttctcacttaattctggagaggcactgttcttaccctcatcttttttttttctgcaatcaggtttgtgatttcagttcttccgccaggaggggaaaatctcctcggtcatgaggctgaaacgatcattaaattcaaaaatgctcttggaattgacgacccagacgcagcaactgttcatgttgaggtattacctttttttctcttcttttttccccttttccaatgcccctttcctttttattctgcctgatgtgctgtattccttaaagaaataggggaattagtcggacacatctctaaccttagtaaaaaaaccaagggagctgtatcaaatcctgttcgtatccgccccaagaagcacttcttatctggtctcttaccttgcttatttgtgacatctcattttaagcaagtattcattttttttcattacaatgttcttgttctgtctcctagattgggaggcgcattttcaggcaaaggttggaagctggtgatcgtgatgatgatgtagaacagcgtcgggtctgtttcttccttatggttcttctctgagatcgtgtgcgacattatattaactcataactcattcggagaagaaaactctgcccattgttatttcgaatgcaggcatttcagaagcttatatacgtctccacacttgtatttggagacgcatcgaaattccttctgccttggaaacgtgttttcaaagtaactgattctcaggtgatttgttcaaacagatcgatcttttctaaacatcaattttttattgctgtgagtatttggaatcgaagtggacacaggtttttttcctttccatcagcacactgtgtcatggctgcctaatcagataatcaccaagcaaagcccaacgctcatgtattagaaagaagcattgtggagccatgcttaaaaccagagagctccaatgctgggcactccccagcgtctctccttctacattatcactattaattgttccccttctctgttgcaaaattttgttttaaaaaattcttttagctgttttagcttctttgtacgcgaaaaagtgtttttttgttatacttgcgtatatagactgcaaccctttttttcatgccttatcttcatggtagtgcaataattgtaagctatgacttgtctgttaggtggatgttgcgattcgagataatgctcagaggctttactcttacaagctaaattcaattggaagaggtgacatgcatgttaattaaattttacttttctcattcggacattagtcagctggttcagaactttgcatggtatattatttcatgaataaatcggtatggtatatgtgccagtatcatatcttgaaaagtgaaacggtatgactgctggtttaggacttataatggtaagaacacaagtttttcatcctcatttacctacaagtcatccatctttcagacgtcgatggaaatcaacttattaacttgaggcaagctcagcttctttatcggctttctgatgaggtttatcttcataataccaactctttgtcatttccacatttctcacctcatatttctgaatgcacttggtttcttttcttatgtgatgaaacttgctcacatgcagattgccgctgaaatgcttagagagcatacaagaaaattagccgaagtgaacatctcatcagctctggacatcttaaagtctcgtgcaagagcgacgtacgttatattcatgtgaatattaatcgtttgatgttttattctcttattactaacatgctaggttcttgccagtagaggattgggacaagttattgaggaactcgaaaaagtcttagcgttcaatgattctctttcatcactgaaaaagcatgctgacgctgcacagtttgcccctgggattggtccaatttctttattaggtagttccagaattcaatactctttatttatgctgcaaaataaattgaagagcaatgattttttatctatgtgatttgattcaggtggggactatgatggtgatagaaagattgatgacttgaaactcctctatagagcatttgcatccgaagctctttctgatggacgtctgcaggacaatgcggtgggtgttaaattttttgaacatacgtacatcttgattccatattttttgtactttctgaaaaaaaagtgatcttctactatatggacttccagaaaactgaattcactttttgaaggacgagaaatattgattttatgcttcacatatttctgaagagttatggcgagaactatgatattaaatgtgcccttaagttcgtcactcccgtttaaacttggacttcagtttcccgacatggaatatgtacctggttgctagaacaatgattgccagcatgaactgattattacatttatgaggcattttctgttatcagaagaaatgctgtcggattttttttttatatggttgctgaaggtctgttctatctacgacctgttgtttagataactatctgggtttcccatgggttatctaggaaaatacgcttgatacattattaacttggccaaatgttgtgcacttgaaaccttgataccttgattatatttttttctgtggcttgatatttttgttttaacaatctgatacattgagtgtgtggaaaatatgtcccggcaattcattggcatttacggttgatcgttttaaaaatattttcttatggattttctggtagcacacgacatcatgctgtgtcttccatctggctgttcgattatcttctgcatgatgctttccaaacaatttattaaagaaattagtcccatctgagcttgagcaaacatgtaatatccacattcattatgttcatgctgtcacttatcctgaggactcggtgaaaaggaatttatttccccgaatgggatcagatgtttcagctttttttgttcttgttttggtgcgcatttatttatttgtttatccatgttatggtggttgagcttgaatgcgtgtttgcctcccaatgcttgcagatttcggctttgggtcagctgagaaacatatttgggttgggcaagcgcgaggctgaaaccattatggtagatgtcacgtccaaggcctacaggaggcgactttcacaagctgtcaccagtggcagcttggaaggcgctcagagcaaagcagccttcctccagaacctttgtgatgagttgcactttgacccccagaaggctagtgagattcatcaaggtgcgttggaacctaaaactttggtaaatctttacaaagtttttgaccacgttctttgaatttcttgtggctcactgtggaagtcaaccaacctgattatcatgcaatgacttgtattgctcattttccgtagtaaacttctgaacatgtcaagctcattattattattttttttatcggattcaagaagtctggaggaaacatagtcaacccatgaagcattcttgtgaatataagtggtagagacaatcggtttccgatatgcattaatggagaaaatggatgaaaccatctgctatgccagagatcaccacagtccattgcattcttctgtgggaaccgtccactcaattttacaagtaaaatgggaaattttccatggagtgagccggtttcagatgtagctttccggagccacttctgaccatggggtcattgatgctaccctaaaacacggtagaatgatgctataagatgctctaatccacgcatggaatcgttggtactctgtcgggagtgacccacatgaagttctttccagaaatatacaggcagaagctgcagcagtgcgtggctgatggggagctcggcgaggaggacgttgccgcgctgcttcggctgcgcgtcatgctctgcattccccaggagaccgtcgatgctgcccatgccgacatatgcggcaccttgtttgagaaggtcaggtgttcctggggcattcccaatttggaacgttgagattgttgctcttctggttctttgccttcaatgatgccttctccgggcgttgacttgcaggtggtgaaggatgcggtggcctctggcgttgaggggtacgacgccgacatcagagcctccgtgaggaaggcctctcagggcctgcgactgacgaaggatgccgccatggccattgccagcaaggccgtacgattcttttccctgcccgggccttccctttatagttacctgggattattcttgtaaaaaaaaaggggggatttttatgttacctgggatctgataacgacccatgaaatggctcatctgcaggtgcggaaggtgttcttgaactacgtacagcgttccagaggggtcggcaatcgcattgaatctgcgagagaattgaagaagatgatcgcattcaacacgctggtcgtcaccgagctggtcgctgacatcaagggagaggcctctgcggcgccgccagaaccggagccagctgaagagcctcccaagcagattggggaggaagaagaagagtgggagtccctgcagacactgagaaagaccagacccagcaaggagctcgaggccaagctgggaaagcccggccagacagagatcaacctcaaggacgatctgccagagagggaccggacggatctctacaggacatacttactgttctgcctctcgggggaggtcacggtggttccatttggggcccagatcaccaccaagaaggacaattcggagtatcttcttctgaatcagctcgggggaattcttgggttgactggtaaagagatcgtggagatccacaggagcttggccgagcaggcgttcatgaagcaggcggaggtgatcctcgccgacgggcagctgaccaaggccaggatcgatcagctgacggaggtgcagaagcaggtgggcctgccgggagagtacgcgcagaaggtcatcaagaacatcaccacgacgaagatggcggccgccattgagacggccgtcagtcaggggaggatcggcatccagcaggtgagggagctcaaggaggcgagcgtggatcttgacagcatgatctcggagcgcctgcgggagaatctcttcaagaagacggtggatgaaatcttctcctcgggcaccggagagtttgacgaggaggaggtctacgagaagatccccagtgacctcaacatcaacgccgacaaggccagaggggttgttcacgagctcgcgaggatcaggctctccaactcgctggttcaggccgtgtcgctacttcggcagcggaatcgggacggagtggtgcgccattcatgcccaaatcaagcattgaaaattagggttcatcatacctcgaggaggagttgacgtcgatggcgattccctcttgcaggtgtcttcgctgaacgacatgctcgcctgcgaccgggctgtcccgtcggagccgctctcctggtcttcgccggaggagctggccgacctctactgcctttacctgaagagcatccccaagccggagaagctctcccgcctgcagtatctgctcggcatctccgacgactccgcggcggcgctccgggacgcggcggagcgcggcgggctccccctggcgagcgaggaggaagagttcgccttctaagacggccatcttctagggtttttgctagcgtagcttccccctgcgtggagctgttgggtcgactctgctcggcatccatggcttcccctgtttctgctctgcgttggtgttcttggacttctcgacggctttctgaatcgaaatgtgagtgcaggttgctgctggacgccgacgtgtccccctccccttctgttcgactggccgtcgtgggccccgccgtgaggacacgtcatccttcaccctggccgtcgatttgatgctcccatcacgccggcggggagggtatttttaatataaatcatgttttaaacaaattggctggagtggtcgtcccgccacgtggtccaggggggtggattacgcaattttaaggagtttgagggttgttaggaagattcgggtggtcttgatcgccacgagcgttctgtatttccggtgccggctttcattcgtagcctttctgagagagggcggcggaagaagaagggggaggggagctcccagcgcgtgcaggggagaaggaattcggggcctccgagatctagtattcccgaggagaatggctagcttcagcggggatgagacggctcccttcttcggcttccttggcgccgccgcggccctcgtcttctcctgtaaaccccttcccgaggaggattctctcgtccctgatttggtcggattgacgcgccgcggtccggtttgcgtggctttgatggtgttttttttttttgtttctggcaggcatgggggcggcgtacggg

SEQ ID NO: 707 - DNA, 1112 bp, Taraxacum officinale
gctcagaagataattaagaacataacgagtacgaaaatggcggcggctttggaaaccgcggtggggcaagggaggcttagtattcgggagattcgggaacttaaggggtccgggattgatttggatgtgatggtgtcgttgaatttgagacagaatctttttaagaagactgtggatgatatatttagttcggggactggggagtttaatgaggtggaggtttacgagaagattccggaagatctcgggattaatgttgagaaagcgcgtggggttgttcatgagcttgcaaggactcggttatcgaattcgttaatccaagccgtttcgttgcttcgtcaaagaaacacttcaggggtggtaagtggaaacatcacttttagccactgaactgttgtgttttatcgattgaccccccgaactattgtctttttgtaggtttcttccctgaatgatttgttggcgtgtgacaaggcggtgccagcatcgccattatcatgggaggtgactgaagagttatcggatctgtttctaatataccttaaaagcgacccgatccctgaaaaactgtcgcgattgcagtacttgttaaacatcgatgacgcgacagcagaagccttgacgggaatgaaggatcgagctacgccaagtggtggcgaaaagagcgaagaggagtttgtgttttgagtttatttatagtgacggttttgtgagagggataggaaggcgttgttataggtgatgagggggatgtgatatgagtctttcgcttttgaggatttgattgttttatgtgactacagtagatgtaagatgtgtgtagattatgatgagactgggtttccagcattctgtgatcttaataaaaacgtcactagtaattgtttttttttggtttaataatgtcgcaaattattaaaaagtcccttcactttttcgtaattggtgtaacgatattaattagttaaaaacttgagattacggcctaatgacttaagatctagcgtattagtagtttgtggaaagaaaagatttaataataacgtacggttatctatttcgttttgctataaattacattatctatatactaaatcccgtgggcactttct

SEQ ID NO: 708 - DNA, 796 bp, Taraxacum officinale
ttttttttttttttttttccgaattagaccttttagcaggtttatcgttaatattccggttttagacagttttttcttttggtaaaaaacctcaatttttttatctcgaaaaaaagaagttaaatttttttcttcgaaacaaatctgagggttttctagaaaaaataaaagacgtttagtgtcgtattcgaaaaaacttaagaaatgtaagttttttttttcagaaaaatacaaaagttaaggttttatcggaaaaattaccaaaactcaggttttttttagcataattaaccctattacttttaccgaaatcatacatttaaaaacaagttacattttttcaggagggaagccaagctgattgttgaggaacttaataaaatactagcattcaatacctcactagtctcattaaaaaaccacccagatgccaaccgttttgctcgtggggtcggcccaatttccctaataggtaaccactcttaattctcttataaaccacaacatcttaatttccataaattatttaaaatccaaatataactttttattaaataggcggtgagtatgatggagatagaaaaatggacgacctaaaactcctctacagggcatacattgccgattctctttctaccggccgtatggaaaacaacaaggtacaaattaaaacttttaaatacggtcaacttcaacttttgactttgactttgactttccataatgtttttattgtgtaatagctatctgcattggggcaattaaggaatatatttggattgggtaaaaaagaagc

SEQ ID NO: 709 - DNA, 1708 bp, Taraxacum officinale
tcaaatagcaaactgttaccatttatgggcaaacaaaaattccactatttgggtgaacattttactgcctcaacattgatatgaagtcaactgagttagctccatttcattttcaagaaattgatactaactacaatccaaattttgttaggggtgtttggatgtgtgattaaattgattactgtaaatcactttgggtaaaagtgattatacttatattttttatatgcctgtgttcttcagatatggtgttagcaaacagaatgaagctttcaatgcagagctttgtgacatatattgccggtgagtaccaaccgtctaataatccaaacaaaaaatgaaaaaaagtctttaattttgctcttttttcctattgatttctgtttttttccaagtattttgaagtgtaacaataatcctatacatgaaaacttgttaacattctctcattccagatatgttacttcggtacttccttctggaggtgaagatctgaagggcaatgaagctgacattattatgaaattcaaaagttcattaggcattgatgaccctgatgcagctgccatgcatatggaggtactaccacagtagttggtaaattcttcaaatgaggagggcatttatgtcttttcacttcattgattgtttttttttgttcaatagatcggaaggcgtatattcagacaaaggttagaaaccggtgaccgtgaagcagatgcagaacaacgtcgagtatgtttctttttctttcttttttttctttttttttttcattttgatattaaaattatttaaataaaatgattatttttaaactctaaatgagatacagagcttgatcattgttgtggtttccagtgcaggcatttcagaagctgatttatgtctcaacactcgtatttggagaagcttctggattccttctaccatggaaacgtgtgttcaaagttactgaatcacaggtatcattaaactggttatatattatgaatctatgatatatgatttatgattttttaactcttcataattaaaaaaattgttattttgataataatcaggttgaggtagctatacgtgacaatgcccaacggttgtatgcctccaaactaaaatcaatcaaccaaagtaagatactgtttctttaaaatcacatattttctatataactatttgtatgtattgttaataacgtaatatatatatttttagatgttaatccggaagaacttattagtttgagggatgcacaactacagtgtcggctttcagatgaggtagaaattaaacttaataatttataaacagttgtagttgttttaattattgtttttttttaatttgttgcagctagccgaagacatgtttagagagcataccagaaagcttgttgaagtaaatattacaacaagtgtgaatgtgctaaagtccaggacacgaacagcgtacgtgatccacatcatattttgactatttcatttaattttgtaaatattcatcaataaaagtccaaaagtatgccatacaaaatatataattacaaatacttcaccaagaccttcgaaacgagcctattattttattataatatatatttgtctttgatatacgtttatagttggtattagttaccatgtttgttaaattttttgctgttgtactttattactttgggttagttatgctaaaaaccctaagttttgct

SEQ ID NO: 710 - DNA, 217 bp, Taraxacum officinale
ggtggggctgttgttttgggagctgccggcgccggtgctgtttacgcgttgaattcttctgtgccggaaattgccgccctgagtttgcataattacgtggctggttcagatcccggtgctctgaagaaagaagatattgaaagcattgctagcaggttcatttccatcaaacctaaacaaaattctatagttttctacactcatgacctaaaatgtt

SEQ ID NO: 711 - DNA, 987 bp, Taraxacum officinale
tggctttaaattgaaaggcttcaatttcatcgcaacatataaaactctagacttcaggtgtatatgacaatatgacataatttgttgactaaaataagtttgttgactaaaataagtgtttgattagagacataaataccacatatatatggtatgtatgtttatctaaaatgttaaatagttttacaaacatatacataaacattggatgaacagataataactctattgtcaaggctttgttaagcctatatattgtaaatgaaacaacccatatgttgttaaccgcaaatcatattggacacttttcttgttactaggactagaaagttttcatacactattttctaggcaatgctataaaaactggtgtcaagggtgtacctgcattaaaattaaaactcaagggggaattctggaagacggagtaattcacaaaaccctgcctgccccccttttatcttcttctccgccctctcgacactatctcctccctatccttttcccactatcttcactcagctcctcccgtcgcctcaactcaccggagattaccgcaggggggcagggtagtccggaattcacaccatgaacccttcgattcttctgacacaacaaccatcttctcctcacccaaccatcttgttcactccatttctcaaccctacacctctcaaagtcacaacaaagtttctcaccttcaatcatcgtcggcacagatacagctgccgcgcccctgcagtccgttgctcggtatcttcatcctcagtagaccaaccatccaccaccactccggtaagcgatgtgtttggagggaagaaggagctgtcggcattccaatcacttgtggattctatgtcgccggctgttaggttagctagctcggttgttgtcgtggccggcgccgttgctgctggatatggattgggattacgtttcggtgggacccggaatgctagtttaggtggggctgttgttttgggagct

SEQ ID NO: 712 - DNA, 962 bp, Taraxacum officinale
agaagctgcagaaagtaaagcatcatttcttcaaaatctctgtgaggaacttcactttgatactgaaaaagccgttgagatccatcaaggtattagattatgtgtttatattatgtacctcaaattttgtatttttctaaaaaaaaacttacattttttaagttatttcgaataagtcactcgacttttctttttttccctaaaaaccctgaagtttgtatttttttttaaaaaccctcgagttctttttagcatagttaaccttttttttatatatgttgaataacttgtttatttgtgttttagaaatataccgacaaaaccttcaacagtctgtgaaagatggagagttaagtgacagtgaggttaagtcacttgagaggttgcaagtcatgctttgtattcctaaacaagttgtcgaaaagattcatgaggaaatatgtggcactttatttgaaaaggtaatgttttttaattgcattttgcagttatttttcaatttgttatccatgaaatgtaattaataaaaatgagcagcgggttcattaatcttatgtttttgactgaatatataacatataaaattttgctttcaggttgttaaggaggctatagcttcaggagtagatgggtacgatgctgatgtgaaacagtctgttagaaaagctgcatatggtttaaggttaaccagagacatagccatgtcaatcgctggcaaagcagtgagtattttacaaattcaccccctcatctattcccttccttacacttttctcaaatcccaaaaaaaaaactcaggtgcggaaaatcttcgtgagttacgtacaaagatcccggtcagcaggtggccgaacagaggctgcaagagaactcaagaaaatgatcgcgttcaacaatttagttgtaaccgaattagtttccgacatcaaaggagaagcttccggaagctcctcttcagaaga

SEQ ID NO: 713 - DNA, 278 bp, Trifolium repens
aaacttaagtttttgtaacagtagtatttcaattatgcatctgcttttatagttgttggctgttatatttcttctatgttttattactctaattatatcaaaatctaacaattgtttctaatgttcagaaatttaccgccaaaagcttcagcacttggtgactgatggagagctcagtgaggagggtgctgctgctttgttgaggttgcgtgtaatgctctgtattcctcaaaacactgttgaagcagctcactcagatatctgtggcagtttgtttg

SEQ ID NO: 714 - DNA, 973 bp, Trifolium repens
aaaaaacatgtatttatactcttgttccttagcaccctatgttgttgggattttatggatttgactattctttgtattgagggattttatcaatttatttttcatgatgtcccccaaaatgcttccatgttaaatgtcgaattatgtaggtattattgtaagcattttgtttcctagtttttttattttgtaattctccttaatgtgagcaatttacaaatgtagaatatattgcttctaaatttctaatcaatttaaaatttctcagtcctggagttatcgaggcagtagaggaacttgataatatattggcattcaataatttacttatctctttaaagaaccatgcggatgtggatcgctttgcccgaggtgttggcccagtttctttgctgggtaaggttctagactgattttatgtaacttctagtgttttgaatataaattgagttgactgtagttcatatttgattgacataggtggtaagtatgatgttaatagaaagatagaggatttgaaactcctttacagagcatatgttacaaatgctttggctggtggtcgcatggaagataataaggtaaatggcctttggctggtggtctcattttactattcgaatttgaagtaaaatctgttgtcagaatactttgttcatgttattttttttcgtgtttcactgatagcaagtttttacaagtggagaatttagatatttttaaaataagtctttgggtccttgctaaatagctttagctttcaacttcaaaatattttttttgttctttctctaagtttgttgccgtgactcatgattcagcattcaggtaagcaaacacagctttttgccctaaaccatgattattaagcttaactagaaaaaagttgattttcatattttttccaatactcgacttgtatgttcggtttattgttcttttgttaaacattcattttttaaagtaaagatga

SEQ ID NO: 715 - DNA, 2734 bp, Trifolium repens
ttgatcatgtttcttcatctcttttattgtttgagaggcaatcttttgtatcttatgtgactgatagatttatgtttgtccacacttctttgttacatgtctaactagatttatgtgtggcttctaggaagcggcacagggaataatacttttgctttcatagggtttgcacatgagagtttgtctatcttctcatgaattttgttgaattgttgtctgaatatcttgtaatttaattaggtcatgtgttttcactttgtaaacacatttttatttccatactattaaatttgtattagttatgattatcttgcgtctagcttatgtttttccatactcattagatgacagacagtattgttacgcggatatattatggtttcttatgtttttgccgtcttgcaagggaatgtcaaaatggagttactgaattatgtttttcttcataggttgtcatggaagcaattgcatcaggggttgatgggtatgatgctgaaattaggaaatcagtaagaaaagcagcacatggtttgcaactaaccagggaaattgctatgtctattgcaagcaaggccgtaagtatccacgtgtcaagaaaattgatgatcatttatgatgatttgaaatggttttaacttttgttatgctgttatatcatactgcaggtaaggaagatgtttattacctacataaaacgtgcacgaggtgctgaaaattctaaggagtctgcaaaagaactcaagaagatgataactttcaacactttggttgtgactgagttggtgaaggacattaaaggggagtcagatgatgtatcatctgaagaacttgcagagggtgtaacacaaacggaagatgaagaatgggatgctcttccatcactcaggaaaacaaacccagacaaagaacttttagaaaagatggggaagcctgggcagacggaaattactcttaaagatgaccttccagaaagagataggactgatctttacaagacatacttgctttattgcctaactggtgatgtgacgaagattccttttggagcccagatcactaaaaagaagaatgattcagaatttgtttttctaaatcagcttggtgggattctcggtatgactggtaaagaaatagtgggtgtacatagaagtcttgcagagcaagcttttaggaaacaagctgaggttattttagctgatggacagttaacaaaggccaaggtggagcaacttaatgatctgcagaaggaagtaggcttacccgaagaatatgctcagaaggtaatcaggagtataaccactactaaaatggcagctgccattgaaaccgcagtgacacaaggacggctgaatattaagcagataagagaactaaaggaagctggtgttgatttagacaacatggtatcaaagaacatgagagagttgctcttcaaaaaaactgttggtgatattttctcatcaggcactggagagttcgacgaggaggaagtatatgaaaatatcccatctgatctcaacattagtaaagaaaaatcaagagatgttgtccgacagcttgcacaaactaggttatcaaattcactcattcaggctgtggcactattaagacagagaaatcatagaggagtggtgagtggttttctgtagcttctattttcaaaaagtctgtttatgtttctaaattttgttatggattgtcaagtgtaataatgtctcgccatttgtgcaggtttcatcactcaacgatatactagcttgtgacaaagcaatgccctcacagccattatcatgggaattaccagaggagcttgctgatctttacaccatattcataaagagtaatcccattcctgaaaaattgactcgtttacagcatctgttaggcatacatgattccacagcagctgctcttcgggagatgagaggtagattagtcaatactgcagtggaggaagaagagtttgtattctgagtgttgtaacaaaataattgttaattggcatatcgaacatgtgccgatcaattttgattggtgatttcttttaaaggagtgagagatgagttacgattagagattcttggaaaagtgatgagagcaggtttatacttacagttggaatttcagatagccatatatattgagatcattcaatttattaagtcgatgttctgaatggataaaaatcatttggtgtgtatatatatttaatgccaaggattaggaaggctgcactgaagagcagatatgtgggaaaaaactttgggatatggttcaaccaagtttctaatatgcaaaaaacgtaagatattgtttgatctaaatgataaatgcaactcagcatagtaggatgtatgttttagagtttggtttattgatttcaaaatataaggtaatcaataactattggaaaacaacaatgaagaaaaaatttcaagatgcaattagtttctcgtaatcgatgattcggttggtgtagaatctaacaatgaaggaagatccttttttgtcaatatctggcttaacaacctttgtccttacgattgaaaacaacaaacaatacaaggatatgatgcaaactatttcaagttaggctttattagagttagtgtacatagtagttaggaactaatactctctcagatccacacttatatcgatccattttagaagctcaacaatgtgcaactatgaactgtcacaaaactagacatctccttcagtgagaataagg

SEQ ID NO: 716 - DNA, 629 bp, Trifolium repens
gacacccactgtggattttccggcatgtattgcatgttgtagtcataaacatgcccatgctcatagctgttcctttcttaatttttgcaaatgtagatttttccctttctaatcaattatgtttttcagtactggagcgagccaagttgttgaggagcttgataaggtattggcatttaatgatttactcatctcatttaagaatcattcggacatagatcgccttgcccgtggtgttggcccagtttctttagcgggtgagtttcctgactgagtatctgtttttgtttttatttactttttggttctttcctagttttatattttgaagttaaattaaattgatttttggtgtaggaggtgagtatgacggtgacagaaagatggaagatttgaaactcctttatagggcatatgtttcagatgctttgtcttctgggcgcatggaagataataaggtaaatggatataacattcaaatataaaaattgaattgctaacatgtttatattttttatccaagattttttttgataaaaaaagttgaatatgagagaaagggtttgacctttttcttcaaatgatcattttttttttttattaacaaagctggttgtactgaaactttc

SEQ ID NO: 717 - DNA, 898 bp, Trifolium repens
gcgatctcgcaagccatgagattactaatatcaaccaccatcaacatcaatctcgtaagcccctcaaccacgatttatcaaaaataaaacgagttaaaagatcatctttatctgaactctgaatcatacttctattaaactcttcatcgtagttgcatattcttgatcttgattaagaaaaaaaagataacatgtatagattctttcataattgcaaagggatacccaaacttttcaaatatccctttaccacccactaatttgcagttgaaaacaacaacacacaatcctcaccgtccaaaacactttcccccattaaaacaataaacaaaaaaccacttaaaaaatctaaaccgtcagatcaaaactgcagttcaattcatgtgaagttaagtatcaacgatatcatctcttccctctatcatcatctcttctatctatcttctccatttccgttaaaccctacaaaacacaaacttcaacaccttaaaacgacgtcgtaatttcaaaccaaatcatgaacccttcaactctaaacccttcacaaactcacccttcaattttactaccctcactttctcctttacgcacacaacgacgtcgttttcgtgtctcactccctcgttgttcctccgacactaacaaccctacttcatcttcttcgccgccagctccgccaaaacgaccggcgaaggaactgaacggaattgaaattctggttgataagttgcctttgccggctagacttgctacttctgctgtaattgttgccggtgctgttgctgctggatatggtttaggttcgaaatttgggggaagtagaaatgctgctcttggtggtgctgtggctgttggtgttgctggtggtgctgctgcttatgctttgaatgctactgcg

SEQ ID NO: 718 - DNA, 620 bp, Trifolium repens
acttgtttaggtatgtattttctgtgattcctcctggtggagaggaacttaaaggtgatgaggttgataagattgttaacttcaaaaattctttaggtcttgatgacccagatgctgctggtgtacatatggaggtaatttttgtgttaattgtgttgtgcatgtacgtgcgagatttgacggtattgattttgaggagtgaaagtagttatgtgtcttactggtttggtgcttgttgaccttctatcctagattggtaggaaacttttcaggcaaaggcttgaagtaggggaccgagaggcggatgttgagcaacgtcgggtatgcttgttgcatacttgtattattgagctaaatatagcaattatttctgtgctttaaataaacggtaaatacttggaacttgaccattgatagtctctccagtgcaggcgttccaaaagttgatatatgtgtcaaatattgtatttggagatgcatcatctttccttctaccttggaagcgtgtcttcaaggtcactgaatcccaggtatatatgtgaattgtatttgtaatttgcaattaggttaggagtctaggagcatagttgaataattgtgtttaggtgtattttcccgaa

SEQ ID NO: 719 - DNA, 7131 bp, Trifolium repens
gtatcagtttggtgaattattgatcaaaattgaattataaaaattgaagtatcagtttgtttctaagcctcaacttcaaagcttcgcacataattcaattttgataaataattcacaaaactagtaccaaaatgatagtaatcgagttaactttcaaattggcatatgcatagagttcagatccgctccagtctatctatcctccagtttcccagttcgcttaaccgatgtatgacacgtggcgattggaaattttaacggtggagattaaaagatatatataaaaacagctttctttattaataaaaactgaggaatgtgtttcatcttcttcctcataactccaccattctccaccgctttatctttcgtgttccacctcaccatcaccgccatgtcaacgtctcaccgtcgtgttctcatagagtttgagattaagaaataaaatggaatgaaatcaaattaaaaaacacattagattgaagctactgcaatttttttatgcatttttggtttcgttctccttcccacactgtcaataacattgttagattgaaacacagctctccaaatgcttccgaaagaattttttcttcttcacatctcagatctgaaattcaccaccaccaccaccatcaatcacttgagaaaccaacacaaacaccatttccgttgttctttgcaaaaggatttcaaatactcagatttttctccgtcttgcaaatacccgcttcgagtggtcactgcgattacttcataacttgaatgggtttttatttgacaccattgttaatcaatccttttgaaaaagtcacaatttttttaggaacaaaaagttttgaaaaacaaaatgttattactattctgttctgggttgcaatttcacagtgataaaaacaaatcttagtattgcaaccaagattcactgtgttctgggttgcaatgaacacagtgataaaaacaaacccagtgatgataaacaaatcttaaaaacacagtgataaaaacccagaaacaatgaacacagtgaaattgcaaccaaagaaaaacaaaatgaaagagattatattgaagattgttgtgaaaatgggattggaagtgataaacaaattgaactcttaaatcaatgaagattgaacattttggtttaatgttagcttcattttgatgcaaaattttctttttttttaagagaattttgagaggttatgttgaagatgcgtatgaatgggagaagaagaagtagaacaatgaacacagtgcaacaatgtttttctcttgttttaattgaccattaattcttgaccattgaaagtttatttgccatgtgtctaatatccgtgagttggactggaaaactggagcctttatgtactggagctgatcctgactcatatgcatatatatgatgaatgaaggatttcaaattgaaattgtatgataactccgatcatgtcgaatgtatttgcttttcttatgtttcaggttttgatatcgacagagctatttgtgatatagctgacggcgccagcttccatccgttctacgactgctgtaggtcggctgcaataccatataggcttccaaaacaattcccgagagacatttatccgccccccgaatttggcaaagatgttcgccaaatcgcatttactgccaccgacagtgaggattcgagtgcatggggttattggatttctcagtggcgctctgcgtgtacaaatttcacattttctctgatcagtgctctggatacgactgaaggcaaagtgatcaccaacatggatttggtacgattaatgaaagggaaattgtctgtcgaaaaagtggcacgagaaaagaagggagagaagatcaatacacagtgcgcatcactgttttgcgccgaggccgactgcgatgagccatttctcttcattgatgagcggccatatgtttcccagctaaaatccattgatagaggtaattatttaatcagtaatacatcctttatttagtatgtaataaacattttcttagcttttattaacggggtttgcttattaggtctgaccgatgaggtacttgtcgcacttagagaaacacagcttttatgtcacatttctgatgaggtacatctttttgatctcttttgtaattttctatttcttccctgggataaaccctttcccttgtcatcaaataattccatttctgaaaaggaatttccattttatagcttgcagcgaagttgttcagagagcatgtaaggaaattggttgaggaaaatatttcggtggcacttggaatacttaaatctcgcacaagagcaacgtaagactcgatttttttatttcaaatattttttacttttgagggatcaggtcattgtgggttttcattgatgattgagctggcttagtatgttaatgtttttcagtactgaagtgggccaagttgttgaggagcttgataaggtattggcatttaatgatttactcatctcatttaagaatcgttcggacatagatcgccttgcccgtggtgttggtccagtttctttagtgggtgagtttcctgaccgagtatctattatttggttcttttctagttttatattttcaacagttgatgttaaattaaattaattttttgcgcgtaggaggtgagtatgacggtgacagaaagatggaagatttgaaactcctctatggggaatatctttcacatgctcggtcttctcggcgcttgaaagataagaaggtaaatggactgttgttgatattatatatgaaatatatgaaacgatggacattttataatatatttcttatccatttcagcttgctgcaataaaaaatctatttggactgggtaaccgtgaatcagagcaacttggacagtcttcttccaaaaaaaagcgacgtggacagagagtttcaagtggcgagttacaaatggcagatagcaaagcgcaattccttcaaaaggccagtgaacttaatgaaggtaaaacttcaaatgctaatagttaattggaattttatcttttataaggcctgggttataattactttatgttccctaagtttatatttttgtgtacaattcttaatcttagttgtgaacttgtaatgaataataataatattcaattatatatatatagttgttctaatggttagcttcttatatgatgtgttattactatctttctttatcatgtttactattttacaacacaatctaacaatagttcattgtctttaagaaatttatcgccaacagcgatgtgttgctgatggggagctcaatgatgagaatgctgttgctttgtttgaaaaggtgataaaactgagtacataaatatacatctccacctttttttctgccttattcccaggatacctatacttttaatagaatttgtcatgaatttctggaatgtataatttggaattgtttgtcttggactctttttgtgtcgatatttttcttttatattgggtcaattcaaagtaagatgagataccaaaacttaaacttgaaactagatttcatttttgaaaatttcaaaacagaaatatacaacctaaggccccatcgagagtggtttttggttttacttactatcaaacctgttcattagtttgattaccttatacttaaatccaagctgtaaaagaagtctagtaacaattagttgatgacattgatatgtaaaataaacatggttatccttttttattttattgtcatgaggtatgttcaatctctgccagacattgaatttttttacttattactaattcatttttattctttatagattgtaaaggatgcaattgcttcaggggttgatggatatgatgctgaagtaaagaaatcagtaagaaaagcagcacacagcttgccgcttacgaaggagattgctttatctattgcaagcaaggcggtgagtatccattgttaagaaatttgatgctcatatacaatgattcaaataggattaaatttcactatgctgtttttatgacattaatacaggcgaggaaggtgtttagtatttacatagaacgtgcacaatcagccaaaaataataataatgaatctgcaatagaactgaagaggttgatagatttcaacaccttagttgtaactgagttggtgcaggacatcaaaggagagtctgctgatgtttcaactgaagaacctgtgaaagaggacattacagaaactgaagaaggagaatggggatcacttcaatcactcagaaaaataagaccagacaacgaacttatgggaaagtctggtcaaacagaaattactcttaaagatgatcttccagaaagggacagaattgatctttacaagacattcttgacttactgtctaaccggtgatttgattaatattccttttggtgctcagaaggacgattcagagtatctttatctaaatcagcttggtgggatcctgggattgactgacaaagaaataatggatgttcataggggtcttgccaaacaagctttcaggcaacaagctgaggtacttttggcagatggacagttgacgaaggccggggttgagcagcttggtaagctgcagaaggaaataggcttatcgcaagaatatgctcagaaggaaatggcagctgccattgaaacagctgtaactcaagggaggctcaacatgaagcagattaggaaacttgaagaatcaaatattgatttagacagcatggtatttgtgatcatgagagaaatgcttttcaaaaaaactattggggatattttctcatcaggtactggtgaatttgatgcggaagaagtttatgaaaaaatcccattggatctcaacatcaataaagagaaagctagaggggttgtccgtgaccttgcacaaagcagagtatccaactcgctcattgaggccgtcacactattaaaacagagaaatcacaagggagtggtaagtagtttcctaagcttcatatttttttattcaaataagtggttgtgtatggccaagtttgtttgattgcttattgtcttctgtgcaggtttcttccctcaacaacttgctggcttgtgataaagcagtaccttcacagacactttcatgggaagtgtcagaggaactttctggtctatacaccatatacttgaagagtgatccaaatcctgagaaattgaaccgtttgcagtatctgttgggcataaatgactcaaccacagctgcacttcgggactcgggatagattacttaacaccgcggaagaagagaagtttgtattctagttctggatatctaccgatgtttggcagtagagggcatattggagaggtcccgatgagcccccacaattctgtatttttattttccattttgtttaacggtgaaaccaaaaatatagtcatagacattacctccaattaggtttgctgattatgaggtagatttagatgaagtcctatcacaagggagacctagtgcacttagcacttatggcaaacatttgtcatctcaaactccgaatgtcaaactgaagggatcattctaaagtctgcatagacagaagtactaaagaggtttaacatgtcaaactgtaatgaagtagtcatccctcttgaaatgccggctgcggctgtgacattttatttttccctcgtgaaatataatatatagttgtctctcatgtaacttgtcatatacttgcttgaagagttacatatggagtatggtaaagctacacattgaaacttgaacgaaacatgctatcaaattcaacccactgtagttctaaatacactatcaaatagagtcctttaaacgtactcctttcgtttatattgtctgtcatttaatgttttgcacattatttaaagaaaaataataaataatgggttgagtgaaactaaattatatttaaaattgtgagtgatacattaaatatttcttttggtaaactcaggtatctctacgtgcaagcatggaaactgagatctatgtatggagttgacctcttccgatatatcttttttcatatccaacggttatggattgaatccaagaccaactcattaaggagtcaaaatatctagcacttgtgtcatattatttttaagcaaaatatttttagtaagtgttaggcaattgacatcaaattgtctaattacaaacaaagcatcaccaacatgaggctctgtcatttattataagttgaacaatatgtactatattctttataagttgttattaatttaatttgaagttttaaccattcagataagcttctgtttgcaatctattataatagttcatattgcaggcaaattatatattaatacggatgtgccccttttccgcttcccttaacctgatcgtattgctcccgcaaaaatccagtctgatgataattgcgcaccatatttctgcggtatcgaggaaacacattgttttaaaaaccaaccaatagctttaagcatgacttgagtaccaaacaactcaaataatacctaattaaattgctcctcaattctttgtagatggctttggctttgtcctgatatggtccaatctctgcaagattcactgacacatattagtttcaagaagcaatgaaaataaaaattgaatatatgcagatataccttttgaataatgatggagtgctgaaagaactctgtaattcatgtttatccaaattgtacctctccaatatggaagcatcatgttctttgttgtacttcatatacaaggaaccggggaataaacaatgccaattttggttcactttaatccaataatcgacatatgctgaataagttcactcaaatataatccattaaaaatgtattagagtgttggtgagaccttgttttggcaagactagagaacgtagtccttaataggctgctatttgaaatgagttcaagctgcttttccaggatccatgatccctgaatgagattgtaagattaaaaaatgcatcatttttgttttttctttaaaatggtgatgtggcaatagtggattgattagttgagtgacatacatgtgcaaaaaatccttcaatgtgagatgattgtattgtatatatagtactagtagtattagttgcggttaagatattaaccaaacaaggac

SEQ ID NO: 720 - DNA, 667 bp, Trifolium repens
ttcctctatacattatccaacattttctatcactattttagtaatatcaaacacattttacacatttataggaattatgattcctgataattaaaaaagactgtaccaaacaccctgttaatattgtggtaataattttagttgaagcagtttttatcttcagtacagggtagttgtttaatttaaatgtatttataataaagctggttgtactgaaactttcaaaatgaaattctgtttcatttccactcttaaattacctgatttcgaaattctctcaaagacagtactcttaagaatatgtatcaccattgaagagttgttaaatgttgttgatattatatatgaaacttcatctgtgtgaatacttattttatgatctacattttttaatatatttattatccatttcagcttgctgcactaaatcagttaaaaaatatatttggactgggtaaccgtgaatcagaagctatttcacttgatgttacatcaaagatatatcgtaaacgacttggacagacagttgcaaccggcgagttagaaatggcagatagcaaagcggcattccttcaaaatttgtgtgacgagctccattttgatccacaaaaggccagtgaacttcatgaaggtaaaacttcaaatgttaatagttaattgaaatttt

SEQ ID NO: 721 - DNA, 204 bp, Trifolium repens
tatttatttcaactttttattcaggtttgtgttgtctgtgcttcctccgggtggtgaggaacttaaaggtgatgaggctgataggattattagctttaagaattctttaggaattgatgatccagatgcagctaatatgcatatagaggtagttcatggttatggttattgaatatgtttgttatcattaatggaagtagttat

SEQ ID NO: 722 - DNA, 2985 bp, Xanthium strumarium
agccagctccgttgttgttgtagccggtgctgtggctgctggatatggattagggttaagaattggtgggaataggagtgccagtttgggtggagctgtggttttgggtgctgctagtgccggtgcggtttacgcggttaattcgtcggttgttccggagattgctgctgtgagtttgcataattatgttgctggttcggatcctggggcggtgaagaaggaagatattgaaaacattgctagcagatatggtgttagcaaacagaatgaagctttcaatgctgagctttgtgatatatactgccgatacgtgttatctgtacttccttctgatggtgaagatttaaagggtgatgaagctgatattattattaagttcaaaaattcattgggaattgatgatccggatgcagcagccatgcatatggagattggtaggcgtattttcaggcaaaggttagaaactggtgatcgcgaagcagatgcacaacagcgtcgggcatttcagaagctgatttatgtttcaacactcgtgtttggagaggcttcaggttttcttttaccttggaagcgtgtatttaaggttaccgaatcacaggtcgaggttgctataagggacaatgcccaaaggttgtatgcttccaagctaaaattgattggtcaagatattcatccggaagagcttattagtctaagagatgcacaattacaatgtcggctttcagatgagctagctgaagatatgtttagggagcacattagaaagcttgttgaagcaaatatatcaacaagtgtggatgtactaaagtccagaacaagaacagccaaggatgcacggcttattgttgaagaacttgataagatattggtattcaataacttgttagtctcgttgaagaatcatcctgatgcaagtcggtttgctcggggcgttggtccagtttcacttataggcggcgagtatgatggtgataggaagatggatgacttaaagcttctctacagggcatatgttgctgattctctatctggtggtcgtatggagaaagagaagctttctgcactgagccaattgaggaatatatttggtctgggtaaaagggaagcagagtcgattgcaatagaagttacatcaaaggtatataggaaacgccttgctgaatctgtaaccggcggcgctttagaagctgcagatagtaaagcagcttttcttcaaaatctttgtgaagaattgcactttgatcctgagaaagccattgaaatccatgaagcaatctaccggcaaaatcttcagcaatacgtgaatgatggagagcttagtgatgaagaggtgaagtctctggaaaggttgcaagttatgctttgtatccctaaacaaacggttgaaaagattcacgaggatatatgtggcactttattcgaaaaggttgttaaggaggctatagctgccggagttgatggttatgatgctgatgttaaacagtctgtaagaaaggctgcgtatggcttacgtttaacaaggggggtggccatgtctattgctggcaaggcagttcggaaaattttcattagttacatacaaagatcacgagcctcgggtagtagaacagaggcggcaagagaactcaaaaagatgatagcatttaacaacttagttgtaactgaacttgtatcagatatcaaaggagaatcatctgataccaccacagaagacgagcccattgatgtggaagcaaaacccgtagaggaagtagacgacgaagaatgggagtcactgcaaacccttagaaaagtcaagccggcccgcatgaccacagggaagcccggtcaaactgaaataactctcaaagacgaccttccagacagggatagaaccgacctttacaagacgtatttactctattgtttaaccggtgaagtgacgcgggtcccatttggtgctcaaataaccaccaaaaaagacgattctgaatacgcttttctaaaacagctagggggtattctagggttgaccgataaagaaattgtggaagtccatagaagcttagctgaacaggcttttacacaacaagctgaagttatattagcagatgggcaactaacaaaagctcgtgttgcacaattaaacgagttgcaaagacaagttggtttgccatctgaatatgctcaaaaaataataaagaatataacaagcacgaaaatggcagctgctcttgaaactgctgtgggccagggtcggctcagtataaaggaaatccgtgagcttaaagggtcggggattgagttagatgtgatggtgtcacagagtttaagacaaaatctttttaagaaaacagtggatgatatattttcttcaggaactggtgagtttgatgaggtggaagtttatgagaagattccagaagatcttggtattgatgctaacaaggctcgagatgttgttcatgaacttgcacgaactcggttggcaaattctttgattcaggccgtatcgttattgaggcagagaaatacttcaggggtggtttcttctctaaacgacttgttagcctgtgacaaagctgtacccgcctcaccattatcatgggaagtgcctgaagagttggcagacctgttttcaatatacatcaagaatgaccccgcgcctgaaaagctgtcacggttacagtacctgttgagcatcgatgatgcaaccgcagaagcattgaaagagatgaaggatcgtgcagtacctagtgaaactagtgaagaggagttcgtattttgagtgtagtttttaataactttttgtgcgcgatggcaactggcttgcgctataggtgtgagagaaccacgggtctttcttcccaaatgtctatttgtttgtttagatatgtttgaacgggtgtgcatgaccaaactggtttttgttgagctttattaataacatgaatgtacggttgatatttgttatactccattgaagatttggaggtattttggacc

SEQ ID NO: 723 - DNA, 1145 bp, Abutilon theophrasti
ttcttccccttgcgccgcttcaccattgcagcagactatacagaggtttattttctgaaaataaaaatcacagcgtgtccacccgtatcgattaccggacacttggtgtcttgaccgtgtccaaccttgaattttttcggcgtgtcagggagtgtcccatacgaggaggcttccggcgtatccgtgcttcctagctttctggtagcagctgccatgattctgaatggcttcacccttccctccaggtctgtttccttgaggctttctaagcctgttccatgtagctctagttttcatcatttgcctgccacatctcgcaacagcagcagcagtagatcttattgggatctaaaatcctgttcagttggaggcgtgcctttcttgcacctttctgctacatcatctccattgttgagtgggaatcaaggtagtctgtcgcaagctttaccatcattaccaaggcgtcgcagatctaatttggtgcctcgagcatcaaaggatgttccatttagttttcgtttccctgaaatgactaagaagcccagatggtggtggagggctttagcatgcctaccctatttaatgcctcttcatgagacatggatgtatgcagagacagcttatcatctacaccccttcttggaagactttgagtttttgacctatccgttccttggagccattggaagtttgccgagctggttcctgatggcgtatttctttgttgcatatctggggatagtgaggagaaaagaatggcctcactttttcagatttcatgtggttatgggcatgctattggagattggcttgcaggtaattgggaccgtgagtcggtggatgccaccttcaatctattggggtaagtttgggatgcatttttggacagctgtggcatttgcttacctctttaccgttttggagtccatccggtgtgcactcgccggtatgtatgctgacattccattcgtttgtgatgctgcatatatccaaattccatatgattaattagtgaaaacatatggtaaaaaaattgttataaatgtttagtttgtatggaaaaacatttcaaccatatatgaatgtttttttaagtttgttagttctttatttttaagtttttttttattttttatttttttacc

SEQ ID NO: 724 - DNA, 5246 bp, Abutilon theophrasti
tagttttataactttacaacactaaaaggatcaaacgaaaatttatcattttaaaaaagtcggttcaaaataataataataataatagaaactattggattgagtaattcacgttacccaaataacactttcgtgattcaattgttttaattgatagaattaagtgatccaattgtttaaactaagagtatggtaactctgttattttaattgaaagagttgaatgactcaattgtttaaattaaaagtaaaatgacccaattattatccgaataagagttgagtgatctgggatgaaatttactctttaattatttactggtatcgatttcaaaattgaattcaactctctcacttactattattatttgggccaaataatcattaaagctgggccaataaatattatgcaatatacttggaccaaaaaatgatataacccaatcaatggtttaaaaggaaaaaaaagcataccccccaatcaaaactttccctactcaagaccctatccttaaatttttatcgtgaagcatcatcttcttcttccccttgcgccgcttcaccattgcagcagactatacagaggtttattttctgaaaataaaaatcacagcgtgtccacccgtatcgattaccggacagttggtgtcttgaccgtgtccaaccttgaattttttcggcgtgtcagggagtgtcccatacgaggaggcttccggcgtatccgtgcttcctagctttctggtatttaaattatatagggaaacgctaactctccatgttatttcatgcctttaggttatttgattttgatggttggtctgcttcaggtttaacatttttgctccaccgtgctgataaaatttcatatattgtcttcaacaggtagcagctgccatgattctgaatggcttcacccttccctccaggtctgtttccttgaggctttctaagcctgttccatgtagctctagttttcatcatttgcctgccacatctcgcaacagcagcagcagtagatcttattgggatctaaaatcctgttcagttggaggtatatgccatgcttacccttttttcttttaaagacgtcgtaggtttaatttacatggtttgaaggtcaaaactcaatcagaataagataccgaattatttcggtttggtttcaattgttattttgatccacttggattatcaaattttaaagcaaaaaatatttcggttttgtttgattttctttttaaaccaaattgaaattattccatactaatttctacctgagagtctcagtttttttttgttttccgttctgtggttctgaattgatgaatgtcctaattcctaatactttgttttcttagatttgattgtgtaactgtccaatcttgtaggcgtgcctttcttgcacctttctgctacatcatctccattgttgagtgggaatcaaggtagtctgtcgcaagctttaccatcattaccaaggcgtcgcagatctaatttggtgcctcgagcatcaaaggatgttccatttagttttcgtttccctgaaatgactaagaagcccagatggtggtggagggctttagcatgcctaccctatttaatgcctcttcatgagacatggatgtatgcagagacagcttatcatctacaccccttcttggaagactttgagtttttgacctatccgttccttggagccattggaagtttgccgagctggttcctgatggcgtatttctttgttgcatatctggggatagtgaggaggaaagaatggcctcactttttcagatttcatgtggttatgggcatgctattggagattgccttgcaggtaatattgggaccgtgagagtcggtggatgccaccttcaatctattggggtaagtttgggatgcatttttggacagctgtggcatttgcttacctctttaccgttttggagtccatccggtgtgcactcgccggtatgtatgctgacattccattcgtttgtgatgctgcatatatccaaattccatatgattaattagtgaaaacatatggtaaaaaaattgttataaatgtttagtttgtatggaaaaacatttcaaccatatatgaatgtttttttaagttgagcattaagttttatatacccccagcttaagtactacggctgtttcgtttctgattatcctttccgataggtgttactctaattgatggttatgcttttgatgttgctatttatgatgtctaaaccgttttgtttcgtctatttgcttgcaatctaatggttactaggtttaggcatagttcaatgtttggcaaaacgatgccagcaaaatcaagttttcagcacgattacttgcatgggcaaaatcccagattacgaccattttaagtgaacagctaccatatatttataagtggccagtggccaaaaatgccgtggcttctttaaagagtggcttctttatagagtgagatgtgacttaacataagtggaccgtgtaaaaattttttttttgaagcacattgtaggcatagagaccacattgtaacttttaaaaatacaggtaccacattgtaatatttgatataatacatgtaccaaaaaagcaattaacccttgtcatttcagtcttgcatcattttcagcttttgtgtgcctttcatgctattttccattcccacgaaaaaccaaataataataaagggttaatccatattttagtcatccaagtatacttattttcccacattagttctttatgtttttttttcttttcatattagtatctaactttacctctcgtttcccgattcaatcatttttagttaaaataaaccggctggggtgttcgaccaattatttgctgccacgtaatataaatttagtacttacaaaatttagcattaaaaattcagtgtttaatttttcagcatttaattttttcagtttattaaacagactcaactaattgataattattatattataaattaacaatttcatcatgttaacatacattatgacttttatcatgtaacattttacattaccagtgttttcagacttgtttttaggattgacccgggctggcgggtcctagtccgatcacaactgaaatttttatttttgattttttaatatttgtttaagtctttaagaaacaataaataatgttcaaaaaattcagaaataccagaaaaaataaaaaaataattgaattttcaataattattaaagaaatataataataaaactatgatttaactattaaaccaaaaaattaaaacaattgaacatccaaaatttaacaaaatgcaacaaagaacaaacttaaagtcttaaacatctaaatttacttaccaaaaaaatcatctaaatttactaacaaactcacaaagtcacatatcgaagaagaaagaagaagagtgaatgaagggtttgatttgtgcgtgcaatactatgctgcagtttctttctttcaatttttggcccaaaacgatgttgttttggccaataattttgtaaaaaattaaaaaacaaggcattcggtccaatcgattttgtttcgggtcggtgaagcagcggaaggatcgcacttcaccgcccgtttttttggtcggatcagatcggaccgacgagccaacaacactgcactcccaattaaataaaaaatttaaggataaaatatcaattaggattggcccctccagtacttttgtgtccattactttccaatacaataatcatgatcatttaaatgtgtagggtccactcataaattgtcaaagtcatattaatcaatgatgatgaagctagtattggatagtaatggacacaaaagtactagaggggagccagatccgattgaaaaaatgttatctagcatttattacttgcatgacggattttttagttatttttttttcttcttcaaaacaattgaccattttttttttgagtttgacaaagtataattataggtggatctacatgggacggagctacacatggtccttgggagaaaaacttcttccgcacctaaactatgccccatggctcaattcatgctctcagtatatcttatcactctccaaattacacatatttttttattaattatttttattttattttcacatatgtcaaaatattattggagagacacagacgaaaataccaaacgaggacaaacgatttaggttgatgcttgggatattctgatcactctcaaatttggttaaactatttcaggactgtttcaaaggtcgattttcagaaacaattcgacgcagttggggtttttcgatttgttgcataggtgactggccacgatggtgaacttgaagatggcattgaggtccatagggtatgatgaattacagtaccttaaaagatggggttttgttgtaaatgtgcaccgctgtactctgtatttgttcccaattatcaatatgcacttaacagactctattaatctattttacccttttataattcttctgtgctctctaccactaactctgttttattttttattcgatcggaacttgccacatgactaaaggaaaaaactaaaatcaaatttagagcctcagggaatcaaccgataattaatcctcaactatgttttttttttctcgcattaagagtttttatttggtccactatcggtataaaaaaatactacacaagcgagtttaatcttataatatatatcttttctatttaaaaaatacacccacatgtcatcatcacaactctattgtaatttttttaactccaccaccagtgaattggataattttcctattattaatctgaaaaaaatcctttcttgttaaatgaagccctagccgccgtagccatgtgagcctccgaatacaagattaagccatactatgtggcatataaatcgggtacgtgcgtggttgggaccagtgatggaatcagaaattgagtcaagggactgaaatgcatatgaaataatttttttctcaaatgaacaaataaatatgagtattttcataattataatggtttgaggggtgaagctaattttacgataatactttttataaaaatttcaaatagttaatcttttaagttgaggggatttcagcccacccaggagataattccgaccctggtttggacggcggcctgaatattattatatcaacttgcgttggggatatgtttatccagcaaaccttgtatgctgaacaaattcttgtggcacaatagaac

SEQ ID NO: 725 - DNA, 621 bp, Alopecurus myosuroides
gccatcagttcgtagcttgcacccaagaacacaagttagttgtcaagcatctttatcgtcattcagctaccctgagttaacttccaaacctaaatggtggtggaggaccctggcatgtgtaccttatcttctgccactgcacaacatgtggtcccacgcagatgctgtgtaccagcttcatccatacttgcaacagtttagtctgttttatgccttcattgatacaatggcactagttcctggatggctttttctgatgatcttcatgactgtctacttctttgtggtgagacggaagtggtctccacactttctgcggtatcacatcatattggccattcttcttgacaccggctctcaagctctggcgaccatgtgcaactggaatccaagcattgtttttcagggcaaaccaatggcatatttctggatgacactggccttcattcagatcttcacagtcctcgagtgtatgaggtgtgcacttgcaggggtttatcctaatgtcccattcatatctcacacggcattcatccattctgatctgaacctgttcaggtaattgactagtgcgttgtgttgaataagaggggctaagtaactgtgtgtgtgtgagagaga

SEQ ID NO: 726 - DNA, 770 bp, Amaranthus albus
cacaggggcttctttgtcctcgcatctttcagcttcactgagccctcttttgggtggagaacatggtgggttgtcacacaaaattcctcttttacctaaaagaagactgtgcatgacacctagagcagcaaaggacgttccttatagtttccgctttcctccaatgacaataaagcctcgttggtggtggagaacgctagcctgccttccatacttgatgcctttgcacgagacctggatgtacgctgaaacagcttataatcttcatccatttcttgaagacctcgagtttctgacataccctttccttggagccatcggaagccttccagcttggtttttcatggcgtacttcttttgtgcttaccttgggatcgtgaggagaaaggagtggccccactttttcaggtttcatgttgtgatgggcatgttgctcgagattgctttgcaggttgttggtactgtcagtcgttggctgcctctttcagtttactggggcaaggttggcatgcacttttggacatttgctgcattcggatacctgtttaccgtgcttgaatgcataagatgtgctcttgctgggatgtatgctgatgttccttttgtatgcgatgctgcatatatccaaattccatatgattaatacatcgtttgtcgacaaataccagtattcactcatatgttataggttcatttttgcaacttcctatttagacgactcgatctgtttgatttgcagagtgtaagtttgtattgtcctacttgtaagt

SEQ ID NO: 727 - DNA, 638 bp, Amaranthus chlorostachys
agaacatggtgggttgtcacacaaaaattcctaatctacctaaaagaagactgtgcatgacacctcgagcagcgaaggacgttccttatagttttcgcttcccaccaatgacaataaagcctagatggtggtggagaacgctagcctgccttccatacttgatgcctttgcacgagacctggatgtacgctgaaacagcttataatcttcatccatttcttgaagacctcgagtttctgacataccctttccttggagccatcggaagccttccagcttggtttttcatggcgtacttcttttgtgcttaccttgggatcgtgaggagaaaggagtggccccactttttccggtttcatgttgtgatgggaatgttgcttgagattgctttgcaggttgttggtactgtcagtcgttggctgcctctgtcagtttactggggcaaggttggcatgcacttttggacattcgctgcattcggatacctgtttaccgtgcttgaatgcataagatgtgctcttgctgggatgtatgctgatgttccttttgtatgcgatgctgcatatatccaaattccatatgattaatacatcgttagttgacgaaataccagtaaacacccatatagttaaaggttc

SEQ ID NO: 728 - DNA, 1188 bp, Amaranthus graecizans
cttaaactatctattaagtcctatcttctatcacaccaaattcaccatgtatttgggtttctcgaaaccctagctactgctcactatcctccataaccatatccgccatttctatactttcttttcctactggttcttcaactcctgaaataggtcagagaatgatcataaatgggtgcagtatgaattccagagcatataaacctctgtcttgtaatgcttccttgccgaggcccgtttctttgccagcaaaggcagctttaactaatatcagagctttatgtcgaccaattgaggggctgaagttgagatgtttcacaggggcttctttgtcctcgcatctttcagcttcactgagccctcttttgggtggagaacatggtgggttgtcacacaaaattcctcttttacctaaaagaagactgtgcatgacacctagagcagcaaaggacgttccttatagtttccgctttcctccaatgacaataaagcctcgttggtggtggagaacgctagcctgccttccatacttgatgcctttgcacgagacctggatgtacgctgaaacagcttataatcttcatccatttcttgaagacctcgagtttctgacataccctttccttggagccatcggaagccttccagcttggtttttcatggcgtacttcttttgtgcttaccttgggatcgtgaggagaaaggagtggccccactttttcaggtttcatgttgtgatgggcatgttgctcgagattgctttgcaggttgttggtactgtcagtcgttggctgcctctttcagtttactggggcaaggttggcatgcacttttggacatttgctgcattcggatacctgtttaccgtgcttgaatgcataagatgtgctcttgctgggatgtatgctgatgttccttttgtatgcgatgctgcatatatccaaattccatatgattaatacatcgtttgtcgacaaaataccagtattcactcatatgttataggttcatttttgcaacttcctatttagacgactcgatctgtttgatttgcagagtgtaagtttgtattgtcctacttgtaagtccaacccgaatgaagtgccttttgttggtttagcggatgacatacgtctgaataatgttcttttgaatgactacatatgttaaattgagcattttctgcca

SEQ ID NO: 729 - DNA, 1145 bp, Amaranthus hybridus
ccgagcataaactatctattaagtcctatcttctatcacaccaaattcaccatgtatttgggtttctcgaaaccctagctactgctcacttccatatcttccatttctacactctcttttccttctggctcttaaactcctgagataggtcagagaatgatcataaatgggtccagtatgaattccagagcatataaacctctgtcttgtaatgcttccttgccgaggcccgtttctttgccagcaaaggctgctttaactaatatcagagctttatgtcgaccaattgaggggctgaagttgagatgtttcacaggggcttctttgtcctcgcatctttcagcttcactgagccctcttttgggtggagaacatggtgggttgtcacacaaaattcctaatctacctaaaagaagactgtgcatgacacctcgagcagcgaaggacgttccttatagttttcgcttcccaccaatgacaataaagcctagatggtggtggagaacgctagcctgccttccatacttgatgcctttgcatgagacctggatgtacgctgaaacagcttataatcttcatccatttcttgaagacctcgagtttctgacgtaccctttccttggagccatcggaagccttccagcttggtttttcatggcgtacttcttttgtgcttaccttgggatcgtgaggagaaaggagtggccccactttttccggtttcatgttgtgatgggaatgttgcttgagattgctttgcaggttgttggtactgtcagtcgttggctgcctctgtcagtttactggggcaaggttggcatgcacttttggacattcgctgcattcggatacctgtttaccgtgcttgaatgcataagatgtgctcttgctgggatgtatgctgatgttccttttgtatgcgatgctgcatatatccaaattccatatgattaatacatcgttagttgacgaaataccagtgaacacccatatgttaaaggttcatttgtgtaacttcctatttagacgactcgatctgtttgatttgtagagtgtaagtttgtattgttctacttgtaagtccaacccgaatgaagtgccttttgttggtttagcgatgacatacgtctgaaaaatgttctttt

SEQ ID NO: 730 - DNA, 1063 bp, Amaranthus lividus
catgtatttgggtttctcgaaaccctagctactgctcacttccatatcttccatttctacactctcttttccttctggctcttaaactcctgagataggtcagagaatgatcataaatgggtccagtatgaattccagagcatataaacctctgtcttgtaatgcttccttgccgaggcccgtttctttgccagcaaaggctgctttaactaatatcagagctttatgtcgaccaattgaggggctgaagttgagatgtttcacaggggcttctttgtcctcgcatctttcagcttcactgagccctcttttgggtggagaacatggtgggttgtcacacaaaattcctaatctacctaaaagaagactgtgcatgacacctcgagcagcgaaggacgttccttatagttttcgcttcccaccaatgacaataaagcctagatggtggtggagaacgctagcctgccttccatacttgatgcctttgcacgagacctggatgtacgctgaaacagcttataatcttcatccatttcttgaagacctcgagtttctgacataccctttccttggagccatcggaagccttccagcttggtttttcatggcgtacttcttttgtgcttaccttgggatcgtgaggagaaaggagtggccccactttttccggtttcatgttgtgatgggaatgttgcttgagattgctttgcaggttgttggtactgtcagtcgttggctgcctctgtcagtttactggggcaaggttggcatgcacttttggacattcgctgcattcggatacctgtttaccgtgcttgaatgcataagatgtgctcttgctgggatgtatgctgatgttccttttgtatgcgatgctgcatatatccaaattccatatgattaatacatcgttagttgacgaaataccagtaaacacccatatgttaaaggttcatttgtgtaacttcctatttagacgactcgatctgtttgatttgtagagtgtaagtttgtattgttctactcgtaagtccaacccgaatgaagtgccttttgttggttt

SEQ ID NO: 731 - DNA, 1016 bp, Amaranthus palmeri
cgaaaccctagctactgctcgctatcctccataaccatatccgccatttctatactctcttttcctactgtttcttaaactcctgagacaggtcagagaatgatcataaatgggtgtagtatgaattccagagcatataaacctctgtcttgtaatgcttccttgccgaggcctgtttctttgccagcaaaggccgctttaactaatatcagagctttatgtcgaccaatagaggggctgaagttgagatgtttcgcaggggcttctttgtcctcgcatctttcagcttcactgagccctcttttgggtggagaacatggtgggttgtcacacaaaattcctaatctacctaaaaaaagactctgcatgacacctcgagcagcaaagacgttccttatagtttccgcttccctccaatgacaataaagcctagatggtggtggagaactctagcctgccttccatacttgatgcctttgcacgagacctggatgtacgctgaaacagcttataatcttcatccatttctcgaagacctcgagtttctgacatacccttttcttggagccatcggaagtcttccagcttggtttttcatggcatacttcttttgtgcttaccttgggatcgtgaggagaaaggagtggccccactttttcaggtttcatgttgtgatgggaatgttgctcgagattgctttgcaggttgttggtactgtcagtcgttggctgcctctttcagtttactggggcaaggttggcatgcacttttggacattcgctgcattcggatacctgtttaccgtgcttgaatgcataagatgtgctcttgctgggatgtatgctgatgttccttttgtatgcgatgctgcatatatccaaattccatatgattaatacatcgtttgttgacgaaataccagtaaacacccatatgttaaaggttcatttttgtaacttcctatttagacgactcgatctgtttgatttgtagagtgtaagtttgtattgttctac

SEQ ID NO: 732 - DNA, 1042 bp, Amaranthus palmeri
accaaattcaccttttttttgggtttctcgaaaccctagctactgctcactatcttccataaccatatctgccatttctacactctctcttcctacaggctcttaaactcctgagataggtcagtaatgatcataaatgggtgcagtatgaattccagagcatataaacctctgtcttgtaatgcttccttgccgaggcccgtttctttgccagcaaaggctgctctaactaatatcagagctttatgtcgaccaattgaggggctgaagttgagatgtttcacaggggcttctttgtcctcgcatctttcagcttcactgagccctcttttgggtggagaacatggtgggttgtcacacaaaattcctaatctcctaaaaaaagactctgcatgacacctcgagcagcaaagacgttccttatagtttccgcttccctccaatgacaataaagcctagatggtggtggagaactctagcctgccttccatacttgatgcctttgcacgagacctggatgtacgctgaaacagcttataatcttcatccatttctcgaagacctcgagtttctgacatacccttttcttggagccatcggaagtcttccagcttggtttttcatggcatacttcttttgtgcttaccttgggatcgtgaggagaaaggagtggccccactttttcaggtttcatgttgtgatgggaatgttgctcgagattgctttgcaggttgttggtactgtcagtcgttggctgcctctttcagtttactggggcaaggttggcatgcacttttggacattcgctgcattcggatacctgtttaccgtgcttgaatgcataagatgtgctcttgctgggatgtatgctgatgttccttttgtatgcgatgctgcatatatccaaattccatatgattaatacatcgtttgttgacgaaataccagtaaacacccatatgttaaaggttcatttttgtaacttcctatttagacgactcgatctgtttgatttgtagagtgtaagtttgtattgttctac

SEQ ID NO: 733 - DNA, 349 bp, Amaranthus palmeri
ctattaagtcctatcctctatcacaccaaattcaccttttttttgggtttctcgaaaccctagctactgctcactatcttccataaccatatctgccatttctacactctctcttcctacaggtatgttctctctttatctctctcgctcttcatttgttctgtagttgtaaattagggtttttcattgtgactcagcatctactgtaggagtaagcaagaacgaaattacattacatttgcaattcatcggagattttctcttttcttccattaattttgtatcccaggaatatcaaaactttgtgaaatactgattttagttaagagtatagtaaaatcttattttc

SEQ ID NO: 734 - DNA, 3881 bp, Amaranthus palmeri
gggattaattgcctatagtgaatttggttaatccgatgacctgctatagtaggtaattcaccaataaaagtaaattatagaataatgtaaaataagaaaaaaattttgaaaataacaaaaaagatcagaaatgttttgaatattttttttttgatattttattttattttttttaaaaataaaacatactatagcaagtcaacggattattcaaatttactctaggcaaatacccccacaattgaaattattcttaattaattaatagataaaatcattgtatcgtgaaaaaattaattttttttaagtaattttttcttaaattttttgtaagctctttgggcaagccacccgagcataaactatctattaagtcctatcctctatcacaccaaattcaccttttatttgggtttctcgaaaccctagctactgctcactatcctccataaccatatctgccatttctacattctctcttcctactggtatgttctctcttcatctctctcttgctcttcatttgttctaatcttgtgtaatgtagttgtaaattagggtttttcattgtgattctgcatctactgtaggagtaagcaagaacaaaattacattacatttgcaattcatcggagattttctcttcttccattaattttgtatcccaggaatatcaaaactttgtgaaatactgattttagttaagagtatagtaaaattttattttctggttattgctttggattgttaatttatcaaatgtaatccagaagttatcatttgtgtgttgagttcaagttgctcaagtaattgaattggtggttttgaaatgttagcatgtagttttagctacatattttgtttgacattgataatcttatattttgtggaaaatacgagaaaatttgcatcctgaagacagtgcagcatggtttcaccgatacatacttacattacgggatactatacttactagtgtgtcgtacctgctcaaattcagtttcagtcaatagctgattttgagcaattcgtgcggggtgaccaacttaatacaataacaagataatttaagaaacttaaggggttgaataatattttcaatgaataaaacctaattaaggccgtaaagaaggtccgtcattggtttcaattgctgttttgccacttgtagaagtagataaacctgatggataacgtgttatccttcacaattgccgctatttgtgccagtggaagaggctagcagcttatttttcatccatattctgatatctttttgttctacaatgttgtcactcgaggattgatgttttttttttctatctcacttcatgcttgatgtaattcttgtgtaatggatatttgaatttctgttgtaggctcttaaactcctgagataggtcagtaatgatcataaatgggtgcactatgaattccagagcatataaacctctgtcttgtaatgcttccttgccgaggcccgtttctttgccagcaaaggctgctctaactaatatcagagctttatgtcgaccaattgaggggctgaagttgagatgtttcacaggtatactattttccttgtaacctgatgttctcttgttaatactcttgtgcaatttgacagggaggtgtgaggaggtgtagacaagtgaaattactccgttacacagagatgctcttggtcttgtctcatctgctggggtttggttgatgtcccatagtctttttgtgagaacttgatatgtcgtaattatggtctttgatttacaatctgaaaatataatttgtgctttagtgagctaagtaactaacaaaggtatggcagctaaggtgaaaaaacttggtcattcgtcgacatgaatttctatagttaaaaactcgctaggcttttgtaaatatattgtattttatctgttacaatatcaactatttctatgggtaatctcttcattggacttaactatgatatactactttccttgttagttgtttgtctcagtgcgccattttattcttttctgtcgtcatataatattcgtttaaatggcaggggcttctttgtcctcgcatctttcagcttcattgagccctcttttgggcggagaacatggtgggttgtcacacaaaattcctaatctacctaaaaaaagactctgcatgacacctcgagcagcgaaagacgttccttatagtttccgcttccctccaatgacaataaagcctagatggtggtggagaactctagcctgccttccatacttgatgcctttgcacgagacctggatgtatgctgaaacagcttataatcttcatccatttctcgaagacctcgagtttctgacatacccttttcttggagccatcggaagtcttccagcttggtttttcatggcatacttcttttgtgcttaccttgggatcgtgaggagaaaggagtggccccactttttcaggtttcatgttgtgatgggaatgttgctcgagattgctttgcaggttgttggtactgtcagtcgttggctgcctctttctgtttactggggcaaggttggcatgcacttttggacattcgctgcattcggatacctgtttaccgtgcttgaatgcataagatgtgctcttgctgggatgtatgctgatgttccttttgtatgcgatgctgcatatatccaaattccatatgattaatacatcgtttgttgacgaaataccagtaaacacccatatgttaaaggttcatttttgtaacttcctatttagacgactcgatctgtttgatttgtagagtgtaagtttgtattgttctactcgtaagtccaacccgaatgaagtgccttttgttggtttagcggatgacatacatctgaaaaatgttcttttgaatgactacatatgttaaattgagcattttctgccattttcaacattagcattgagtgtaagctgtatcgtcgtctttacaaaagatggtctatcaagagagcacctgaaagacaaaacattcaacataagctggagatcaaaaggaaaggtttactttgtgagccattagtaaatactagtatcttgaccaataaggattttaagcattcaaaataattagcatgtgatatagtgatacctcctacaacttaatttttcaatttcatgaaaataatttaatttgataagaaaaattttaatttccatattctatacgttgaatatgtaccttattagatttgataaaaaagatacgagcaatagacttttcacggtgtttgataatgaagatataaatcaattttccatagaactaaaaaaattatttgtatttctaattgtataaatattaattgtattataattcttgactataaaaatcaaattattcttttttttcataatcaaatttccaaaatatagttctcccttttctcaagagtttgctaatagtagagtgttaacaaactcaaaaacgagtgaacaattaaaagctttctatgaaacaaaaatctaaatatgtcaaacaggtcagaaaacctctcgactcgcttaaccagtttaaagttttttattttcatttttaagttttatcattgactacatctaaattgttaagtcttaataataagttttcgtttcttagttgtttattttgcattcaccatgcaaaacgaaaaatattaaataaaattaagtttaggttatacgctatatttattgatttaacttaaaactaattcaattaattaaaagagttttacatatttgtttcaggtttaaaattttgactagaacctaaccaattttaattaattaagtgaaatgtctcaactcaaacctacttatttcgggttaaattcaagtcgaattaacatgtcgggtcgacttttgcg

SEQ ID NO: 735 - DNA, 881 bp, Amaranthus rudis
tattcatcttcttcaaggttcttaaacttatgagataggtcagagaatgatcataaatgggtgcagtatgaattccagagcatataaacctttgtcttgtaatgcttccttgccgaggcccgtttctttgccagcaaaggccgctttaactaatatcagagctttatgtcgaccaattgaggggctgaagttgagatgtttcacaggggcttctttgtcctcgcatctttcagcttcactgagccctcttttgggtggagaacatggtgggttgtcacacaaaattcctaatgtacctaaaagaagactgtgcatgacacctcgagcagcaaaggatgttccttatagtttccgctttcctccaatgacaataaagcctagatggtggtggagaacgctagcctgccttccatacttgatgcctttgcacgagacctggatgtacgctgaaacagcttataatcttcatccatttcttgaagacctcgagtttctgacataccctttccttggagccatcggaagcctgccagcttggtttttcatggcgtacttcttttgtgcttaccttgggatcgtgaggagaaaggagtggccccactttttcaggtttcatgttgtgatgggaatgttgctcgagattgctttgcaggttgttggtactgtcagtcgttggctgcctctttcagtttactggggcaaggttggcatgcacttttggacattcgctgcatttggatacctgtttacagtgcttgaatgcataagatgtgctctcgctgggatgtatgctgatgttccttttgtatgcgatgctgcatatatccaaattccatatgattaattcatcgtttgttgacgaaataccagttaaacaccca

SEQ ID NO: 736 - DNA, 828 bp, Amaranthus rudis
tttatatattgtgttttatctgttacaataccagctatttctgtgggtaattctgaattctggattgacttcctctcttcattggactgaactataaattataatatactactttccttgtttgttgtttgtctctatgcgccatttgattcttttctgatcgttatatattattcattgaaatggcaggggcttctttgtcctcgcatctttcagcttcactgagccctcttttgggtggagaacatggtgggttgtcacacaaaattcctaatgtacctaaaagaagactgtgcatgacacctcgagcagcaaaggatgttccttatagtttccgctttcctccaatgacaataaagcctagatggtggtggagaacgctagcctgccttccatacttgatgcctttgcacgagacctggatgtacgctgaaacagcttataatcttcatccatttcttgaagacctcgagtttctgacataccctttccttggagccatcggaagcctgccagcttggtttttcatggcgtacttcttttgtgcttaccttgggatcgtgaggagaaaggagtggccccactttttcaggtttcatgttgtgatgggaatgttgctcgagattgctttgcaggttgttggtactgtcagtcgttggctgcctctttcagtttactggggcaaggttggcatgcacttttggacattcgctgcatttggatacctgtttacagtgcttgaatgcataagatgtgctctcgctgggatgtatgctgatgttccttttgtatgcgatgctgcatatatccaaattccatatgattaat

SEQ ID NO: 737 - DNA, 1184 bp, Amaranthus spinosus
cctttggacaagcctcccgagcataaactatctattaagtcctatcctctatcacaccaaattcaccatgtatttgggtttctcgaaaccctagctactgctcgctatcctccataaccatatccgccatttctatactctcttttcctactgttttcttaaactcctgagacaggtcagagaatgatcataaatgggtgtagtatgaattccagagcatataaacctctgtcttgtaatgcttccttgccgaggcctgtttctttgccagcaaaggccgctttaactaatatcagatctttatgtcgaccaatagaggggctgaagttgagatgtttcacaggggcttctttgtcctcgcatctttcagcttcattgagccctcttttgggtggagaacatggtgggttgtcacataaaattcctcttctgcctaaaagaagactatgcatgacacctcgagcagcaaaggacgttccttatagtttccgcttccctccaatgacaataaagcctagatggtggtggagaactctagcctgccttccatacttgatgcctttgcacgagacctggatgtacgctgaaacagcttataatcttcatccatttctcgaagacctcgagtttctgacatacccttttcttggagccatcggaagtcttccagcttggtttttcatggcatacttcttttgtgcttaccttgggatcgtgaggagaaaggagtggccccactttttcaggtttcatgttgtgatgggaatgttgctcgagattgctttgcaggttgttggtactgtcagtcgttggctgcctctttcagtttactggggcaaggttggcatgcacttttggacattcgctgcattcggatacctgtttaccgtgcttgaatgcataagatgtgctcttgctgggatgtatgctgatgttccttttgtatgcgatgctgcatatatccaaattccatatgattaatacatcgtttgttgacgaaataccagtaaacacccatatgttaaaggttcatttttgtaacttcctatttagacgacttgatctgcttgatttgtagagtgtaagtttgtattgttctactcgtaagtccaacctgaatgaggtgccttttgtatgtttagcggatgacatacgtctgaaaaatgttcttttgaatgactaca

SEQ ID NO: 738 - DNA, 1144 bp, Amaranthus thunbergii
atcacaccaaattcaccatgtatttgggtttctcgaaaccctagctactgctcacttccatatcttccatttctacactctcttttccttctggctcttaaactcctgagataggtcagagaatgatcataaatgggtccagtatgaattccagagcatataaacctctgtcttgtaatgcttccttgccgaggcccgtttctttgccagcaaaggctgctttaactaatatcagagctttatgtcgaccaattgaggggctgaagttgagatgtttcacaggggcttctttgtcctcgcatctttcagcttcactgagccctcttttgggtggagaacatggtgggttgtcacacaaaattcctaatctacctaaaagaagactgtgcatgacacctcgtgcagcgaaggacgttccttatagttttcgcttcccaccaatgacaataaagcctagatggtggtggagaacgctagcctgccttccatacttgatgcctttgcacgagacctggatgtacgctgaaacagcttataatcttcatccatttcttgaagacctcgagtttctgacataccctttccttggagccatcggaagccttccagcttggtttttcatggcgtacttcttttgtgcttaccttgggatcgtgaggagaaaggagtggccccactttttccggtttcatgttgtgatgggaatgttgcttgagattgctttgcaggttgttggtactgtcagtcgttggctgcctctgtcagtttactggggcaaggttggcatgcacttttggacattcgctgcattcggatacctgtttaccgtgcttgaatgcataagatgtgctcttgctgggatgtatgctgatgttccttttgtatgcgatgctgcatatatccaaattccatatgattaatacatggttagttgacgaaataccagtgaacacccatatgttaaaggttcatttgtgtaacttcctatttagacgactcgatctgtttgatttgtagagtgtaagtttgtattgttctactcgtaagtccaacccgaatgaagtgccttttgttggtttagcgatgacatacgtctgaaaaatgttcttttgaatgactacatatgttaaattgagcattttct

SEQ ID NO: 739 - DNA, 1043 bp, Amaranthus viridis
accatgtatttgggtttctcgaaaccctagctactgctcacttccatatcttccatttctacactctcttttccttctggctcttaaactcctgagataggtcagagaatgatcataaatgggtccagtatgaattccagagcatataaacctctgtcttgtaatgcttccttgccgaggcccgtttctttgccagcaaaggctgctttaactaatatcagagctttatgtcgaccaattgaggggctgaagttgagatgtttcacaggggcttctttgtcctcgcatctttcagcttcactgagccctcttttgggtggagaacatggtgggttgtcacacaaaattcctaatctacctaaaagaagactgtgcatgacacctcgtgcagcgaaggacgttccttatagttttcgcttcccaccaatgacaataaagcctagatggtggtggagaacgctagcctgccttccatacttgatgcctttgcacgagacctggatgtacgctgaaacagcttataatcttcatccatttcttgaagacctcgagtttctgacataccctttccttggagccatcggaagccttccagcttggtttttcatggcgtacttcttttgtgcttaccttgggatcgtgaggagaaaggagtggccccactttttccggtttcatgttgtgatgggaatgttgcttgagattgctttgcaggttgttggtactgtcagtcgttggctgcctctgtcagtttactggggcaaggttggcatgcacttttggacattcgctgcattcggatacctgtttaccgtgcttgaatgcataagatgtgctcttgctgggatgtatgctgatgttccttttgtatgcgatgctgcatatatccaaattccatatgattaatacatggttagttgacgaaataccagtgaacacccatatgttaaaggttcatttgtgtaacttcctatttagacgactcgatctgtttgatttgtagagtgtaagtttgtattgttctactcgtaagtccaacccgc

SEQ ID NO: 740 - DNA, 556 bp, Ambrosia artemisiifolia
  unsure (1)..(556): unsure at all n locations
acacacaaaacgccacccccatcatctcgaagacatgtatctccaagagcatcaaaggatactggtgcatttagttacagataccccccaatggagaaaaaaccgcgatggtattggagaactttagcatgcttaccctacctaatgccgcttcatgaaacatggatgtatgcagcaaccgcctatcaccttcaccctttcttggaaattttcgagttcctcacttacccttttctacgtgttttagggggtttgccaagctggtttttaatcgcgtacttcataattgcttacctggcagttgtaagacgaaaagagtggccccacttttttagatttcatgtggtgtcagggatgnnnnnnnnnnnnnctctgcaggtgacaggaactgtgtggcgttgggttccgaaagcctggtattggggtaagattgggatgcatttttggacggccttcgcgtttgcttttcttttcacggttttggagtgcattcggtgttgtcttgttgggatgtatgctgatgtgccgtttgtttcagatgccgcgtatattcaaa

SEQ ID NO: 741 - DNA, 1073 bp, Ambrosia trifida
ttacattacattatcttgtctatgtaagccgtcaccgtccttaatcatctgccgttaagaacacaatcaacaggtctgggttaataaggtgtttcaatatgattttgaatggttattcgatgcattccgggcagttgctgacctacaagccatctaagaccagccttttgaagccgatgcctcgtccacgcggactgtcggtaccgcgtgttaggagttgcttcacagctcatcaggagctgagatctttctcttcttctcaaggagcttcacttgttcatctctctgctacatcatctctactttatgggcatttaggtctatttacacacaaaacgccacccacatcatctagaagacgtgtatctccaagggcagcaaaggatactggtgcatttagttacagataccccccaatggagaaaaaaccgcgatggtattggagaactttagcatgcttaccctacctaatgccgcttcacgaaacatggatgtatgcagaaaccgcctatcaccttcaccctttcttggaattttttgagttcctcacttacccttttctacgtgttttggggggtttgccacgctggtttttaatcgcctacttcataattgcttacctggcaattgttagaagaaaagagtggccccacttttttagatttcatgtggtgtcagggatgctactggaaatttctctgcaggtgacaggaactgtgtggcgttgggttccgaaagcctggtattggggtaagattgggatgcatttttggacggctttcgcgtttgcttttctttttacggttttggagtgcattcggtgttgtcttgttgggatgtatgctgatgtgccgtttgtttcagatgccgcatatattcaaatcccgtatgaataagggttgcgacttcaatcttgttgttagcacttgtcacctgtttagtgtttacctttgtactgcgcaatgactatgcactttgacaatgtatttgggtacatgatagtagtagcagtgaaaagacaaacatagatcacttgaattacttttgaagttaccaacagtatgcatcaaatg

SEQ ID NO: 742 - DNA, 1045 bp, Ambrosia trifida
gttttgaacaaactatcattaagggtgtgcttaagtatgttcatgatcatgtttttagtagaaataaatgaagatcttaaaacgcgtttcaaataaacctaacctgttagttagctgggcatgcatcattcaatacggctgctaaattccatgtatggttgtagaatcaatgcaagatttttttacttaacgttttttggtcgttgttgatagcaggagctccacttgttcatctctctgctacatcatctctactttatgggcatttaggtctatttacacataaaacgccacccacatcatctcgaagacgtgtatctccaagggcagcaaaggatactggtgcatttagttacagataccccccaatggagaaaaaaccgcgatggtattggagaactttagcatgcttaccctacctaatgccgcttcacgaaacatggatgtatgcagaaaccgcctatcaccttcaccctttcttggaattttttgagttcctcacttacccttttctacgtgttttggggggtttgccacgctggtttttaatcgcctacttcataattgcttacctggcaattgttagaagaaaagagtggccccacttttttagatttcatgtggtgtcagggatgctactggaaatttctctgcaggtgacaggaactgtgtggcgttgggttccgaaagcctggtattggggtaagattgggatgcatttttggacggctttcgcgtttgcttttctttttacggttttggagtgcattcggtgttgtcttgttgggatgtatgctgatgtgccgtttgtttcagatgccgcatatattcaaatcccgtatgaataagggttgcgacttcaatcttgttgttagcacttgtcacctgtttagtgtttacctttgtactgcgcaatgactatgcactttgacaatgtatttgggtacatgatagtagtagcagtgaaaagacaaacatagatcacttgaattacttttgaagttaccaacagtatgcatcaaatgttttcaaatgttgtgttggc

SEQ ID NO: 743 - DNA, 243 bp, Ambrosia trifida
ttttgaagccgatgcctcgtccacgcggactgtcggtaccgcgtgttaggagttgcttgacatctcatcaggagctgagatctttctcttcttctcaaggtttgtgttttaagctagttttattgtgtgaaatgttatcatccagtgccttgttttggtttacattggagttattacgctgtatttgagttgtatatgatcttataagtctaatgtaaacgaattacggccctgctttaaaaa

SEQ ID NO: 744 - DNA, 461 bp, Ambrosia trifida
gacatagataatgtaaattgttaaatttaggcaattaaaaaccggggctcgttacattgggccttggagcgtaagcccaaccccaacccggctaattgatgggttttattgttgtttcctgattcatcatctatctagtctagtctagagcttagcttcctgtgttttccccattacattacattacattatcttgtctatgtaagccgtcaccgtccttaatcatctgccgttaagaacacaatcaacaggtaaccaacctctatcttttaataaattcattccataatcctctaacactaacatctgtgccctaatttatttccattatcgccaatttattaaaactaaaaacattcatttcagacattggtggtttttcagtttctgatgtgttatttgtgtttattgtctaggtctgggttaataaggtgtttcaatatgattttgaatggttattc

SEQ ID NO: 745 - DNA, 1130 bp, Chenopodium album
tgctgctgctttcccaaaaccctaactactgcttacattcttcttcctctttcttctacttcactattcatcgtcttcattaacctccatttctacacttctctcactcacactgtcttccctaggtctccagttccttaattgatgtttgaaatgttctgttttgggtgcttaaacttatgaactggtcagagaatgatcataaatggatgcagtatgaatttcagaccatataagcctatttcctgtaatgcttcccggccaagacctgctccttcacctgcaaaggctgcgttaaccaatgtcagagctctatgtcgaccaactgaggcgctgaaattgaatcatcctacaggtttttcattgtcttctcatctttcagcttcatcgactcctctcttgggtggagagcatggtgggctgtcacacactattcctctcttacctaaaaggagaggacactccatggtaccccgagcagcaaaggatgttccttatagtttccgctttcctcagatgatgaagaagcctcgatggtggtggagaaccctagcctgccttccttatctgatgcctttgcatgagacctggatgtatgcagaaacagcttatcatcttcatccctttcttgaggaccttgagtttctaacataccctttcctccgatccattggaaggctgccaccctggtttttcatggcatatttctttgttgcttacctcgggatcgttaggagaaaagagtggccccacttcttcaggtttcatgttgtgatgggaatgttgctcgagatagctttgcaggttattggtactgtcagccgttggatgcctcaagcagtttactggggcaagtttggcatgcatttttggacagctgtggcatttggttacttgttcaccgtgctggagtgtattaggtgcgctctcgcggggatgtatgctgatgttccctttgtgtgtgatgctgcatacatccaaattccatatgattaattaggtcctttgtctgtggatgaagtgttctgcaaatgtggaacatacttgagcagcttgtttagagagcatatcatgaaaggaccaaacactctcatctgtttaaggtgctcttttttgtgtcccgctcccct

SEQ ID NO: 746 - DNA, 1081 bp, Commelina diffusa
gtcccccaaaatcttatcctcttttccggcgatcgtccacaccccctcgacggccaacggccaggtggtcgtggacatgattctaaatggatgcatgctaaactccaagaacatgtccatattgcccagcaattctggtaaactgtaccattctaatcactcagcaggctacacaagtcgaagagtaaatgtccattgtggtgttactagaaaaaatgttcttacgaatgctggagcttggactgcacttccactgtcaagcacttctacttccctccttagaggagatcacaacaacttgactaattggatgctgggtttcccgaagcttcctgcagcaaggcctagaagcagcatgattcctaaagcagccaaggatgtccccacaagctaccgatatcctgcaatgaccaagaaaccacagtggtggtggaggaccttagcttgcatcccgtacctcatgccgcttcacgagacatggatgtatgccgagaccgcttaccatctccaccctttcttggaggacttcgagttccttacatatcccttcctgggtttcatcgggaggttgccgagctggttcctcatggcctatttctttgcagcctatctagggattgtcaggaggaaagagtggccacattttttccgtttccatgtcgtgatggggatgcttcttgagatagccctgcaggttgtaggtactgtgagtcgctggatgccacttgctgtatactgggggaagttcgggatgcatttctggactgcagtggcattcggatatttgttcacagtgttggagtgcatgagatgttcattagcgggcatgtacgctgacattccatttgtctgtgatgcagcttacattcagatcccatacgactaatgtggataaggacagatgtcatcaatttgctccaatgttccgttttgttcacctttagcaatatgttagaattatgttttgcaacttcttgtttctctcgatgttgtgacttaatttatagtggtttcaattgttatgctaatgtatgtttttccgcgtaatacaactaatgctttgtatgtgtatacaaaaaaa

SEQ ID NO: 747 - DNA, 1189 bp, Conyza canadensis
accttcagccaggtcctgctgggatatttggccgtcacaaccgccggccggttcatacgaaagtgtctcagtatgattttaaatggttactccatatatggggggcagttagttaaatatcagacctgtaaaaccaagcctttgaagtcaatgtctatatgtgctcttcgtccacaggcactctcactttttgagggttaggagttctttgaaatctcatcaggagcacagatctttctcttccctaggagccccacttgtgaatctctctgccgtatcatctccgctatacgggcatctaggccatttcacatccaaaacaccagccagattgtctcgaaaacgtcactctactgtctctccacaagcatcaaaagataccggtgcatttagttataaatttcccccaatggagaaaaaaccaaaatggtattggagaactttagcatgcttaccatacttaatgccacttcatgaaacatggatgtatgcagaaaccgcctttcacctccaccctttcttggaagatttcgagttcctaacttacccttttttgagtgctcttgggggtttaccaagttggttcttgatcgcatatttcatagttgcttaccttgcagttgttagaagaaaagagtggccacacttttttagatttcatgtggtaacggggatgctactggaaattgctcttcaagtgacaggaactgtatggcggtggctgccgggtgcctggtattggggtaaggttggaatgcatttttggacggctttcgcgtttgctttcctgttcacagttttggaatgtattcggtgttctcttgctgggatgtatgctgatgttccatttgtttcggatgcagcttatattcaaatcccatatgaataaggtgtcttgatcgacgttaatcatgttgttattgttagtacttgacaattctctccttttggtcctttttagaactatgaggtgctattttgattctcttgactaatgtaagaaatggtttgagtgttgtactgctgtttgtacatttaaattacagcatacatagcgtgatgcttaaccatgacttccttacaaacaaatagcaagttgaaaagtctgttggtgatttaaaataaaatggcataaagttacagcaaaaaaaaaagaaaaaaaaacaaaacatgtcggccgcctcggtct

SEQ ID NO: 748 - DNA, 9046 bp, Conyza canadensis
  unsure (1)..(9046): unsure at all n locations
accttaatttatggggtgttacatgatacacgtatgaccatcatgtgccatctagaacataacctgcattgcatgaattaaaaaatgagattttcatgtcacttcaagtaccctaatttaaggtagaagtgacaacttaacctggagtttttcttgcatcttcggcccttattttccttatgttatatatatcaattattgtggatttgtattctggaaattcctgtattcacgtactaaaattcggctcgatttaccacctagtcttactaccctttccataaactcttttcaactgcagacatatgccttaaataggaatgaccctcatcattccctaatggatggtgattatatacggtctatcacctttaccttataaccatcatcttacatctatattcaaatgacatttcaacataaacggacaattagtttttctggacctagaacctttgtttttgctacccttcttatcatatgtttcacttctttgtttttgctccccctcttatcatatgtttctttacaatgacaaacaaatgagactttccaatctacaccactagtctttctatcggatcttcgcttgtgtatcaccaaaaccgagctcacgtcctgtctttgagcccagttcgtaagtgtttcatgcaagtcgaatgtatgaaatatagtaaacacaaataaaatattttattattcacgaaaaatatctatgaaaaaaatatatgaacgatatcgtatacattataccttatttttatataatgcttcagggttgtagccaagctcaaaatttgaatcgtcggattcatcacttgatttggatcgctttcatcatattgattgaggccaacctatcatcctaataagaagaaaggggcaaggcaaaacctagtcctaacaagttgttgggtttccatcagcccgaaaagtaatctattgattctctctcaattggttggggttgttttcattaaaaaaacatcatttgaaaaagaataaatatgaacaccaaggaggatgttttcttggtgtggatatgatagatacagaaggagaccttgcattaatttttctcacaaacctcaattagtgtttcacccttacctcgcttaatgtttcatatttatgtcaacatgtacaaaccttttagcactaatattactgctaaaggtagtgtacgagttgtcctttccgacacttattttttagcaacgatattgttgctaaacgttgtatcagaaaagataaaatcgttgctaaagatcgtaggtagaaaagacaaaattactgctaaaaatatcatctctgttaaatgttgtatcagaaaagaaaaaatcgttgctaaaggttgtaggctaaaaaataaaattgttgctaaaagatatgaccgggtgaataaaaaagtgatagggattaggaagttccctttgaataatatgagggctttttatgtaaatgccgcgggcaacaaaagttgtagacttgtagtaatatttcattttacattatctttttctgtgtaaaacaaaaaacccaccttcagccaggtcctgctgggatatttggccgtcacaaccgccggccggtaagttccattttcttatttttatatcacttttaattatatcgttgctttttattatgagattttatttgtgtttttttatctaagtttcttaatgttaacaaatattatcattttaagataatgtattttctaatgtacaacagtttattgattaataagttttgtaaagtgattattatgggtttaatatgtgcattgtatagaaaagaaaaacccatgtatttggttggtaattaaattgtaaggtatttttagttttactatgacagagataagagtgaaaattgaagtaagtcgtcatgattcaaccataggtcgtataatttatagaattcgcaacaaagattcgaaagattaggtgtttttaaaccacctgctaggtagcctaagtgggtagccgtcctcaagtcgttacaagaggtcgaacctccctaggtaaaatcttgagaaaggaacccaaaactgccactggaataatggaatacctggttacgctgtacattctgtgccaaaagatttgtccttttccgcataacctgaatagggaaaaatatctagctttactcgtttaatgaataatgaggtctggtttggccaatatcgaattttggttaaacttttggcatgatgggaaaatagtttggttctcaatggataataatctaagagaaatagagtgaacgacctgaacttgaatcgttatatcaggattatttttatttctttttttcctttattaggctgggtttgtatcgttctaatatccactgaaaagtttatttagggggatacttgttgaataaccgtgtgaaatgagtatatgagaataatgataagaatcactatctaacaatttttgttaggaaagtgtacataaggtaagtttatttagaggtaaatctcctaccggcatccttgaaagcttttaactgccttcatgattcaggtctaatgatatgcatatacaatttttatgtgaacatgtttttagttttcccatatcttgaaaaacatctgatgaactatttatctaagatgctacgttcagtatttttctattgccaagttggcataagttttgttgaaaattgaagacccatgttgttgaatttagtactgcatgcagtttgcattactttttggaaaataatgttttttttgagatacaattctgaagtgtcgaacttttgttaaactaaagctatgatactttaattcaaagtgttctgtttaataatgtgggtaatttgtaatgtattacgtaaatgaacattgtcaggttattctcagttttctttagcttttatgaattctaatacagcttttattgcatgttttttgtataggttcatacgaaagtgtctcagtatgattttaaatggttactccatatatggggggcagttagttaaatatcagacctgtaaaaccaagcctttgaagtcaatgtctatatgtgctcttcgtccacaggcactctcacttttgagggttaggagttctttgaaatctcatcaggagcacagatctttctcttccctaggtttgtgtatcctctaactagttttactttggctgaagttttgaataagtccatttgtaacatgctatattcatgatcaaaaaattgactattgaagttgtgaaagtaacaaaaagtgtttttactggacataatctcttaacgattattccatacttgacttggaccttttcagtatgagaagaactgttatcgtaagaatgtatcatttgttcgatgcacggagtgcaatatatagtgaatattgcagaatttatagaaacatacaggcttatctcaaattatcagatatataggtcaatttaatacacagattactgttagatagagagatgtggtgatacaggtgtctttcttgagcagtctctcttcccttgggtaggggaatgactgtccatatcatacctcctcaatacccttcacaccattgagattgggtattgttgcttatgtggtgattcaactaggcatgttgaaatcttctagaatttgaaaaagagtattatcgtctatttttgttagtcctttgagatacccagtggaagggaagaacttgcaattctaagaagaccctttatgcagttcatgatgctctcaagatagtaaagcatcttcagatgcattccactttttaatcatgttgcttctggattaggattgactgaaaactcatcatgtaatcaagaaaaaatgtactcttcgagaaaaagctaacatttttggagtttgggctaccttaacttatcgcatacaacccacggacatgggtttaagaatatatacatgtttgtatgtacaataattagtctaaaatcttttcaaatagattacttattgctgaatatccttttgctgtctgtttcactgttttctcacttagatcaaaattgcatcttggtatgacaattttccttgggagataatattatattaaactctttggcccataaagccacttgtgtgtgtgtgtgtggaagttctaaagatcatattgtcatggtggtgaaaacttcctttagattgttctctagaatgagaaatgaaaagggtggttatacatattcgtaatttttgtattagagcactcttagccggcttacctttaacctaactctctagtttatggcctggtaaagaacctggttatatcactgttgtgagaccttctcatgataaagatgtcttgtttccattgctcataactgaatcttattacttatttttttagcagataaaacaatacttgaaggtactgtggtataattgctaattaggatttttatacagtatatacacattagatgtgtacataaaagttgtaattgctaaagattatgctctaggatttatatttacatggaatagttttctgctttccctcaatacaaataaatatcacatgaacttaataaatctgtttttacaagcttatgccaaagcattctgttccttgagtagtgtagttggaatgtctgatcctacaaccatgactagtttgattattttttctgctagtagtagcagttttgactcatttatggataaacagatcattgtggttactacttttactctaaaggtcaaatgtgaaacatatagttctcaagctaaaatggagcaggtcaaacataacagaagtgtacctctaaattgttaaatctgagaatcgaattatcatttgaacagcatagttttgtaatcatatttgtctgtaaaacaaatgagaaacaatagaccaagtgctgactcaaattgacccggtctaaaatcatccgatttgatgtattgcacttttgcccaacttgcctgttgtgccacctctggttttcgatcaaatcaagtttattttaactttcttcttctttttcgacatttttgatgcaggagccccacttgtgaatctctctgccgtatcatctccgctatacgggcatctaggccatttcacatccaaaacaccagccagattgtctcgaaaacgtcactctactgtctctccacaagcatcaaaagataccggtgcatttagttataaatttcccccaatggagaaaaaaccaaaatggtattggagaactttagcatgcttaccatacttaatgccacttcatgaaacatggatgtatgcagaaaccgcctttcacctccaccctttcttggaagatttcgagttcctaacttacccttttttgagtgctcttgggggtttaccaagttggttcttgatcgcatatttcatagttgcttaccttgcagttgttagaagaaaagagtggccacacttttttagatttcatgtggtaacggggatgctactggaaattgctcttcaagtgacaggaactgtatggcggtggctgccgggtgcctggtattggggtaaggttggaatgcatttttggacggctttcgcgtttgctttcctgttcacggttttggaatgtattcggtgttctcttgctgggatgtatgctgatgttccatttgtttcggatgcagcttatattcaaatcccatatgaataaggtgtcttgatcgacgttaatcatgttgttattgttagtacttgacaattctctccttttggtcctttttagaactatgaggtgctattttgattctcttggctaatgtaagaaatggtttgagtgttgtactgctgtttgtacatttaaattacagcatacatagcgtgatgcttaaccatgacttccttacaaacaaatagcaagttgaaaagtctgttggtgatctaaaataaaatggcataaagttacagcatgtaacatggttattctagtagttgcttatatagtatacctgattactctttgtttgctccaccaatagatgctcaagcataactaccacctcagcaaacacatcattaaaaaattatagtacattgaagtattcagctcatgttgcctgagttgtccactttgcggggtcctataggtagtgtcaccaagggtttgcccctgaaggactatagacaaggattatccaagaactaattctgtaaaacattctcaatgctaagactagtctaggacccaccactaataccttaaacattccacctacacttatttattgcagtgacgagtggccaaggacgagtcccacttaatggtgttgactcgtccctgggttaaggacaaaaggaacgaagagcgttgggcacctcgtaaccaaaagttcaataacttggtataatgggtaactaacattggcttactttttttgtgtggtggtggtcactttggaaacataggaaccatgtcattcaccaagcaagtgaagaatcaggcagtgatgtgtttcagtctattgtatctctatcttattttttggatttcaactcgtgataatgaatctaatatgtcatggtcaatttgggcgatgagtccatcttttcttttgtactttggcaccatgccgaaactttttttaaaaaaacttcagttgttaaaaaaaaaaaaacattggcttactttaagtttctagtttcctaacataatgattttcttgtttcctaatataatgatttattgacaacgaaggaggagaaattttcataacaatcttggttgaaatattatatctggctttttttttctttaaaaatgacaaaacggtttgagtttctaaaaaaaaaaacggtttgagtcacctggtcaatcgggaaccataccagtttttggaaaacaactcaaaggaaaaaaaaacgaagacaaaaaaaaatgacctgattgaacttgtcttcaaccatgcactgatataatggttaggttgacttaggttataaacattgtttcacgatgatcactgagtagattagtgactgctttgatcagggactccaagttgatcagcgactataatgacttttgcctatttagtttttttttttttaaagtaaattttacctcagacgcgtatgatgtgtgctaatcgcataacgaaatgagcccgcactaaataaattttacctgagacgcctatttagtatatttaactaattgtaatccatgaaagatcatttaatctattttgaactgttgtatcttgcaaaaatattgagtttttaagatatatatatgtaatacaaacacaaattttaggctctcttgcaatccaattttgtagtttgcaaggagtacgcggctttcaactttttgtacaccttgaatattactattgggttcaaaaccttaacctctaagtggctctaacacttgttgttttttaaaaaaaaatttgaaaaaattaaaaaactacttcttgtctcgatatgaaacccgtacaattcatacataacaatatagtttatatgagttacatatcatcatctgaatatatctattgataaaattttaataagttattttagtaaatttttaaatgccgttcaaagaaaatatagctatatagaaatatcttttcttttttagaggacaacttttcacatttaaattatgtattagatataccttacccagtttaaagtctaaaaaaaacttagcagaaaactatctcacatgctaattttttaattcaacaagaaacaataactatataacaatattcaagatatattaaaaagttagcataagagggtttttcacccgacttgtataaaacaacatcattctcactttccttataattgaaaaaagatttttttttccatccaaaaaggttacttggaaaacttattatcattgaaaacaatgaattatttcaccaaagtttttgcttttttcaagtgatggaaagtttaaattaaacaacttttttttgttttgtttgtttaagacttaacgaacttaataaaaaatacctaatctattaagtcaatcaaacatatttgtttcttgacttataaaataaaaaataactatattaacttaaccacaccgacattatatattcaatcggtcactttatccattaattacttaatgaataaataaacaaacgggtcttagataactgtttataaatacggttaggttaagataaagaagttaaaatttcaaaattgtttgacgtgtacgtacattatttatttaaaaaaactttcatttttaattaggtacataatttagagttgaataataactatttttgatattttgatggtgatgcgtggtgacagcggtagtggtgtggttattaatgtaaaggtagttaatataaaagaggatagtgcagttatttttaagatatgaaaaatgtgtgttgtaaataaatttattaaggtatttataaatatataagaaaagatatttaaattaacgaataaggtaagttgaatattttaaaagtttaaatattaaacaagagattgatcaatggagtacaacagatgtgcatatttgttcatcacaccatcagcatggacatttcatataaaggacaagatttttctaaagggataagtatcctgcaatgtaataaactttggatgaatgtctataatagaaaataactaaagttgtgtgtnnnnnnngtaaacaactttaaaaaatgttttttgtatgtaagaatacatacgtggcaaccatatagaggtgtcacttgtctgattttaattggttgaatatattttcttacatacaatannnnnnnnnnnnnnnnnnnnnnnnnnnnnnnnacacaactttagttattttctactacagacattcgtttaaagtttgttacattccaagatacttatcccttttctaaattaatgattaattattgggataagtatcttgtaatgtaacaactttaaacgaatgtctatagtannnnnnnnnnnnnnnnnnnnnnnnnnnnnnnnnnnnnnnnnnnnnnnnnnnnnnnnnnnnnnnnnnnnnnnnnnnnnnnnaattaaaatcagacaagtgacacct

SEQ ID NO: 749 - DNA, 5369 bp, Cyperus esculentus
aaattaataatggggaaaaaaagaatcaagcacagccccaatgattgatcaggaatggatggatcagtgcagtaacctccattgcatttgtgcttcatccaaaagttgcatgaaaacttatatttttcagtgaatattcctgagcaagatgatatcaaaatggaatgcatattccaaaatgattaataaatctctcaatgcctcaattaaaaacaaaaccattgttacccgaaaaaacaacaacaaacgttttcttttccaatacagtctttccaatttctatgatcagatgacccgattaaatttactttagggccaatagtgaaccagtctacgagacagattctcagaaaagatgtaacatgtattccaaatggctccaaagcagatcctgccatttgagaaacaatagaaggggagtggattcttgaagaatgaaattagcacgagagataaatgacattaccaactgaaccaaggcattacaaacaggactcttgaagacattacgaccaagttaaaacctttcctgaagtactaagctgcaatatacttatatacatactccagactaatctacaaggggaaaaaaaaaataccatgcacaaaactggcataaaagaaaatccaagtccgacaaccttgttgcttaatcttcttcaaagtacttttcttcagcatcatagtttgcttctctggtccagtgatcatctaacctctcatcattatcaattttcgagtaatccaaatactcggtgtcctcaccagagagaaatttgtgttgcataatttgagtaaactgctccatatgatcatgcagctcttcttctgaaatggtctgactggatgtgctaaattcagtcgattgttgtgctgcagggtcctcgacaggatgaacctgcatgttcccagtttttttttaaaaaaatatcacttaaaatataaataagcttatgcattgcatatcaaaattttgctgagtcgaatctggtcgaccaggtcatatgaagattaacaattcaagtcgaactgaattcataataactctactttcagtttcccaagagtactaaaaacaaccgctcttccatttgatttagaaaatcagtataaaccatcaatgtgattcaaaagaacacttagcaatatgaatgatatatgcatcttacggtctacaatggcacatatattttaagttatatcaggcataagtctaccctggtgaagcccaattgccagtcacagtgtgtgcatatgtttgtaaatgttctttttgtatttaaatagtgtacaggtgtatatcaatgtgaggttcattaagtgattgctaatgtgattatatatcagagagagtgagagacgaacatttgtatcctttgatttatcttcctgtatctcttcatcactctcttcttcttcctcctcttcttcctcttcttcctcttcctcttcttcctcttcctccttcctgataccaacccactccttcctgtcaactcctcgccttatctgctcccctctgatcttcccgaccaatactgcttcatcacaccgccgcaacagtgtctccgaccatttctcccctggccttgacatcatcctccccgtctggtcctgccacctgccaacatactcatggtgcaagtacggctccctttccctcattgcctcctccgaaaagtaatccccctccatgactagctgctccatgtaagccctgcgacggtttttcactgttgtggagcttacaagttggggattttcaggtcgacagagtcgtctcaggtgccattccacctcatactcagaacggagtggctcgaattggcgtagctcgtcaggagtgagcagtgagccatacctctctaaaaatcaatattaaagaaagggttctaagtttatgactttagtgccataaagaagcaacaacatcataatatttatcatcagagacaaagataactcgcacagatcttaatttttgtttccttttccaatttagtgcacacccaaatttttgattcaccaaattttcaatagaattataatcagatgcttgagctcaaaattgtgataatcaatcactgagcaagaaataaatccctcaatcaatctttaataccagactatattcaagcaaaacagtcacagtagcaaagatcccaaactccaaacaaattgagtaaataaaatttgcacatagcagggttagtaatagtactgagtagtagttacctagaaaaatggaggcgtcccgcgagaggaggtcaagcagagccgacttgcgcttggaaacatcctccggcgtctcctggcgaatggcgccggggaagtagagtccctccacggacgccaggcggtccgctattgcttccatcgctgatctctccatctccatcatcattccctccctctctctctcgcctgaacctccaagctcacgaagcccgtaactaactaacttaggcccaatttgatgatctatttatttgaatagaaccgatgcaagtcgtattgatcgtgactcgcgtacaagattacaagtggagccgaaaggtcagccagacagctgtaggtgcaccgggtctgtttatagttgccgctcacattggactgttcgagatccagagagttcctttctaccgcctctctccgcttccccgccggcggagagagcaaggaaagctcttgcacggcacttgtagttgtacccctttgcttaacttagctcaggtctctctctctctctctctctctatttctgtcttccttcttctccaagtaatccttttttggattgatttggatttagggacttgtagctaacaaatctctgactgcgtttgtgtttttctaatcgagacagttcaatcaatgtatgaatttagttttgtacaatcttgttattctaatggatagctctactgctcaactgaaagttgcttttttcctttttcttttctgattttgaaggaattcagataccggtaaattgccagttgcctgacatggatgtgcttcggtgcggaccgacaacgagcggtcagttgcgggtgtcttcccgtgtaaagttcggtaattttaggtcacgccgcagttttgtttgctgttcgagaccatcgccggtgtttccaagtatttccatttctcaccaagaaagaagacccctagtttcaagtggtatgtatgtatttatcaatatcttcatattctaaaagaaaattcaacgtttggttgttgttaatcaatattgatgattagagttaagtatttatgtaccattgttcttgtcgctagaaatatctcaaaagattatccccaattagttaccagatcaatgaacgctttggttgagaaaagaaaattgatgtggttcttattcaaatattctggtatagttgataaagtatgtctattttcaggtggttcagctaatctctatggcaatacacctgttttgctgagtaaaaagggtaccagcaataccagaaacccggtagtatgtgcaggatttaagtcgtatgttcacccaaaactaacgtcgaagccaagatggtggtggcggaccatagctgctgtgccgtatctgttacctctccacaatgtatggcagtatgccattgctgtgtaccaccttcacccagttttagaaaacttcgagttcttggcaaacccatttctcgacaccatgggtctaatgcctagctgggtgatcataaccttgttcatggggacatacttccttgtggttcgaaggaaggagtggccccactttttaaggtttcatgtggtgatggcgctattgatggacactgggtttcaggctctggcaactgctttaaactggctgccccgaatcgcgtataaaggccccttcatggcatatttttggacggcctttgcgttttcgcaagcgtacacagtgttcgagtgcatgaggtgcgcgctcactgggacttatcatgatgtaccattttggtcagatgctgcttacattcatacagatccgaagttgttgaatttttaagtctggtatcagaaatgtgtgtgcaagggaaatagtagttgcgtacacttgcctgatccttatactggtactttctttgttgcttagatgtagttagttttgaagtaatcttatatcagttcatggatatactagtttcgtttttgctgtgttcttggaattttatctcattgtttgtgtgatctcgaagctagaataaaaattcatatgggaaataggatatgtttatatttgctgtattgttagtttactgctcaaaatcttagctaataatttattgacttgatttggctgcctctagcactgaactactagtgcagctaatcaagtttgcaagtattttcaggctggctactatttaattatgatgaattctatggatcaaaagaaatatggatcgttaatttgttaattttttgaattggatggtcatgatatatttgttgggcataattaaggagaggtgtttgatatgtaaaagaaaatgaacagcttgatgaaaaatacatagttgacaagaacagaacccctctttaatataatatttgtcataaagtaaaagtaatttgtttgtttaatgtggcttaaataaataaaagaaaaaaagcaagacctagcccaaccaggattggcctttctttcttcttcccgatgctcctatgcagcctgaatgcctgatcatcgaaccatagccgagtcgacagaggcaaacccaagcccaagcccaagcccaagcccatgcccatgcccatgcccatgcccatacaacaacaactcagatttccaatgggcttgatcaattaatatttgggcctgccgacttacttgcttacttactcccagctcctcatacaaactgaaacctctctgcgggttcgccatctcgccctccctccctccgctattattattacctccgtcgatagctaaacggagttcttcgctcgctcctcgtcggcccctgctcttctccgcctcagcagccggcaccgggaagtcacctccgacccgccgcggcttcagtttctgtcagcaggtagctcggcttccccccttttccggttcaaccctcagtttcaattgccttttactttaagagaatgcagttgtgcatcttactgtatgctgatttgatacaaggagatgaattgatgataattttgcactcactgtatgtccgtatcgaattttagtttttatttaagtatacagtggaacagttagtcaatgactgattgtttatttgttttagaatacagtaaattcggtatgcgattatgtatctgagtatctgactgcatcaaatttatgaatattcagttgcaattgtttcattctgtta

SEQ ID NO: 750 - DNA, 472 bp, Digitaria sanguinalis
ttcatctctctgcagcatcatctttactctatgggcatttaggtctatttacacacaaaacaccacccacatcatctcaaagacgtgtatctccaagagcatcaaaggatggtggtgcatttagttacagataccccccaatggagaaaaaaccgcgatggtattggagaactttagcatgcttaccctacctaatgccgcttcatgaaacatggatgtatgcaaaaaccgcctatcaccttcaccctttcttggaaagtttcgagttcctcacgtacccttttctaaaagctctggggggtttgccgagctggtttttaatcgcctacttcataattgcttacctggcagttgttagaagaaaagagtggccccacttttttagatttcatgtggtgtcagggatgctactggaaattgctctgcaggtgacgggaactgtgtggcgttggcttccgggagccttgtattg

SEQ ID NO: 751 - DNA, 553 bp, Echinochloa colona
gtctaaagagcacccagtttcatgttaagaggaatcatttttgtgcaagagctctacgagttggtacagattctgtccatcatggcatgcctacatcattcccaatggagaattctttcaagggcattccatcactatcagtacagcgcaatcagcatccaaggtccgttagttgtcaagcatcctcactggcatcattcagctaccccgagctgacttccaaacccagatggtggtggagaactcttgcttgtgtgccatacttgctgccactccacaacatgtggtcttacgccgacgtgatctaccagctgcacacttacttgcaggggttttcactgctgtataccttcatcgataccatgacactgtgtcctgggtggctctttctggtgatttttatgacggtatacttctttgttgtgaggcgaaagtggtcaccgcactttctgaggttccatgtgatactggctatcctcctggatactggctcccaagcagtggccaccatgtgtacctggatgccaagcatcgtgtaccaggggaaaccgat

SEQ ID NO: 752 - DNA, 492 bp, Echinochloa crus-galli
cctgggtggctctttctggtgatttttatgacggtgtacttcttcgttgtgaggcgaaagtggtcaccgcactttctgaggttccatgtgatactggctatcctcctggatactggctcccaagcagtggccaccatgtgtacctggatgccaagcatcgtgtatcaagggaaaccgatgcagtacttctggatgtctatggcgttcatacagatcttcacggtgctcgagtgtatgcggtgtgctctttgtggaatgtacccgaatgtcccgttcatctcccacactgcgtttattcactctgatctgaatctgttcagataggtgctttactattatagatccaggatatgagaaggttgttttttttttggaaatagctacttgcctacttatagttctagagacagttttgttcatattgaagggtcttgtgtaattcttatcataaactggtacaacataattcgaacaccactgcaatcgatcccc

SEQ ID NO: 753 - DNA, 1031 bp, Euphorbia heterophylla
gacgagaaggctagggttccttatctctcccaaaatcccaatcctctcatcttcttcgccggatgtcagctactattttgattcattcctaatcccaggcaactggcaatgattcttaatggctacacatggcctattggtggtcaatgtgcctttccaagtaccaaaccatctacacccaggttgtataccctggtcccttcttgcatttcacgcttgaccatcgaagctgcaggttcatctattccttctcaacatttgaagtctagattttgcacatccagaggtttatcctccggatcaaccccactcttgactggagatttaggcacaatttggcacacccttccatcattacataggcaacgaaaacgcaatttcatccctcgggcagaaaaagatgtaccatcgagtttccgattccctcccatgaccaggaaaccaagatggtggtggagaattctagcatgtctcccttatctaatgcctgttcacgaggcttggatgtacgctgaaacagcatatagtctacacccattccttgaagaacttgaatttgcgacatacccatttctccgagccttagggcgattgccgccgtggtttctaattgcctacttttttgtagcgtatcttggagtagtgaggaggaaagagtggccccattttttacggttccatgtggtgttgggcatgttgttggagattggttttcaagtggtaggggtgtcgagtaaatgggtgcctcgcgggatctattggggtaagttgggtatgcatttttggactgccctttcgtttggttttctttttacggttttggaatgcattaggtgtgctcttgctggtatgtatgctgatgttccttttgcttccgaggctgcttatattcaaatcccatatgactaatggatggagattaaactaggctagaataaatgtatgttgtatttctattttgtgtttgttttttttttgaaaccatacttttgagcataaatgaatggatatttagattggctttgtaaaaa

SEQ ID NO: 754 - DNA, 2815 bp, Euphorbia heterophylla
ttactcctccaatctagttttaattgattttttagctccattttagttctttttttagttattaatttatattactccctccatctagtctttattgcccttatattaaatatgagagaaattgtctacgaatgtaaatataagtaggcaattaataagaaagataatattaatattaaagtatgaaggataaattagccattttaataacgtgataaatgttttattagcattgatgattcgattaaatggacaaaaaatagatgaatggaataacattaatatttaacgttttattgttaataataaaaagtaataataataatataatgaataaactgaaatttaatattaaatgctgaatattgatgaataatagtaaataataaatattgaatactgaatactaaaattgaattgaattgaacaaaataatactgaactgaattaaatgtaatactaaattgattgttactaaattgaacaaaacgaaacagataagttgataagaacagcggctaagtttaatattagtgcaattcaagcatctattcaaatttaaacgtcaagacaaatctctaaaagtaaaatcattgaagaagtagagagcccaagtccaatatacaaaaagccccattctaggaaaggacgagaaggctagggttccttatctctcccaaaatcccaatcctctcatcttcttcgccggatgtcagctactattttgattcattcctaatcccaggtaatgctccatttcttatcttcgatttcttcttttgctttccccgctctcttttgtttcatttataacttcaattctgtcgatcactttcaacttttgctatgtatatttctatttatgtctctaattttgatttcaatttcatgattttcgttccgcgaaatcttatgggaacctgaaattggaagaaattcaattgaattttgtgtattatactagttgaattgtactaaattccttccgctttagtggttagtggttaaatggaatctcggtttccaaacattcttggagacctggtttttttcgccttcgtctttgaagagtaaagctggatacgttgtttaccttcattttcactgtttttatgctcacataaagttatgtattaccagcactttctaataatggccatggatttgtgtcattggcattctctttattgctacgaccattttttcagtgatttatattgatcaagaaaaaatgagagattttcatctttaatttctcaagctacatttcattttgaaacaggcaactggcaatgattcttaatggctacacatggcctattggtggtcaatgtgcctttccaagtaccaaaccatctacacccaggttgtataccctggtcccttcttgcatttcacgcttgaccatcgaagctgcaggttcatctattccttctcaacatttgaagtctagattttgcacatccagaggtatatattctaaacgtatttggtaccatacgtaatacaagtgattttatagtggacttatttgccttttggggtcgtgttctctagttcaaattcccttttggtgtctggctatttgatgcctgatgtattcaattttgtctatttggtcatccagttttaatattataagggattattgagagctggtaattttatgcatagtcagcaaaacatatctattctccaaatgtcaaaatgagaatttcacataatctgtggtgtcagatggatgctatgtactaaaattaaatagttcatgtaccaaatagtcaaatattgtccacgtcagataccgaataggcgaaaagcgattaggttaggcaccaaacaaacaatttcagtaggttaaacaccaaaagggcatttgagttatagaaaatgacccgaaaaaggtatttaagtcttcaatagtgcttgtaatgtgtgcctagaatcacctgacatttgttcaatgcaggtttatcctccggatcaaccccactcttgactggagatttaggcacaatttggcacacccttccatcattacataggcaacgaaaacgcaatttcatccctcgggcagaaaaagatgtaccatcgagtttccgattccctcccatgaccaggaaaccaagatggtggtggagaattctagcatgtctcccttatctaatgcctgttcacgaggcttggatgtacgctgaaacagcatatagtctacacccattccttgaagaacttgaatttgcgacatacccatttctccgagccttagggcgattgccgccgtggtttctaattgcctacttttttgtagcgtatcttggagtagtgaggaggaaagagtggccccattttttacggttccatgtggtgttgggcatgttgttggagattggttttcaagtggtaggggtgtcgagtaaatgggtgcctcgcgggatctattggggtaagttgggtatgcatttttggactgccctttcgtttggttttctttttacggttttggaatgcattaggtgtgctcttgctggtatgtatgctgatgttccttttgcttccgaggctgcttatattcaaatcccatatgactaatggatggagattaaactaggctagaataaatgtatgttgtatttctattttgtgtttgttttttttttgaaaccatacttttgagcataaatgaatggatatttagattggctttgtaatttttttttatcttggggatgatcaataatatgtttaataccttaatttgacatttttacaatcttgatatatgctattggcctaatgcatgaaaatcaccttg

SEQ ID NO: 755 - DNA, 1256 bp, Festuca arundinacea
aagttcttatgatatttctggcagacgaaggattgtatgatcctgtaagctcactggattagatgttattgatagagtatgtcaggccatatctttattgttatgttatttcctaatatccaatgtgctccatagtccctgtgttgatgtttctctatagatgaggagagttatcaaaaacattagacttgaaagcaagaaaagtgtctagcttagtacagttatattatacaatttagtgaagaaaattctacataatacatgccttgacaatatctaggttgctggtcatgtcatgtcgattgtcattatatcatgaaactataagcggaatatttcatattaactttgttgtaatgagtatttctgaaattgaagttgtagttcaagtatacaaatgttagttactgtgaatgcaacttccaaacaatagaatatttgcgctttcctgaacagtaccacctccgatccgttttaatcaacgccggcaccacgctacgtacatgcatgcagtgaagtaactccgcgtcggttaaatgcgaacggaggtagtacatgatatgtgctaatgttacttgtcactttattaatttatgaaactgaattatatcaagccataatagatattatgccaaaatggttttggatagttggaacttgatttgggctttaatatgttaccttacaaggcatttcttactttcagcatgtgttgatatttccgctcgtgccgtatcttcgtccttcctgaagtatgattctgtaaagggtgccaatcccatcaagccattgccatcagtccgcagcttgcacccaggaactcaatttcgctgtcaagcatctttatcatcattcagctaccctgagttaacttctaaaccaaaatggtggtggaggaccctggcatgtgtaccttatcttctgccactgcacaacatgtggtcgcacgcagatgctgtgtaccagcttcatccatacttgcaacagtttagtctgttttatgccttcattgacacaatggcactagtccctggatggctctttctgatgatcttcatgactgtctacttctttgtggtgcgacggaagtggtctccacactttctgaggtatcacatcatattggctattcttctcgacactggctctcaagctttggcgaccatgtgcaactggaatccgagcattgtttttcagggtaaaccaatggcatatttctggatgacactggccttcattcagatcttcacggtcct

SEQ ID NO: 756 - DNA, 241 bp, Festuca arundinacea
accaggggaagccgatgcagtatttctggatgtccattgctttcattcagatcttcacggtgctcgagtgcatgcggtgtgctctttctgggatgtacccgaatgtgcctttcatatcccacacggcgtttatccattctgatctgaatctcttcaggtagccaactgctcaccatatcaggtttttgatatcagaaggatggaaaaggagacggaggtgcaaatagggtagtatttctgg

SEQ ID NO: 757 - DNA, 1103 bp, Ipomoea hederacea
tctctctctctctcgctctgcactttggtattatgtctttcaacaaatactagatcttcatccaagggcttgaatatgaatgccaatggatgctttctgacttctgggggtgtttattcaccctttgaggctaattccaagtcctgcaattcaacatctgcgcggctttctctactgcctttcagggcagccttctcatcaattaggagctcatatgcacctcatcacaatcttacttcttgcttctccaaaggaactaggtttctgagtctttcgtctgcatcgtcacctgttatatgtggggaatatcgtggtttcttagatgctctgcccaaattaccaaggcgaagtagattttctctctccccaagagcatccaaggatgtccctaaaagttttcgatacccagccatgactaaaaagccaagatggtggtggagaaccatagcatgcctcccttattttatgcccttccatgagacatggatgtatgctgagactgcataccatctccaccaccagttggaggcgtttgaattcttgacctatccttttctgcaatctctagggaggttacccagttggtttctcatggcatatttcttcattgcttaccttggaattgtgaggagaaaggaatggccccatttcttacggttccatgtggtgatgggtatgctcttggagatctccctacaagttatcggaaccataagccgttggatgccactgtcggtatattggggcaagattggaatgcatttctggaccgctgttgcatttggttatctctttacggtcacgcagtgcatcgggtgtgcacttactgggatgtatgctgatgttccctttctctgtgatgcagcttatattcagattccttatgattaattagcaaaatgagctgttgtactagtatcgaaccaggcaatgtttttgcttattttgtgtagatgcttcgggctttctactgtaaaatttacaattctaggcattattaaagtgtccattagggagagattgtgactccagagttcaaatgtactttggatttgagatgatttcatttttctgcagtgctgtaattttcttactttattttc

SEQ ID NO: 758 - DNA, 4777 bp, Kochia scoparia
atagtaatcccctgcaatcatgttatttttccgtgttattgcacggctaaaatgtattccgcactacgaagtataaaataaaataacgagaaaaaaataaataaattcagataaatatcaataagactaagacatacgtggattagtagctaaatcgcacttgcacttatccttgattattgttttccccttaaacatatcaaattatgaatctttgaagttgaatcctatccccaaaacacaacaatttcaccaccatgtttgttggggttctctaaaccctaactcctgctactctcactcatcttcttcttccttcttttctctcttcttcttcttcttctcactctcactggtatgctttctctctctttcttgtaaccaataattatttcatcgctgctacttaattcaagctcccatttttttcctcctttttatttgcatttctatctgtaatttactgtaacttgcgatatgaactcgtagtatgctggtataccattgattttctttttatgggatgtttctttagattaagacttcttatgtcgtaattcattcacaaaatgctggaaatttcattagtgagttgcatttgctgattattggggttcagaattcggacattttgtgaatttagctgttagttttgtttatcattgggctcaaaatttgtgcaattttatttcatattcatgttgaagatagattaatggtggataagtagatagttgattttagtgactagaatggttttttgctattatgtacgaaatcttgttatgcacctaggtgcaccctgaactaggtgctgggtgctccgattgagcaataatttggcctgatataactatataagtagaagtgtcgaacaatcgaattagccttaggcgcacttggagatacagtggatgcaatcagagctatagtttttctgtatatgcaagtatttgcaatgcaatcccctcttcaattgtcattgttgtaattacatgttacttttcttggcaagtgattgagtgtctgaataagcttggtgctagtcaaatttcgtcaaacatttggcatcttcaatcacttttgggactaaggctttgactttgattgattcatgtagtcgactacacttataagactttgattgattgattcttttgacatttccaattatctttgtgtttatttagtgtgtcctttactatgctgccattgagtttgatgaattttgtcaagcagaatgcttgattaataagggcctgtcttctctagtttgacgcgctgattgtgtttccatgtgtaactgtgatgatttgttcttcctctatttttgtttgctggttagggttatagacttatagtggcaatagaaaccaagatgaaagagtgtatttgtggcattgtgtaagaaaagttagcgaaagattattatatgcggggtaaaaaggagtattgaaaaaatatgtttgccaacaattaagtaaaaatgtgaccgataagaaggaatgggaagatgagggttgaggaaactaggaaaatgtatccaacaaaaagcacagagggggtattctgtagagttctcaaaaagggaaaccttgaatgctgaaagagtggaacactggaaataatccaaaatggtgctacaatggtaaaagcttctgtaaatactgtttttcattccataatcatgtgactaacaattaatatgtcattcatattgtagtgactttgtcattgtataatgatatctgaaaccatagacaaatcaaagttcttcataagtgcctgttttcttatatgctgattcgaaatttagtacttaattctcttaatataggttagagaatgatcataaatggatgcactatgaattccagagcatataagcctctgtcttgtaatgcttcatggacaaagcccgttcctttgcctgcaaagcctgcactatccaatatcatagctcttttccgaccaagcgaggggctgaaattgcgttgtgcaacaggtatgcatttaaattattgattcctgggtttttccctcgttaaaatgtttctggtttgacattaagttagtaaattgtgtagtcaaatagactatacaatgatgagaaacaatcagttgttaaccatatttgccggctgttttcttcttactagtagtagatctcttttttccatctgttttttgctgatggttatctcttactcatccaaaaattacaggggtttcatcatcttttcacctttctgcttcatcaactccgcttttgggaggagaatatggtggtttgtcacacaccatccctcttctacctaaaaggaaaggatgctgtttggcacctcgagcagcgaaggatgtgcctactagtttccgcttccctccgatgacaaagaagcctcaatggtggtggagaactctggcttgccttccgtatctgatgcctctgcatgagacttggatgtatgcagaaacagctttcaatcttcatccattccttgaggactttgagtttttgacttaccctttcctcagatctattgggaagctaccaccttggttttttatggcttatttctttgttgcatatcttgggatcgtgaggagaaaggaatggccccactttttcaggtttcatgttgtgacgggaatgttgcttgagattgccttgcaagtaattggtactgtgagccgttggatgcctctggcagtatactggggcaagtttggcatgcacttttggacagctgtggcgtttggttacctgttcacagtgttggagagtataagatgtgctcttgctggaatgtatgcagacgttccttttgtatgcgacgctgcttacatccagattccatatgattaagttagataaaatgtctgtaaatgaagtgttactgtttacatacgcggaacatatttgagcagcttgtttagagagaaaaacttcgtgattggagtaaacacccatctttttaggtgcaatttttgtaacttaatgttcccctggtgtcacttttattcttaaagtgttgaaaggttgtattgttctaccaagatagggtcctatggtgtagtttagttgttgcctgaaattattttttgcatcattcactgttggatttgaacatagtgctacatgatgaggatcaacattccctacattttgcatctatgagttgaaatgttgaagttctcaagctcaaaagagaaatcgcggaaaaatttagggataaaagataaatcgtctcgaggtgtgaagaggaggaaggatggttagacaaatcaaggagagtagcggaaactgtggtgtttattgttttttcaaaagaaaatgagttttcttttccatcgaaaaattattcacctttaacaaaatgattttccctcatttagtaaagtaaaataatatggaaaaactttttcccaaaaatattgttactattgcaacaatattttaaaaataagggtttttccctcatcatgttttacgaattttatttgatagccatcaatttttataaagtagagatgatcatccttagtctaactagcggggctcgcaaaattgtgacaatttgaaatactaaaaaaatacgcattattataacgggtttggtaaaggtccatgaaacttgatccggattagctcgcactagcctgcaaaacacgcattattataacgggtttggtaaaggtccatgaaacgggtcggatagtccatgcaacccaaaccaaattctgatccctgaaaaaaaccagtagtaatagtagaagtggaagtgtgctctgctctctcactttctcaaaccttccgcaacactctcatttcacttccttcttcatcttcttcaatctggatttctagggtttcgaaaaatcaattgactgattgatcgatctgtgaaacaatggcgttagccttcgatgagtacggaaggccattcataatcctgcgagagcaggagtccaaaacccggttacgaggaatcgacgctcagaaatccaacatttctgctggaagagccgtcgctcgtattctccgttcgtcgcttggtcctaaaggcatggacaagatgctccagtctcctgacggcgacatcactatcagttacttcctctctctctctctcttcgttttttgttttgttttgcaagttagggtttttgattgagttcagatttgtgtgttagggttttggttaggatcaattgacattttgtgcctggttagtttgaaggagtggttaattagggttagggaatgcaattaattaggaaatggcgattgaattcagattcaagtgttagggttttggctttgttactaagtttagatcgactgtttgatctgtttttggtggtgttgtgattcaatggagcttacttattatcgtttcggattttttatagtgatttttgggttttggagaaggagggtttaactagggtttagaaatgctgtacggtttggatttggttgagagatgtcctaattttggggtctaagagctaaggttgattgcgctaattcggaaatttgggttaattttttaatcataagcatcaaagtaaggtttggaggtgtgagtttcttttgtgaaatgggtttctttataatcatctatttcttcgtgctccatttctgaggtttcctagaggtatgagctagggttttgaactgccctccaggattgagtttttaagtgagaggagaaatgaaatctagcctgtaagatgttcatttatgaaacatatgagttatatattgatgtgt

SEQ ID NO: 759 - DNA, 782 bp, Lolium arundinaceum
aaatgtatttcaccgtagttataacatatatcttgcagccagcactgattttcttcgccatgacatgctgacatcattttcgaaggagggttctattaagggcattccatcattattgacccggcacaatcagcgtcaaagatctgaagttggttgtcgagcttcctctctagcatcattcagctatcctgagttgacttccaaaccaagatggtggtggagaactctagcatgtgtgccatatttgcttccacttcacaacatgtggtcgtatgccgatgtcatctaccagttgcacacgtacctgcagggattttcattggtttacaccttcatcgataccatgacactgcttccagggtggctcttgctggtgatattcatgacagtgtacttcttcgttgtgaggcggaagtggtcaccccacttcatgaggttccatgtgatcttggctatcctcctggacaccggctctcaagcagtggcaacaatgtgcacctggatgcccagcatcgtgtaccaggggaagccgatgcagtatttctggatgtccattgctttcattcagatcttcacggtgctcgagtgcatgcggtgtgctctttctgggatgtacccgaatgttcctttcatatcccacacggcgtttatccattctgatctgaatctcttcaggtagccaactgctcaccatatcaggtttttgatatcggaaggatggaaaaggagacggaggtgcaaatagggtagtatttctggcaatagctacttacatttctaga

SEQ ID NO: 760 - DNA, 552 bp, Lolium multiflorum
cctctcacgcgcgtcgcttcgccgtcaccgctcccgttgtacctcgtcgcgtccctgccgtctcaaccccatccgcgatttcctccatcggttctgcgattgtgtccaaggttctgcttcgcacacgatgctgtcctgtcaaggagtagctactggggctgcaaattctcagctattcggtttccctgccgcgagccgctatggttatccttcaagatcatcagttcgttctaaaccaggctttctgaaactgcagccgcctgcacttcatgacaagaaaatcctccctttgagagcatgtgttgatatttccgctcgtgctgtatcttcgtccttcctaaagtatgattctgtaaagggcaccaatcccatcaagccattgacatcaagccgcaacttgcacccaggaactcaatttcgctgtcaagcatctttatcgtcattcagctaccctgagttaacttctaaaccaaaatggtggtggaggaccctggcatgtgtaccttatcttctgccactgcacaacatgtggtcgcacgcagatgctgtgta

SEQ ID NO: 761 - DNA, 275 bp, Lolium multiflorum
agtctaggataggctaatcgattttttttattcacgcagattgtgtccaaggttctgcttcgcacacgatgctgtcctgtcaaggagtagctaccggggctgcaaattctcagctattcggtttccctgccgcgagacgcaatggttatccttcaaggtcatcagttcgctctaaaccaggctttctgaaactgcagccgcctccacttcatgacaagaaaatcctccctctgagaggtactgaattcgttcttacatgtactttactcaagcat

SEQ ID NO: 762 - DNA, 218 bp, Lolium multiflorum
gttacttgttactttattaatttgcgaaactgaattatatcaagctataatccgtattatgccaaaatgttcttggatagttggtactcaatttaagctttaatatgtgaccttacaatgcatttcttactttcagcatgtgttgatatttccgctcgtgccgtatcttcgtccttcctaaagtatgattctgtaaagggcaccagtcccatcaagcc

SEQ ID NO: 763 - DNA, 1716 bp, Lolium rigidum
ggtcgtaagtctttttgcttgggaggaccagttttttgttgacagtttactgtataaaagaaagctcatggtcgagccaatgtcatgaagtaaacatgtaagatgattcttttactcatgatgtcattttgtatacttgacttatccagaggcttcataaatcagtctaatataaaccataacgaacttatcataatcaaagagagcttatattgtacttcgatattggaactgagacctacacgtatagtacatgtcagtttgtgtcttgtttgttagataattttctttacattttatttcattaccttgttatattctgatgcttaaatccgttctttggttctgaacacttagttcttaaaatgtatttcaccgtagttataacatatatcttgcagcaagcactgattttcttcgccatgacatgctgacatcattttcgaaggagggttctattaagggcattccatcattattgacccggcacaatcagcgtcaaagatctgaagttggttgtcgagcttcctctctagcatcattcagctatcctgagctgacttccaaaccaagatggtggtggagaactctagcatgtgtgccatatttgcttccacttcacaaccagtggtcctatgccgatgtcatctaccagttgcacacgtacctgcaggggttttcattggtatacaccttcatcgataccatgacactgcttccagggtggctcttgctggtgatattcatgacagtgtacttcttcgttgtgaggcggaagtggtcaccccacttcatgaggttccatgtgatcttggctatcctcctggacaccggctctcaagcagtggcaacaatgtgcacctggatgcccagcatcgtgtaccaggggaagccgatgcagtatttttggatgtccattgctttcattcagatcttcacggtgctcgagtgcatgcggtgtgctctttctgggatgtacccgaatgtgcctttcatatcccacacggcgtttatccattctgatctgaatctcttcaggtagccaactgctcaccatatcaggtttttgatatcagaaggatggaaaaggagacggaggtgcaaatagggtagtatttctggcaatagctacttacatttctagactgttttgtttatattcttttttaaattatcatgtgtaagtgccaccagccctagctgggacctattctgttatggcaaaacctgaacagtgacgctactgattattgcatctgttgaattgcttcagtggtgtagttatctgcagtttttattttttagaaacgtgtaaactggaatacatgtttcctcatgtgctttgagttaaccttttagtcaagggaatgcatagcagtgtgggcgtgagtgcgggtcttgacacctgtcgtccagccacattctgaacatggctcaagtgagagagtctgaacataagaaataacatctgtctctgccaattcctgttatatttcccgtctccagtgtccgaatgttgattttctgtggcattaataaatggagaatcaccagttatctctaccattatattagacgtgttcagtatttgtgtataactgatcaatacaagcgatgccacatgtctctacccctgtacattgttttaaggctcagaagggtatcacggttaagtgttagcacctcaaataatatactctcccgattcaaattaat

SEQ ID NO: 764 - DNA, 3223 bp, Portulaca oleracea
tttgtttgctaggaattcgaaattcgtttgatgttttatggataaagattttgcatcgacagaggaaagctgatattattaatttcttcgttggcttgtaaagttacgtgagatgaatttagagttttaaatttaggagagaatttgaagagttttgtttcatgtctgttttagcattgtatttcggatggttgatgtggatttagaatttatgttgaaagattgagtgtttgagaagtgaactttgattttgaactgtgattacgaattttcgtctatttcttgtgctttgtttgattaatttcagaatgtatcgttggtatggtgtaattctactactgtaatcattcttccaccttcaccacgaggaatgtcatctttaagctctttgcttggttgcagtttcatcgattgagctgaaatttgataagtggttctagggtgaaaacagtgggttgttttagtttaaaatttgctgaaacgtggaatgttcatgacaaaagtacgaatttaaggatgaggtttggagggcacactgctgtttgtgcattccattattcgtgttgatagcaacgggttcatttatatcactatagattgattggggcttcgacaaggctttcttggatgtgggatgccattatctttttcccaaatccttacctttcagaactaacttgttcaggtgtgagcaatgattgtaaatggattcactatgaacaccagatcgtataagcctctgtcttgtcatgttcaacgcccatgcttgcctcgcttctcagcaaaagcagcattgccaaatgtcagagctttctttacgccaaatgaggagctgaagctccataaacatgttggtaagcaattctattcttccgcctaattttctgatcctatgttacataaatgttggtttggcatttgataatctttgtataagcttgtaggtgagtagtctataaatggtagattagatgcttttcccaactttcctacatgtaagtgagtgtttcatgaaggcttaacaatgtctttgcgttatcacgagattgtttgggggggaggggggaattggaaattttccatacttgcggttcttgattttgttgtatgccgtattgctactttcagcttctgacatatagtaaatgacagtaatttcctcgtatctttctgctggatcaactcccctattaagcggtgaacatggtgggttgtcatacaccattcccctactacccaaggggagaaaactcagcatggctcctcgagcatccaaagatgttccttacagtttccgcttccctcccatgacaaaaaaaccccggtggtggtggagaaccctggcatgcatcccctacctgatgcccctccatgaaacatggatgtatgcggaaacagcctatcatctccacccctttctagaagaccttgagttcttgacatacccttttctcggggcaatcggaagtcttcccagttggttcttcatggcctacttctttgtggcttaccttggcattgtgagaagaaaggagtggccccacttcttcaggtttcatgtcgtcatggggatgcttcttgagattgcactgcaggtgattggtactgtcagccgttggatgcctcttgccgtgtactggggaaaggttgggatgcacttctggacagccgtggcatttggctacctgtttactgtgctcgagtgtatcagatgtgcccttgctggaatgtatgctgatgttccatttgtgtctgatgctgcttacattcaaattccttatgattaatacgagattgagatagatgtttttcaggttgaatttgtcctagggttgctactgtaggttgtgtttttgaagctgtatggattttgtgcataatctgctgcctggttttatgtattaattacagacacaagtatttgtattttgaactgattatgcaatgggtttagtgaagagttcatagtataactgtataaagggtgagttcttggaaaaaattgctactaaacttttcaaattattcaaaaatatcaccaagtttgaaaaagtgtaaaaaatgtcactgtaatttccattttgttaaaaaaatgccatctaatacgaaggtaacttacaactgccggttaaaaggggaaaagttgaagagttcaatttttaaaattaaaattgatgaagcttctcttgtacacttccccttcaattttcagtaaattttccccaaatcctaaaataaaacactaccccctcaagttatttttcccctgcacctcatctttatcttctttttcttcttgatcgactgttcatcttcttcttctccctgccagccatcttcctcgtcctcttctcttcttctcatttgatcactgtacttcaactgtcacttcaccactgtctccttcagtccctgcaacttcctccgaccaccacactcttcgtaacctccccaaccatgacctcacacagttggaaattttagggttagggtttttgaataacttctgtatcttgtttcagaactccagaggataggaagatggaaggagttgagaatggagggaaggaaacaatagggagatgggtattagttttttaaagttttaatttttttaatttttcatttatttttcattttttttatcagttaaccgactctacctacaactcccagtcataatgacattttttaacaaaatggaaactacagtgacatttttgacactttttcaaacttggtgacatttttgaataatttggaaagtttattgacttttttttcatgaactcgtcgtataaagggcctatccctacatacctgaggattcttgctacacaaccttcaattatgaccctgttctttagttgggttaaacctaactaatctaacctaattttaacttaacttatccttacctaatttaacctaatccaacttcctaaaaaacaccaaaccaaaaataactttttaaataaaaaagaaatttaaataatattattttaatctcaaatcaatccattttttctaagggcgttgatatatgtcgctccccattttactaatgtcgccccctcaaaagacatatttgcccctttcctctccctctcctctccctcatcctctcaaattctctctaatctaaaccctctctttaatcactaaaatttgtattggtttgacagggccacaagcgcacggtgtacgtagtagcacgtcaagg

SEQ ID NO: 765 - DNA, 1265 bp, Senna obtusifolia
tttagtttctcattctgtgcctctaggggactctatcatctctactctctctacgagagccccaaactccatcgtccgccggctcgtctagccgccgtctagcgtaccagcaaggaggtgaagggccaatttgagcattacacggatctcaagagtccatggcatcccaacactgatatttagtttctgaatccagtttgcagatctctcgtggctgaccatgattcgcaatggttgcattgggacccaatgctcatcgaggccttgcaggcccaccctaccttgtagacccgtgttctctttcagttctcaaatgccagctatggcttctgcctcaagcatccggaattcatggagggctaatatagaatgtaaatcctggttgccaaaaggaatgccattctcaaacatttctgctgcatcaagtccacatttaactgggggtcaaagtcttgcgtttcacacaatccccttgacacctaggcggcaagggtctcgtatggttcctcgagcatccaaggatgtcccgtatagtttccgtttcccaccaatgaccaaaaaaccaagatggtggtggaggaccttagcatgcctcccctacctcatgcctctccatgagacatggatgtatgctgagacagcataccatcttcattcctttttggagaacttagaattcatgacataccctttccttatggccattgggagtcttccaggctggttcctcatggcatacttttttgttgcatatcttggagttgtgaggagaaaagagtggccccacttcttccggttccacgtcgtgatgggaatgttattggagatttcccttcaggtgatcggaactgtgagccgttggatgcctctggcaatctactggggtaaactgggaatgcatttctggacagccgtagcgtttggttatttctttacggtgttggagtgtatacggtgtgctctttctggaatgtatgctgatattccttttgtctgtgatgctgcatatatccaaatcccatatgactaaggagcaagatataagaaaggttagccttctgggttttgtatttgttgtatcagatgttttgttgagcaaacaagtaaactgtatgagatttccctttatgcatgtacggattagtttagttgtatgcttgttgtgacctcttctgcttattcttattgcaatgacatttcagcctttgatcttgtttgcatgagaaaggcaagtttaaacattcaatggaagtgttaaacacaca

SEQ ID NO: 766 - DNA, 1532 bp, Sorghum halepense
atatgggtaagcatgcagaacatgggacaataacataacgggccattgaatgtccagaataggataactgaaatataactaaagaaatgctgttatgatttagtgcctgtagagttaccttggctaaaccggtcccgtgcttctccacaaggtggctagcgctagcaattcttttgtgtgtgtgtgtgtgtgctggcatattcatttcaccttatcattatatgttatttctagcaaatattttgtttcctaataagtgtcatgatatacttatagtcctgtattagatgctataatatctggtgttgctgatttcctgggctctacctgacagttcaattttgtgtttcatggaagaaaaaaaacttttgcagctttaggatctttattcctttgattacttgttgaggacccattttctgatataggtttgctgaaaaaaatatataatgtctagttggcagttggcacatgtgagacaatacaaagtaatagacaaaatacaatcatttgaacagggtatgaatttgaattgttcagagttccagccagagcatattatcaacaagatatgtaacatgatacggagtttgagtcttggtttagttatctccattgatacttttttttatgtttagaatgacatgggaaatgataccattttgcaagtggttctatactgatttctttaatggctggggatttatctatatgttccattgtcacattctttgattattgtccctagttactataatggatttcattttcatcattgtttgtgtttttcagttgtcactgattccattcatcatggaatgcctacatcattcccgagggaaaattctgtcaggggcatcccatcactctcaagacagcacaaccaacatccaaggtccgttagttgtcaggcatcctcactggcatctttcagttaccctgagctgacatccaaacccagatggtggtggagaactctagcttgtgtgccgtacttactgccactgcacaacatgtggtcttatgccgatgtgatctaccagcttcacacttacttgcaggggttttcgctgttgtacaccttcattgataccatgactctgtgtcctgggtggctctttctggtgatatttatgacagtgtacttcttcgttgtgaggcggaagtggtcgccgcactttctaaggttccatgtgatcctagcaatccttctggacactggctcccaagcagtggccaccatgtgtacctggatgccaagcatcgtttatcaggggaaggcaatgcagtacttctggatgtctatcgcgtttatacagatcttcacagtgctcgagtgtttgcggtgtgctctttgtggaatgtatcctgatgtcccattcatatcccacaccgctttcattcactctgatctgaatctgttcagataggtgcttactacataaattccaggattcagaaagggtggtttttttgaaatggctacttacagtcgtagagggtgtgttttttgttttgttcatatagaagtc

SEQ ID NO: 767 - DNA, 6857 bp, Spirodela polyrrhiza
gggagaggagagaggaggaggctcaaaggcctcgttctattctggttctccagagggcggggggagggcgggggatgccggtcggatagggttcttcccttcgcctctggggcaggggcgtctccccgagcggcgccatctcccgggtgaggaacggcgccccgccgtcttctctccctccggcgaccctcctcgattcttctcatttccctcgctgaaaagccgtcatcttcgtttgctatggctctttgatccttcggcctccccgctttgtggctcatctgtttctggtcattcatctgcatcatcccgcgtttcatgggtttttctctgggaaatcaccggtttatatattgattaggccctttcgagtgggattctctcgcgtttttttgcacgacccatgaagaggatcgtgaataatctgcgcgtttcttcgggattgctgtgagcttgtgtgtctggaataacgttcttcttgttttcatctcatccagcggttgttggtccgagatgatttcaagctcttttacagtggcttcgggcatggcgggggctttgaagcctgcggcttacaggccttcagctggtaaccctcgactcgcccgggttcctcctctgcctggtaggttggggctgccgaacatccggagcttcggtggagcttctctagaaaggcgagcatcgtcttcagcgggtacacattttcttccccttcacccatgcccagtaggctcactctttttcttattacaaatttttttttttaatctcgtgctggaggaggcctgcaagtgcttgacttcgattttatttgttcttcttccgtcaaccatcagatgtgagatttattttcatgcgcggcaaaactagttttattttccaatcatttgcataggtgtaccttaataaataatgcctaaatggccgtttatgccagcaatttgccctcacttgatcatcctgaggatcacaggatctggatgtcgggacaggttttggatttctccagattaatggaaggcaggggcttggaagacaatctggagccttgctgatggagagaagagcagtgctttaatgagcagatagaactagatttttctctgccttgtgaacgaacgattcagtggctctctctctctctctctctctctcttcatgcaatcgtggcaaaaaaatggccatcttccatctctctctcctcccaccagaatgcttcgtctgatgaagaagcttgctgcggcgttggactctctgtgggcttcccacgccgcatgaacagacagctccttcattgaaagaaaggcaaaaaaaatctcatatcgcagaaatgcgtagctgtttttatacatatacagataacggatattttttgatgaaagaagggcatgataaatatatccaagatattgctggtcgttcttgagatgccgatgatgataaagtcgtgatattttgatgtgcccattggatttctttcttgggacgatctataaaattttatgtgcccgtcgccagtcagatgagatcaaataattttccgccgtcgttctctggaattgcaggaagggccggaggattgggcctgcacctctcggccgcgtctgcctccctgctgtgcggagaccacggcagcctgcgagcgatgatcccgtcggcgccgggcagagccggagatcggagccggaggggcccgcgggcgtccaaggacgtcccctacagcttccggttccccccgatgaccaagaagccgagatggtggtggaggacgctggcctgcatcccctacctgatgccgctgcacgagacatggatgtacgcggagacggcgtaccacctccaccccttcctggaggacctggagttcctcacgtacccgttcctgggcttcatcgggcggctgccgagctggttcctgatggcgtacttcttcgcggcgtacctcggggtggtgaggaagaagatgtggccgcacttcttcaggttccacgtggtgatggggatgctgctggagatcgcgctgcaggtgatcgggacgatcagccggtggatgccgctggccgtctactgggggaagctcggcatgcacttctggactgccgttgccttcgcctacctcttcactgtgctcgagtgcatgcgctgcgcgctcgccggcatgtacgccgacatccccttcgtctgcgacgccgcctatatccagattccctacgattaatcgtggtggcactctgatccctcccctccctctgcctgtctgaaactcctctctctctctctctctctctaggccctccactgtgaacccttgtgggctctttgattagaaaaaagaaggctttttttctgggactcttagagccctgagccatctctgttgcttttcttgatgatgcctgcgtgtttgattcagcacagtgttcatgtttgggctataagaccaaggctcagtttttttgcgatatgttaatttctcggtgaataattaagcagatgtttttccagcacccataataggattaggcgtctcgataaattgttggtttataccctgaaattatttatctacgcaagtaaagagatgggtttgatggtgacgagatggttaatctgacgagtcaaaccttttgtaaaaattttatttttttcatcgttttcgctctggaaggttctgaaactgtgcccgtcccctgtcgcccggggctccgcgcctccgtcgcggctggccgtccgatcaactttatttgaggggctcggaccgctcgcggcgtactgttattcttcgacatgcccgcccttcgcctcctacctttccggcgaactgagctgtaggaatctgacatctccggctagcgccgccgtctggagtggggtgagtccttgccattgcccctcctccggccctctaagtttgcatttgcgtctctgtattgatcattggaggtcattgattctgtccttgctttgttggttatgcttctcgcccatctcttcttcctgcgtttaggcctggtctttgacattccaaaaagctcacggcagggctctgcttcttagggttctctctctctctctctcgctctctctcttctccatgaaaaggtttctgtcttacgaacctgattaaaattttttgtcagtcgtgatctctttttctgtcaaattgaatccacgggccttaatttcggtcctgctttttactttttagaaattattatattctacttttacttggatatctccttgtatctgaagtattttttttcttaaaaaattcctagggttccttactaaaatgtatttattgataccagggaaagttagctgtagggataaattatttgtgatctcatcgcatactagtttattttgagcagaattttttgttcttttcttcttggcattgaagaagatgtggattttacaattcatgcttcttgcttctatacaattgggtaccatttatgtgggatataaatttatataggcggtcatttcatggaagagatgcccttgaacttctttcatgtaatacagctttaagctcttttaatatttattaaatattcctctgttttcttcttggactctggaaggctttttcttcccaatgtaggtttctacttcatactttctgttggctataattcccagagccaagatcctgtcagaatttgaacattttctttctttctttctttctttctttctcagattaaataaatcagccgattcaaaataaaattgtattaaatctccctttttttccttcttgattcctttcttttctaattagttgattgaaatccgtagaaaaaaaatctctgctctatacataccgtctgagttactctttaaagtctccaaaaattttccatcaaggacaagcctcaagactggatctgccaaagcctcccaagggctctgaggccgttgacatgaacaacaacagtgggggtttgcctctggggcctgagaaggctatggaagtaaagagcgaggaccagaagagggctgctgtccatgctgagctcgagagggtgaaccagctccccaccaacagcagctatgcggtccaccgcatgaaagtgcttaacaagcttctgcatctcatgtccatcaaggtaatcgagggacccagtcggctacccaaagggatttttttaaaatttatttcacgaaccagccattacattttcggataaatgaggtaccatttatccgggagaagcatatgtatagatatataatttgaccttgcgaactatcaaggtaattgaagagcccaatcgactatctcaagggatgtagcagtagccagtttcttttggcgatgaagtaggatagcaatgatgctgctgtcatgtgtaaaataaaagagccatttttactgtttttggcatcagggtatgatcgagaattagcgggtaaatttcagcatattaagtgctaaatatctgaagaataatttttttatatctacataggctggtaattgttgtaacggttagaattgagctatcagtggggtgggcccatcgttgcacccactggtttattttccataacaactgatataggactcttcttatagcgacttttgagggctctgccacatggaccggatcaactggatatgttcagcccaagagcagctgtctagagttattgggttttacccagctcagaaaagaggataatccttgtaatcacatggttgaatacttctacaatgaccaatatgaatctattccctagcactttttattttctttccagctagaagaaggtaaaaaaaaggtcccgagatatgaaaaataaggattccagtctagatatatgtttaattcttcttttctgatccattgatgcatagaaaatggatgcttttagaaatcttggtgttctgtagttaaagaggatataaataaaagctcagaatgcccgtttcaacttgaccagagggtgggattccgagatgctggtttctggtttcttttttagtttcttcaggtagagagagagagagagagagagagagagagagagttaattgttgttctctatttattatagtttgcatagtatatcacattgattaattttgcactttttttttattaatcatcgagctcacatctgctatttcacgtggtcactgtggactgataatccattttataacttatgtgaatcacaaattggctacataaggttttttttagccccaaaccaattggcctgcgaacagtttttattattctcacagagtgggcggggtagcgcagaacttgagatcgaaaactttcttgcctgcttgtgtttcaagattgggaccgaagatatccccgccaaatgttccttttttggaagttgatctgcatatttgtccttgcaggagatgcggtcaaatgcatactctccttgtgtggtaatcctgtggttaaagctcctgagttatgtcccatttccatcttctgcaatatctagtgaataatcgtttttccttgctggcgttgactctgaatattcccttatttagagactaattggtccatccatcctcactaaatatcctcaaccctttgttcaaggtcaaagtccttttgactttgtagagcctctggatgagctaatattgagctattattcacgtaattatgttcctccctgagatgagtattcgttgtcattagtaatattatgataataagtaaatccatggtgtctaaaaaaatgatgataagcttttttgccctgtggactcgaccatcacccagagcatgttcatgaatgatattttctctctctagaatccatgaacattatattttttttaaccattttatcaatattaaatatgccgctcctcttctaattgtgctgtgatttcatctccctgctagaggaccaccacccaggacgaggagctggagcttctgtttgcagggctctctctctgaggatgaagtacaaggcccgaggtcgttgaccttgtgcagaagcatcaaataaatgtcaatatgaagcgtctctgtgcatgcccatgatgctctttctaccgagctttctagtccggggcttgatgagcaatggaacgatcttatctttggcgatcatcatcatctggtcaactctctctctctctctctctccttatctctgtacatacagacactggatctatgaagatatatggaggatattgggttctcgcatttgattgatctaaatttcttgtagcatctccttttgtaatctttccagggagatgtcttactggatcatccgtcttctctttttcatcaaatattgagcacaagataagatgaattattcgacaaataattcacccttttgataagaaaaaaccaacaaatggtgaatttcccctttttaatgggtatggtaataccttttggatttcttcaatgacttcgagggcaagggataacctaaaaaagtaagtttttttcgtcattatcttcaatttttggcccaccaacattacccttttggctttatttgaccctttttttctggattaatattacaaaaatgccaaaaaacaaactaatatctttacaaatttgggaaaaactacgaccctactgaatcagacgatctccaaaatggagataagacaaaggggcgctggagagagagagagagagagagagagatagagtttaatagtagggacaaaaagatttattttttatgaaatcggcggactgatccagaaggcccacctcattaattttctattttcgtgaaatcccacaaccagaataaatccagagagagaagctgcgagttccccccccgcccctcaaagcgcggcgctttttccc

SEQ ID NO: 768 - DNA, 2395 bp, Taraxacum officinale
ttttcctcttacaacaggctttccatttcttcatctctcatctgcatcatctcatggaattctatcccatttcacaccgaaaacccccagcaagttatccccaaaacgcccatccaccatctctccaaaagcatcaaaagacacaactccattctcatacaaattcccccccatggaaaaaaaaccaaaatggtactggagaaccctagcatgcctaccatacctaatgccactacacgaaacatggatgtatgcagaaaccgcctttcacctccacccattcctcgaagatttcgaattcctaacttacccttttcttcaagccctcgggggtttaccaagctggttcttgatcgcgtatttcatcatcgcctacctggcgattgtcagacgaaaagagtggccccatttctttagattccatgtggtgacagggatgttgttggagattgcacttcaagtgacggggactgtttggaaatggctcccgagtgggtggtattggggtgtggtggggatgcatttttggaccgcgtttgcgtttggtttcttgtttacggttttggagtgtgtgaggtgtgcacttgctgggatgtatgcggatgttccgtttgtttgtgatgccgcttatatccaaatcccttatgaataatgtgtttatgtgtatttttgttattgttatcttggactttttacaacattaaggtcaaatacttattgtatgttacaatttagtgaatttacatccgtcctttgatttatgtaagtttttttttaccgggataaatgatttctgaaagatattttgagcaaatggtgaaaagcatgtatacttttggatttccctgattttatatatcaagtcgataagaaacacttgtcttcctagattaaggggttgtttcttttttatttttcctgccatgaaagtcatatcaagtgcctaaatgaataatgatgtatgtcgggataaagtgttgagtatataatgtttgttgagttatctctttttttgtactgaaccaattgtttaaatcagaccaaaaaaaaaaaaaaaaaaatttcataatattcgttaactataacattatcaaagttttaatgtgagaggagtttggaggataaagtgttgtatctataaggtttgttgagttatctcttgtctatattgagccgatggtttgaatgaggccgatttgaccattttaccttaactttttataaaagcaaatttcacaatatttcttttaactataacaatattcatcattcttaatgtttaatgtgagaggaattgggtcgaaatttttgaccagtttactcttactttttaaaaaagcaaatttcacaatattcattaactataagtctataacaatactcatcattcttaatgcaagaggagtaggcaggaaaaataagagaaaataggtaaattgttaagtttcttaatggattaagacagattttttggtttgaccaattaaatcattatgtccataacaaataaaaaagaaactcctagtataattgtccaggacattgcatgattactatattcatgtccaccgcttaattcatatatattctttttttttttcttttcatcttatatatatactaggtggtctgagtgcaataaatatgttggttatggttttcattttgtaaattatgttaagatgatattcgttaaataatttaataacatagactttgattgatagtgagcattagattgtagcttagaagttgcatttgtacaaaagattatggttaatagatacttgtctaaagacctaccggtctaagcaccttagcaaacacaaaaggttgttccatatttacaagtggggtttcgaaaggcaatagactttcatacttgttccttgattgtgggtttactatgttttcttggttggtcttgctcacgctttctgccatattgtttgaactttgagatgtagtatttaagatgttttttctggttacagaactaattgtttttcgtttccatcttaagatggttcgtctccggtacttttttgtaaagttgtatgtattctttttcgtttggacaaaacaaggcatcaacacttgaggcacaagtttttgtttcttattttctggttgtacgtataactccacagtctttctctcgaagatgaaagagatttgcccgacattaacggatatctagaaataatttttttggtaagatcataaacactataaaatgttgggtgtgcttaggaattacctaaaggaaatattgaagatatggttgaaagaaactatggtattaagatgaaaaccgcacgaaagagaccgactttaaatgcagtacggatagactgcgtgttgggaatagggggcccttgcagtacccacctgg

SEQ ID NO: 769 - DNA, 1703 bp, Trifolium repens
tcgtactatccctgtgttacctagactgcgcaaatcttgtacatctcctcgagcaatgaaggatggctctgctggctatcgataccctccgatgaccaaaaaaccaagatggtggtggagaacattatcatgcatcccttacctcttacctttccatcaagtatggatgtatgctcagacagcatacaatcttcacccgtttctcgagaagttcgaattctacacgtacccttttcttatgtcaattgggaccctacctagatggtctctcatagcatacttcgtgattgcatatcttacaattgtgaggagaaaagaatggcctcatttcttcagatatcatgttgcattaggaatgttaatcgagatagccttgcaggttacaggcatcgtgagccgttggatgccgaaatcattctattggggtaaacttggaatgcatttctggactactgcatttttcatttttctctttactaccatagagtgtattagatgcgcccttgttggtatgtatgccgatatcccttttgtctgtgatgcagcatatatccaaataccatatgaataaggtggaatatgtaaggaagaaaacacctttacatttatgtaatcttgtttttattgtaccttttgttaagcagaaccaaagaatgactactcagtctgtcgttgtttatatcaaaatagtatctgtttgatcccttgagtacattgatgtagttatatgtggatcaaatttatctgtattctcacaatctcacaatttaatcactccctttctacatgtgtatatgtggcatttgtcgataccttttaacattttttaatttgagatgacaatttgaaacatgtccatgaatttgtttaaaccacactagtactgtgaaatttgggattgatttgataccatcagttaatggtttataaaataatttggcattaggttatgaagtccggatactctactcgaaattgatatgcatggaacatgtctagatgcatattgaaggagtatcctccattttttattattgcgaaagtttgaaatacgactgcaatgtgtgtgaaacaactccagaaacatgctttaaactttttgtttaaccacttattttcttcatgttttgagagacattggggtagacactcctttttctttcattgaagggaaaagcatgcttaatggaactaagatggattgacaatttttttctcttcatgcatgtcagaaatgtacaaaatgttttgagagacattggagtagacactcttttttctcaaaggaatatcattgccaatccatccaagttccattaagcatgtttttaaaatcgaacttaacatcaaatcaaagaaactttgaaattatgatatgtattatttttttgggttcattcaattgctttaaaccattcaaactaaagcatatccaatagtcattttgtaagggacttactttgagtttcatgtcctacctgacctatttgtttagttttctttgatttttcttgcttgatcttattgcacaacatgtgaataatattttatcaacatgagttggtctgactcatgactcttgaatgagcaagcttcttcaacatttttcaccatgtggtttacagtttaccattgcatgatccatttggctacctgcagaggtgtgggaaattttattgtttgccttagtagtgtgaaaatgt

SEQ ID NO: 770 - DNA, 369 bp, Xanthium strumarium
gggatgcatttttggacggctttcgcgtttgcttttcttttcacagttttggagtgcattcggtgttgtcttgttgggatgtatgctgatgtcccgtttgtttcagatgccgcatatattcaaataccgtatgaataaggtgcgcatattgacttcagtcttgttgttactacttaactatctattcgttttggtcttgttagaacattaaggtgcgagattgcttcttttcatccatgtaaacagtggtttatgagtgtttttggtacattcaaatcacatcttagtttaatgttaagtgatgatatcatcagacacagattacatgttagaaaaagttatgtacctttttagttttttttaaaattt

SEQ ID NO: 771 - DNA, 485 bp, Xanthium strumarium
ctgctctgagactgccagttaccatcatcctccgtcaccttcgccgtccgtcgtatatcattcttcggataaaacccaatcaacaggcctgggttaaggtatttattcaatatgattttgaatggttatttgctacatcctcattccgggcagttggtgaactgtaagaccaagccattgtctcatccacgcgcagtgtcggtaccgcctgttatgagttgtttgacatctcatcaggagctgagatctttttctccccatggagctgcacgtgttcatctctctgcagcatcatctttactctatgggcatttaggtctatttacacacaaaacaccacccacatcatctcaaagacgtgtatctccaagagcatcaaaggatggtggtgcatttagttacagataccccccaatggagaaaaaaccgcgatggtattggagaactttagcatgcttaccctacctaatgccgcttcatgaaac

SEQ ID NO: 772 - DNA, 1044 bp, Abutilon theophrasti
ttcctcaccgtcaccgatcattgcccactctatcgcctccaaaatttatcacttcaatcaaaactgggaaaccaaagcctctgttgtcccctttcgcctcctacgatcctcttattgttagaagatctaagcttttttcgtgcagagtctcttcttcatcagtttctccgagttttacctcctctaacgatgatagtgatactgacaaggcaaagttagctcaggtttcgaagaggcttcagagaacgtcgaggtactttaagcgattgggcaatttagggttctggggacagctagtatgcactttggtatcggcggtgatactctctttttctgtttttattactgggaaaatcacatcaccagttactttttattctacatccggtggaattgtggctgcattcatatcagttttttggtcatttgggtatattcggacttctgagaaactcaagagaactgctaatgatccttcaaaggctcctcctcgtgctgatgtagtgaaaagcttgaaaaatggcatacttctaaatcttctgggaatgggggctgctattcttggcattcaggctacagtgggcttactagtcgctaaggctcttacttcctcgacaaatccatattatcaaggaatttctcctggctatagccccgttcttgcattggatgtattcttggtgcaggcatcggctaataccatcctttctcattttctggggcttgtattctcgctggaactgttgcgctcggtgacattacctcagtcagacagtattccaattcccaaggtcgcataagttattcttttcttgctgaaatgtcatgaatttgaagcatctgctgcaacatgatttgtagccatagggttttttttttttgtagataatttgtagccatggttgttgaaaagccgttttaacaggtatttcagttgtaagatctcagagctgttttataagtcatctttgcattacatacattgtattgcatgtgacaatgatctagtcataggatattttttctttagtagagagtaatatt

SEQ ID NO: 773 - DNA, 2159 bp, Abutilon theophrasti
ttgtattctcgctggaactgttgcgctcggtgacattacctcagtcagacagtattccaattcccaaggtcgcataagttattcttttcttgctgaaatgtcatgaatttgaagcatctgctgcaacatgatttgtagccatagtgtgtgtgtgtgtgcgtttttttttgtgataatttgtagccatggttgttgaaaagccgttttacaggtatttcagttgtaagatctcagagctgttttattagtcatctttgcattacatacattgtactgcatgtgacaatgatttagtcataggatgtattattttctttaggagagagtaatactcttttctgacttgagagtttgtttgataaaacaccaccaccattaagggtggtcaaatctctacccttctggactcaatacatatccggtcaatatgaattcaaagttaaagagttcttaaagattcttctaatacatgagaaaactgaataacaactgaacatttctggatcaaacacatacatatttgcatcgaataacttgggaagaaagaaaagcaagtctttgaaaaacagatcactactctcttatggtacgagagcaaacgaatataccatcaaagccatggaaattcttcacctcaacagcagggatttatcatgctaaacaaactttgaattttagaataatacagactcctacatatgtttattacatgagaatcgttctcctagaacaaaacaagcactgccaccatacaagtactctacatctccttccagacagggatgatgaaaagctcatatagaaagaaaagagaaacgtatacatgtgatgaaaaactcatatggaaagaaaaacatgaatgtataaacagcaggctaagacctaatcaagaatatagtgatcccacgagggggaaacaatatatggctgaatcgtctcctgaaaaaataggttatcacggttagccctgctcccaacgattgctaactcaaatggttgaatcaaacacccaatcctatgctcctgctcacacttaaccacctgaatgcctgtatgaaataagtgcatacgctttagtcagaataaaaatccatacaatacaactggctttacgattcaacattttgtcttatcaaccaagagcaatcaattcagtccgtgtctaagtgtatgacatgaaaggtcccaaacattagatagcatgccatgcttgaggaatgaaacagcagaggatcattcaatccttaatagataagtgatagttctcttatttggctgttaaacaagttttcatgtgcagagggacactggtcattaaatatgcatatatcagagacatatttataatgtgggtacaagtcaacacagattaaccggatggttgcataattcaaattaatgcaacccaaacaatgtaaaagaggctcgcattcttagtcatgtagattaaagtctaaagtgatataatcaaaaggaacagagaagcatacttacctactgcatcttcttttgcttattagatggaaatggaagcttccttaatacggtttcgtcgaatttcctgtactgagcttgcatgattttgtgagttacagaaagcttctcatcgatatggtgttgatacttgtcatatatcacgggaactgatagactaagaacaactactgcagaagatactgaatgaaataagcatatacgaataataaaaaataaaggagtctcttcagtataatagagattaacaaactcaccgatatacaccagagtgaggaaattgaagaaactaccgatgaaagaaacaaaccacaagccaacagcagcctgagaagaaggcatataaagcaaatatattttttagagtttgatatctcaatgcagccaattatagaagtgaaaaagttaaaccttaaagaaaagtttcaaatctctgccgagggtaacgtcatgcgcaatcgacaatgcataattgacaacaacttgtaactcatcagcaatcttggcagcagtcgtctcagaaatttccaaattaggaaggggcggcaaaggtctgtatcagaaagcactttctgaatcaaacaatatttgcttcaataaaaagcctcctcataatgagacaatacctgttgagaaggaaagcagatctggcccataagaagaga

SEQ ID NO: 774 - DNA, 3396 bp, Abutilon theophrasti
  unsure (1)..(3396): unsure at all n locations
gtctcaggctacaaacatatattcatatcgagccatgggagcaaagaaagagaccaattgtttgtttttggtaaccaaatcaaaggtggaactgctaaaaaaaggggggttaagaccagttgatgtaaatgatgaatgtgacttaagattatcttggtaaatctcctcaaaaaaaaaaagattatcttggtaaagtggctgacattgtactacaatatcacaactttaataagtaaactctgtgtttatttattttggtgcggataactggggggagaagacaaggtggagagaggaatctaatgtctgttactacaagacaaccaagtgtccatcaatggttttttttttttttattccaacttacagttggtaaaaatagccccaagggacaacacacttctgcaagattaggtctaattctgaaccagtccttctattatgtttaaatttggaaatttaatccatctatgatttagttggtttcttgtgtgtcacgggcggcgattcttgactacgatagtgttttagttcagctcagctgtcatcaacaacaactccaattttgtatactttttcaagtcaatctaactccatattctgtttttatatataaataatccaactccatatattctctaacttattcctttgaactaatcttactttattgtaaacaagaacaatcccgtattttaaaaaagtgggatcatgattaatcgcactgtgtaaaaaggcataattaaaaggggtgtatggctacttaatctaatataggaaatttaaggttaaattaatacatggaattcgaatctctaggatcacagtcacgagctagatctttttcagttttagttaagctataaacacttttgttttttctttgatttgtctaattgggggtgagagacaaatattataacaaaagctttgttaggttaaaattttgattatgttcattttttatgatgagcggtttaaaaataacatgtaatatttgtggtagaaatttcaccaaacctgtgacaaacaatcagatgtggactgggcaatttcatcaccattatgcttttggtccacaacatttgtggcataacctaccaattataggatgggctttgaatcgagttaacctagatcaaaatagttcgagttttgaaaatatatctgttatattatctcaatgtgggtatattggaattgtgtatatttacataagaattaaaacttcaaaaaacaagtgataatgacttagtttgtacggctaaagacagcatttggaaaatgataataataataataatnnnnnnnnnnnnnnnnnnnnnnnnaataataataataataattgttgccggtcaagcttgtgaacaatcctagaaaactggagtcgaccactcctttgttgttgtaatgactccgtggacaaaacggagtctcgcttttcaactcatttattatctttaattattagggttagttttattggacatcctgaaataatggtttagattttaaattgatccttaaagttcaaaatattttaattgaatcctccaagtttcatcattgaatcaattagatcattctaccagccaactcgtcaacttgggcgtcaaatacaagctcatatttgatatagattattttttaaaatacgtaaatcccattttaaacttgtgcatataattcgaatagataacttgaatctgacatgttaaaaaataaaatattatttttaaatatataatttaaattaaaacaagagaaaaattaagtaggataaccggatccaaataaaatcgatttgattagataaattaaaaatggatcatagttatcaaatttaaatcaattatgtatggaaaaaccaacgaaacaaccgaaatagcccattgcagacccaggtggcccaatttacatgtataagtgtgtaacttgatgcccacggcccacccacttagtacaaacgtcaaacaagcgaaaattacaaatcaaatcaattagccaactctccccggatcccacatccaatcctatgcccgacgaaccaactcgggtccccgacatacccgcacattatctatctactcatcatgcaaacgctgttgctgccggcaactcgcaccggcatttgtgcggtggcggtgggtcctctccttcctcaccgtcaccgatcattgcccactctatcgcctccaaaatttatcacttcaatcaaaactgggaaaccaaagcctctgttgtcccctttcgcctcctacgatcctcttattgttagaagatctaagcttttttcgtgcagagtctcttcttcatcagtttctccgagttttacctcctctaacgatgatagtgatactgacaaggcaaagttagctcaggtactgcccacccctcactgtccttttcttaatcccagattaccctttaactgattattattaatgaattttagttatttggcatgaagtttcaaattaatcagattggatagttaaagtattttgaaaaagctagagaaatgcaaccagtttccgcattgttcatttattgatattgatttaagcagtaacatcaagatacagagaaaagctacaacgttagaagtagaataattttgtgggttaattttggatggtttaatgtaaatgaacgtttttgaaggagttataaggattttgaatggatacgctgcaggtttcgaagaggcttgagagaacgtctaggtactttaagcgattgggaaatttagggttctggggacagctagtatgcactttggtatcggcggtgatactctctttttctgtttttattactgggaaaatcacatcaccagttactttttatgctacatccggtggaattgtggctgcattcatatcagttttttggtcatttgggtatattcggacttctgagaaactcaagagaactgctaatgatccttcaaaggtggttcgatttcgatattgtgattttgttaacagtttaaagtgtctgatgcattgttaacttaaaagtgcaatttgctttttctatgtttattgttatatttaagtcttgggagaaaaacatatatctgaacctaattgttgttttatttcctggtttctgtcactgtagtttttccttgattagagttttagtggtccatttgagtttgatctagattaagtgcttagtctttggaatatcagattgtagtttggtatatgctcaaatacagggcttatttgagctttccgattgacgttttgatgcctcattaaatttcttataaatcctaatttttcccttgagttttcaggctcctcctcgtgctgatgtagtgaaaagcttgaaaaatggcatacttctaaatcttctgggaatgggggctgctattcttggcat

SEQ ID NO: 775 - DNA, 688 bp, Amaranthus albus
tttggttatattcggctatcagagaaactacggagaacagcaaatgacccatcaaaggctccccctcgtgctgatgtcgtcaaaagtttgaaaaatggaataattttgaatcttcttggtatgggctctgcggtcttgggattgcaatccacagttggattactggttgcaaaggctcttactacatcaacaactcctttctatcagggtaatcctggcacaagccctgtccttgctttggacgtgttcttggttcaggcatcagctaacactatactgtctcatttcttcggacttgtttcctctttggaattgttgcgatcagtgacatcacctagcggtcaaactgctcctgttgtcaagacggcctaggcctttttgagcatttcatttcagcattacacacaagaaggttctcgatacttttctagttctagtcaaaagccgaatgtgggctgatgaatcttgtattttattgctgttgataattgtgcagtagctgtaatcatgaaggctattagggtactgagaactagagtattttgttcagcgcctaaaactcaactgaacagcacatcttttgttaattagccttagctagagaagccgttctctgtaaacaaattgttcaacgttccatatattttgctcgagttatttgtaagcattctgaatcctttctattaaa

SEQ ID NO: 776 - DNA, 1295 bp, Amaranthus chlorostachys
ctcagctcatctgctcacaacttcaacaacaaaaacccattttaaacttcagaatgcagacgctgctttttccggctactcgctccggcgttcctccaccgtcaccaccgccatcgacgatggcacaattacgtcttccgaggcaaattccaagctattgtcggttcttatctcctccaaattctatctcctctttctcgtcgtcttcctcttctcaccttccttctctcttcttaacaaaatcgttaaaatggtgcaattgcttcctcgaatggcgacttctcctacatctaccgattacgcttcacctgttgatgaaactgaccaggttaaactcgctcaggttgctaaaagactagaaaacacagcgagatatttcaaacggttgggtacttttggattctgggcacaactagtgtgcacacttgttgctgctgtgattctttcgttttcggttttaatcaccgggaggatgacatcgccagctactttttatgctacagctggtggaattgctgctgcgtttatatctatattttggtcatttggttatattcggctgtcagagaaactacggagaacagcaaatgacccatcaaaggctccccctcgtgctgatgtcgtcaaaagtttgaaaaatggaataattttgaatcttcttggtatgggctctgcggtcttgggattgcaatccactgttggattactggttgcaaaggctcttactacatcaacaactcctttctatcagggtaatcctattcctggcacaagccctgtccttgctttggacgtattcgtggtccaggcatcagctaacactttactgtctcatttcttcggacttgtttcctctttggaattgttgcgatcagtgacatcacctagcggtcaagctgctcctattgtcaagacagcttaggccttcttgagcatttcatttcaacattatacacaagaaggttcttgatacttttctagttctagtcaaaagccgaatgtgggctgatgaatcttgtattttattgctgttgataattgtgcagtatgtgaacaagagctgtaatcatgaaggctattagggtactgagaactagaatattttgttcagcgcctaaaactcaactgaacagcacatcttctgtttattagccttagctagagaagccgttctctgtaaacaaaatgttcaacgtaccgtatattttgttcaagagttatctgtaagcattctgaatcctttctgttaaatttggtagaactaagttttcgttttagtcttaaataaatcaaac

SEQ ID NO: 777 - DNA, 1213 bp, Amaranthus graecizans
agctcagctgctcacaactagagcaacaaaaaacccaaaagaaaccattttaaacatcaagaatgcagacgctgctttttccggctactcgctccggcgttcctccaccgtcaccaccgccatcgacgatggcacaattacgtcttccgaggcaaataccaagctttagtcggttcttatctcctccaaattctatctcctctctctcgttgtcttcttcccaccttccttttctcttcttaacaaaatcgataaaaatggtgcaaattcttcctcgaatggcgacttctcctacatctaccgattacgcttcacctgttgatgaaactgaccaggttaaactcgctcaggtcgctaaaagactagagaacacagcgagatatttcaaacggttgggtacttttggattctggggacagcttgtgtgcacacttgttgctgctgtgattctttcgttttccgttttaatcaccgggaagatgacatcaccagctactttctatgcgacagctggtggaattgcggctgcgtttatatctattttttggtcatttggttatattcggctatcagagaaactacggagaacagcaaatgacccatcaaaggctccccctcgtgctgatgtcgtcaaaagtttgaaaaatggaataattttgaatcttcttggtatgggctctgcggtcttgggattgcaatccacagttggattactggttgcaaaggctcttactacatcaacaactcctttctatcagggtaatcctggcacaagccctgtccttgctttggacgtgttcttggttcaggcatcagctaacactatactgtctcatttcttcggacttgtttcctctttggaattgttgcgatcagtgacatcacctagcggtcaaactgctcctgttgtcaagacggcctaggcctttttgagcatttcatttcagcattacacacaagaaggttctcgatacttttctagttctagtcaaaagccgaatgtgggctgatgaatcttgtattttattgctgttgataattgtgcagtagctgtaatcatgaaggctattagggtactgagaactagagtattttgttcagcgcctaaaactcaactgaacagcacatcttttgttaattagccttagctagagaagccgttctctgtaaacaaattgttcaacgttccatatattttgctcgagttatttgt

SEQ ID NO: 778 - DNA, 1214 bp, Amaranthus hybridus
gctcatctgctcacaacttgaacaacaaaaaacccattttaaacttcaagaatgcagacgctgctttttccggctactcgctccggcgttcctccaccgtcaccaccgccatcgacgatggcacaattacgtcttccgaggcaaattccaagctattgtcggttcttatctcctccaaattctatctcctctttctcgtcgtcttcctcttctcaccttccttctctcttcttaacaaaatcgttaaaaatggtgcaattgcttcctcgaatggcgacttctcctacatctaccgattacgcttcacctgttgatgaaactgaccaggttaaactcgctcaggttgctaaaagactagaaaacacagcgagatatttcaaacggttgggtacttttggattctgggcacaactagtgtgcacacttgttgctgctgtgattctttcgttttcggttttaatcaccgggaggatgacatcgccagctactttttatgctacagctggtggcatcgctgctgcgtttatatctatattttggtcatttggttatattcggctgtcagagaaactacggagaacagcaaatgacccatcaaaggctccccctcgtgctgatgtcgtcaaaagtttgaaaaatggaataattttgaatcttcttggtatgggctctgcggtcttgggattgcaatccactgttggattactggttgcaaaggctcttactacatcaacaactcctttctatcagggtaatcctattcctggcacaagccctgtccttgctttggacgtattcgtggtccaggcatcagctaacactttactgtctcatttcttcggacttgtttcctctttggaattgttgcgatcagtgacatcacctagcggtcaagctgctcctgttgtcaagacagcttaggccttcttgagcatttcatttcaacattatacacaagaaggttctcgatacttttctagttctagtcaaaagccgaatgtgggctgatgaatcttgtattttattgctgttgataattgtgcagtatgtgaacaagagctgtaatcatgaaggctattagggtactgagaactagagtagtttgttcagcgcctaaaactcaactgaacagcacatcttctgtttattagccttagctagagaagccgttctctgtaaacaaaatgttcaacgttccgtatattttgttcaag

SEQ ID NO: 779 - DNA, 1208 bp, Amaranthus lividus
gctcatctgctcacaacttgaacaacaaaaaacccattttaaacttcaagaatgcagacgctgctttttccggctactcgctccggcgttcctccaccgtcaccaccgccatcgacgatggcactattacgtcttccgaggcaaattccaacctatagtcggttcttatctcctccaaattctatctcctctttctcgtcgtcttcctcttctcaccttccttctctcttaacaaaatcgttaaaaatggtgcaattgcttcctcgaatggcgacttctcctacatctaccgattacgcttcacctgttgatgaaactgaccaggttaaactcgctcaggttgctaaaagactagaaaacacagcgagatatttcaaacggttgggtactttcggattctgggcacaactagtgtgcacacttgttgctgctgtgattctttcgttttcggttttaatcaccgggaggttgacatcgccagctactttctatgctacagctggtggaatcgctgctgcgtttatatctattttttggtcatttggttatattcggctgtcagagaaactacggagaacagcaaatgacccatcaaaggctccccctcgtgctgatgtcgtcaaaagtttgaaaaatggaataattttgaatcttcttggtatgggctctgcggtcttgggattgcaatccactgttggattactggttgcaaaggctcttactacatcaacaactcctttctatcagggtaatcctattcctggcacaagccccgtccttgctttggacgtattcgtggtccaggcatcagctaacactttactgtctcatttcttcggacttgtttcctctttggaattgttgcgatcagtgacatcacctagcggtcaagctgctcctgttgtcaagacggcttaggccttcttgagcatttcatttcaacattatacacaagaaggttctcgatacttttctagttctagtcaaaagccgaatgtgggctgatgaatcttgtattttattgctgttgataattgtgcagtatgtgaacaagagctgtaatcatgaaggctattagggcactgagaactagagtattttgttcagcgcctaaaactcaactgaacagcacatcttctgtttattagccttttagctagagaagcccttctctgtaaacaaaatgttcaacgttccgtatattttgt

SEQ ID NO: 780 - DNA, 1331 bp, Amaranthus palmeri
ccaaaagctctatttttaagtccatcacggcccatcaaaataatgacgacataggtctctcagctcatcagctcacaacttgaacaacaaaaaacccattttaaacttcaagaatgcagacgctgctttttccggctactcgctccggcgttcctccaccgtcaccaccgccatcgacgatggcacaattacgtgttccgaggcaaataccaagctttagtcggttcttatctcctccaaattctatctccgctttatcgttgtcttcttctcaccttccttctatcttcttaacaaaatcgttaaaaatggtgcaattgcttcctcgaatggcgacttctcctacatctaccgattacgcttcacctgttgatgaaactgaccagattaaactcgctcaggttgctaaaagactagaaaacacagcgagatatttcaaacggttgggtacttttggattctgggcacagctagtgtgcacacttgttgctgctgtgattctttcattttctgttttagtcaccgggaagttgacatcgccagctactttctatgctacagctggtggaattgctgctgcgtttatatctattttttggtcatttggttatattcggctgtcagagaaactacgaagaacagcgaatgacccatcaaaggctccccctcgtgctgatgtcgtcaaaagtttgaaaaatggaataattttgaatcttcttggtatgggctctgcggtcttgggattgcaatccactgttggattactggttgcaaaggctcttactacatcaacaactcctttctatcagggtaatcctggcgcaagccctgtccttgcgttggacgtattcgtggtccaggcatcagctaacactttactgtctcatttcttcggacttgtttcctctttggaattgttgcgatcagtgacatcacctagcggtcaagctgctcctgttgtcaagacggcctaggccttcttgagcatttcatttcaacattatacacaagaaggttctcgatacttttctagttctagtcaaaagccgaatgtgggctgatgaatcttgtattttattgctgttgataattgtgcagtatgtgaacaagagctgtaatcatgaaggctattaggatactgagaactagagtattttgttcagcgcctaaaactcaactgaacagcacatctgtttattagccttagctagagaagccgtctctgtaaacaaaatgttcaacgttccgtatattttgttcaagagttatttgtaagcattctgaattctttctattaaatttggtagaactaagttttcgtttgtctcaat

SEQ ID NO: 781 - DNA, 4666 bp, Amaranthus palmeri
tcccaaaccttgtcattctcaaattctacattcatgatttcataattgaaatcattaatttgaaatgaaatgctagttcccaaacacaacctagaagaattttgaatttgtggttttatctacttggtagatttaggttaagtctttaaatctttggtgcagggctataattgaactctttttttcttttcagtttccatttatttcataaatctgcatcttgataatcttctgtattgttttctcttgttttcctacataatccttttcaagatatggacttttttatttgattgttaaataaagaactgaaccttggatactcaaatgtttcttatgatcaactttaatgaagaaaatttatcataaatttttatgatttcaggctccccctcgtgctgatgtcgtcaaaagtttgaaaaatggaataattttgaatcttcttggtatgggctctgcggtcttgggattgcaatccactgttggattactggttgcaaaagctcttactacatcaacaactcctttctatcagggtaatcctattcctggcgcaagccctgtccttgctttggacgtattcgtggtccaggtaagtcttgaactacttgtaccgttgtacggagataattatatgtgtaccctatattcagttgctcacaagcccccctccaaaacccaaattgttagtgctactccttgcataaatgcagatagattgatgatttgttataacaatggctggggaatatcgcataacacattgaagagcttgttgcatctaatgtgctaactaaaaaacttctctaaaacaactcgtactatcaaacagatggtcactcattgacttgtcgtggttgtgtcaagtgggaaggcaattgctacatgtccgtatcttagtcttacataggaataagatctatgttaagggcccttttgtatgcacaataaattaatgctgctagcctgctaccatgacaatttttgctttgatggctcgatggcatagagttttaggtattacctttgatgattccgttcctttcatgactcacccgctattttttcttctggctaacagaaaaaaaagctgttaatatattctgtcactgcccactccagagttcaggcgaattgcaacttgctaatggttcacatcttgtcagagatctcacagatagactttgatagatgtctattgtgattaattacttcctattcccgctatctcaaagaattagcctcattttcttttttcgtctatcttattgaatttggcacatttctatctatggtcatgatcctttctttctttcttgaagtttatccacacatatatccaacttttatatcattgaattcaaattctcttcttatctcggtccttctattggtatgaatattgaccctttagacattattctatagtgtcgaaaaatttcatcatcattataggccccagttatcccacccatagctatgatcgggagggaaagaagacaacaatccatacccgtaaaaaaagatgcggcgaagagtctatcggctcgacaaagatcctcagaaagagagattcctccaatgcaaaggatttgagtgaacttgaatttgcaagctcgcattttacaatacaagcttgaccttatcataaaataaaaagaaatatgaatagactaaaaactgtgatatgtaaaaggcaaagaacaccaacagctaagcgagaaagtatcaatggtcaataaattttagttttcaccaaaaaaccttacagaaatgagggaattgggaccgaaaatctaaaagaaaagggtcaagatggaatgtaaaactctctcaataactcatttgttcgttccattggcaggcatcagctaacactttactgtctcatttcttcggacttgtttcctctttggaattgttgcgatcagtgacatcacctagcggtcaagctgctcctgttgtcaagacggcctaggccttcttgagcatttcatttcaacatcatacacaagaagattctcgatacttttctagttctagtcaaaagccaaatgtgggctgatgaatcatgtattttattgctgttgataattgtgcagtatgtgaacaagagctgtaaccatgaaggctattagggtactgagaactagagaattttgttcagcgcctaaaactcaactgaacagcacatctgtttattagccttagctagagaagccgttctctgtaaacaaaatgttcaacgttccgtatattttgttcaagggttaatttgtaagcattctgaatcctttctactacctcctattcatcttaatagtcccatttgaccgagcacatttcccaatgcaataatttcatcgttaatatttctaattgtgtataattaaaaattgtaaaaagttgatatgaatgatctttgcattaaaatgaatcaaacaagacctcacttgacaatattataacttatagtttaagaataaaatacatatatagagtgattaatgaatagtgtcaaaattcaaatgggactaataccttgaataggagggagtattaaatttggtagaactaagttttcgttttagtcttaaataaatcaaactcaaactccagttaaaagcaaattctgtagaaaaacgagacatttattcagatttttacattattttttgtaatctagtatagacttgtatgtacaagttttcattacattttatttcacttttaatactatggacactatagttttgacatttagactattccttttgctttaatatttgaaaataactttaccgctttctttaatctcatctacatttgtcaattttcttttaatcattcatacatttattctttcgtcatttataaccaaaattttatctttgcctaaaattcaatccatttgcaaatgaggtcagttaaaaagaatagagcaaaacaccttatcaatagtagattattatagacgtttcaatttccatgttttacctaatataagggtgttcggatctgctagctcaaatgttgccactcataataatttcctgctgtttttaagttttttttttttgaagttattttaaagtttaaatgaactcaaaatcaaacaccatgattaacattttaatttctaacctgtcccaaagactacgaaaaaaacaaaaaaaattaagggaaaaacaacacaacacgtccaaacaaacatgagaaaatcatttttgttaagacttaaaaaaaaatgccgaagagaaaaaaaggttttcctcaaaaaaaattgagaaaaaaggttagcagttagcacacatcttaaactaaatatctacaatttgccatcgaaggcgctcaactatttccagtttcaaatcaagtctccatcacccagagaatacaagcaaacctaatactgatgagtttcgcactgaagtatgccattttcctgcttcagagaaaaagtgatgatctccagttcaccacccagaacaaatcttacacagttatgctcttcattctcaattccagaagaaagccgtagagtgatctaatctagagctacaagatttttcgactccttaaaacctcaatgcaaaaataatcaagttgcacataccaatcttgaacatagtagctaagaaagtgtaatcgtatgcacatcttgaaagccctctagaaaatactattctgaaaaacatcaaataaaataatgcattaattcaagaattatttcaaaagcgcttaaactagaaatacacttattcacatgtaagcttaagaaatgaatgaggtcacataatttacaccattacatatacacaaatcacttgttattcaaaatcaagagttcaacggttcaaccattaatttctcctactttgtatagctttattttaataactattgacagaataatcctgctcaggcttgaaaaatagggaatggcaaaaaatagccaatgccaaccctaactaatgcactataattaaggtttcattgtcacaaccaaggttattttcacaggcagcctgtttcaagaacccaacacagatctatgaagtgtattaatacacctaattgatcatcctcttcttcaactgttatggacattctcaaatgccaactctccatctaattctctaatagaatggtcaatccagcaatcccatgtagcctgcaggcctagcaaattattttaaccaggtaacccaatgagctatcttcacctgccactcttccatcaaaggctgcccatcaacaaacaaccacagagaacatccaaaggaatgcacgaaataaggatatctgaacattctcatatgccatgtatgcaatcacatatccaggggaggatgttagcactttaattttcaaattcatgcaaaagatccacgaacaaaaggtgaaagcagcagagatgtgaatgctgaggtggatgtgcggtaaaaggatgatggacatgatcaaaaattagaagttaaaagaaaagctaggggttgctcctctatctgctaagatgcgcgaaaatagactaagatggtttgggcatgtgtaaaaaaatgttattagtggctcccgtcagaaggatagaaaccattatagtggagggtaagaggagccgaggaagacctaagaaaacgtgggttgaacagattaaggacgactt

SEQ ID NO: 782 - DNA, 5510 bp, Amaranthus palmeri
aatttatatataattaacttacacttttttgctaaataatatgattttttagtgttttttttgtaaagaagattaaatattaacaataaaaaacaaaagatgtattatattacgctttatgtcttaagtttttaggagctcatttttatcttttgctctggggcccaaaaataaacgaaacgactctgttctcactattatatacggggaatcaaaccaacaattagtttttgtgcagtatactccatgtgtaaacatttataaactttgaacaaatagatcctatgttgtttggcattacaccttggttagatcacaagttgtacatagtcaactaaggctatcaagaaaagttgtgcaagaacaaacataaatcaggtagaatatactatcaaataaaaattgcttataattacttgtctatttcgctttctagatattagtaaaattaaaattaatactttcttcgtttttttcaaaatgttgtatttgctttttgagtatcatcatcaattattctttccggtcattgggatgatttcgggtcaagtgtttcaggtcggttcaaaattgaatttagtgttcacattggttttaacataattgtaaatcgtccatttttaatcgggtcaaatcgggtttggttataaagtcgggtgtctatcgggtcatggggtctgttttgaacacctctattaatttgtaatttattcttagtctttaaattataagatgtattattataagatgtattaatatatattttttataatttttaattataaacaattaaagatattaaaaattaagttagtgaattgacaaacaagcaaaaggcaaatgaaatgtttaaaataaaacggatggagtactattttttagtaaaaattagatatttgttaataaataaagagagaaaataattatatggattaatttaaaagagttaaaaactatgaataagattatatgaatagcttctcttgtgagaaaccgtatctcaaagagacggccccaaaacaaaaaaatctttattcttatttttctctttaatttgtattaattaagctatttagctcatatgtaaaatgcatctctagagagattgacgctcccaaaaatttgtgttaatagaaaataatgagtgttagtggtgagccaatatccagaaataaaaatgattcacaacaaaataaacaatccaaaataaaaaataatgttaatgagaattgagaagaaaaataattaattattaattgcttaagatagtactatgatcccgtgacgccgtagacagaaatgtgtccatttccaacaagcttgattttgtatctttgtcgttataattatgattgttataaataatgatatttttctatgggaaatcggaattttttatgcttttaattgtacttttattatgcttctaatactcataacattggtttttattttatgattttttaggtgacttgtaactacaataaatttgttgttttttatggattttttttatgaactgatatgtttgtatttactggatttaatttagtataatactataaatttttcatctagaattttgcttttcaaaatttgaattattgtgatttttcgaaaaattaaggtaagaccttaaggtttatatatggaatttgattataatttttaggttttagtgtaatttgatattttgaatgcaaaatgtgtacgagaaattaccaagatttaaaagctacagctaagctgtctttactgcatgagcgacatgaatgacggattaggatcttgttattttaaggattttaaaaaattattaaattcgattttgaattaaatattaaaaaatataatgttgtagacttgtagttatcaacatatgtaaatcttcatatgatctatgtcaaattgtcaatactttttcataattgtcaataattttttttattgtaactaagtattgttattattaattcctatcaaaaaatagtgctattaccattttgttgtattatatcttaaattgatttaacagattaatagtttatttaataaaaaattattattatcactttaaaaatagatcgcatacatatttgtactaaaaaatctcatatattaaattcgtcaagggccttcaaaaattcggagatcggccctagatacaagagaattaattacgttacaaaggttacattgaaagtgttttaatggagtactattggatatatgtaaattagaacacaaagggaaatgattcttccataaattaattacacttccacataattttgatcaagtaaaaaaatagcaattaagtagaagcgtcttttttcggttaggatattttttagtggttaggatagttgcaggaagctgttgtttttgaagatcctttgcagatgagggactttttgatagcactctcctatatagatataagctgtcgtccatctttcctcctcatatcctaaccatagtttgtctatgaacgggatacactgaatatgatgatgatgataaaaatactagtatttaattaatggtaatcacatattttggaagtcaataagtttagcacattctaaatagaactgattagttgcaatgggcttcaagctatatgatccaaatcaacaaaccaaaagtatttgggccacggcccacgaaacaacatacatcaagcttagaagttagaaatgaaaaaactactcttgtgagagaccgtttatcaaataaacgatctcaaaacaagaagccaacattcttattttcctttaattaaatagctcatatatctaatgtgtctctcaagctgagggattctttaaccacactatcttctatgggtataagtgtcgtcgttcttccccagtctcacaaaacttaagtcctatattggaaataaatttatctttctcacaaattttacaatctctattactttgaaattgcaacgtgtagcaatttagaatatcttaatttctttgttattgtgatgataaattcagaatttctattctagtctcactcgcaaattcaatctcatttgatcttatgacttatcatattgctttccatcaattagttttttgactatcatatactaaaaattttaaaaaattgtagaagacagaagttgtgtaattgttttgtcattaacaaagcagtcaaagggctttaaataaaacttctttagttccttaaagaagttctcactttcaattttgggtgtttcatttattgtcccgattagaaaacttttcaatcatatcacaaatttattcataaataactttattcatcctcgttttaatattttaataatgcttatggtcttcacataactttcactaacttcattttaatatttttatatttcttatgatcctcacatgcttctcactaactttataaaaacatcttttagttgtggtctccaaatttttccactaactttcttttaatattttttttaatatttatactcatcgcttttcctctatcaaatttattatttaataaaataatatatccacaatctaaaagattctatctttcttaattcatgtgaacattctttatgagaacttcattaaaaaacggtgagagtacaaaacaatctcttacaataggtaattaaataatgaattcctaaagatattaatgaataataagcaaattaaaagattgtttacatgaatagagtataagagcaatatatggctataagaaaaggtgtagataagaaagaaacattattttacaagatatttcctcaatacaaaaaaaaacaaattttatttacgacaatctcaccataacacaatttgcttgagaggaatccaaaagctctatttttaagtccatcacggcccatcaaaataatgacgacataggtctctcagctcatctgctcacaacttgaacaacaaaaaacccattttaaacttcaagaatgcagacgctgctttttccggctactcgctccggcgttcctccaccgtcaccaccgccatcgacgatggcacaattacgtgttccgaggcaaatactaagctttggtcggttcttatctcctccaaattctatctccgctttatcgttgtcttcttctcaccttccttctatgttcttaacaaaatcgttaaaaatggtgcaattgattcctcgaatggcgacttctcctacatctaccgattacgcttcacctgttgatgaaactgaccagattaaactcgctcaggtcagttatcttgctttgattttcttttaattttctaggttttgagctcgcaagttcgcatttgagatttggcatctttatgtagcttaaattataagctagtttgtttcggtagtgcaatttatgttaattttttaatttaagtgtttatattgctcaatatcgcgcgatattattgtatcatgtttttgtattgttcattgttcatttagctagttggaaattgtttttggtttcaaagctgtaatccaatttcgagacatttgtaaattaggtttttattggttttataccctaatatgcttgcatcggtgaggtttggacctagatcgttggcatttagcgaatgaattggaatttgcctgaaaacgttgaagcaaccttgaatctacagctttagattgttgatattgaatttattagaattggaaataatttattagagctggacttgattgaactatatgttcgttagaacttatattattatacttattaagtagtaaaaattgtgaaagagaggaatcgaaggaaaaaccttatatgtatgtgcacgttattttattatgctgcatactgtgaaattggcagtctagttctgtagttatccgtaaggtgctgtgcaatattcagaaggttggagttctctctttgaagtaaatgcaaacatacttcattgtaggtacactatccctgaaatttataagttagtcgtagttacatgaatctgaatcttctagcattgctgccttagccgtttacaataattcgtacttcattgtctaaataagatttgcgatcagtgtctagtattaatttaagagttccttaattctgtaccctaaaagtttgacatgcttgcttactaactcgtatgctaatgtaccttgtctttgccttctctatttttcatcatattttgaatttggtgcaggttgctaaaagactagaaaacacagcgagatatttcaaacggttgggtacttttggattctgggcacagctagtgtgcacacttgttgctgctgtgattctttcgttttctgttttaatcaccgggaagatgacatcgccagctactttctatgctacagctggtggaatcgctgctgcgtttatatctattttttggtcatttggttatattcggctgtcagagaaactacggagaacagcaaatgacccatcaaaggtaggatcaaagcaaaaagtaaatgttaaccactgatggagttgaaatcttttaacgtaataacttcgtata

SEQ ID NO: 783 - DNA, 1200 bp, Amaranthus rudis
ggccattacggcccatcaaaataatgtcgacataggtctctcagctcagctgctcacaacttgagcaacaaaaaacccaaaagaaaccattttaaacttcaagaatgcagacgctgctttttccggctactcgctccggcgttcctccaccgtcaccaccgccattgacgatggcacaattacgtcttccgaggcaaattccaagctttagtcggttcttatctcctccaaattctatctcctctctctcgttgtcttcttcccaccttccttctctcttcttaacaaaatcgataaaaatggtgcaaattcttcctcgaatggcgacttctcctacatctaccgattacgcttcacctgttgatgaaactgaccaggttaaactcgctcaggtcgctaaaagactagaaaacacagcgagatatttcaaacggttgggtacttttggattctggggacagctagtgtgcacacttgttgctgctgtgattctttcgttttctgttttaatcaccgggaagatgacatcgccagctactttctatgctacagctggtggaatcgctgctgcgtttatatctattttttggtcatttggttatattcggctgtcagagaaactacggaaaacagcaaatgacccatcaaaggctccccctcgtgctgatgtcgtcaaaagtttgaaaaatggaataattttgaatcttcttggtatgggctctgcggtcttgggattgcaatccactgttggattactggttgcaaaggctcttactacatcaacaactcctttctatcagggtaatcctggcgcaagccctgtccttgctttggacgtatttgtggtccaggcatcagctaacactttactgtctcatttcttcggacttgtttcctctttggaattgttgcgatcagtgacatcacctagcggtcaagctgctcctgttgtcaagacggcctaggccttttcgagcatttcatttcaacattatacacgaaggttctcgatacttttctagttctagtcaaaagccgaatgtgggctgatgaatcttttattttattgctgttgataattgtgcagtatgtgaacaagagctgtgcctgtaatcatgaaggctattagggtactgagaactagagtattttgttcagcgcctaaaactcaactgaacagcacatcttatgtttattagc

SEQ ID NO: 784 - DNA, 467 bp, Amaranthus rudis
taaccatttatttcataaatctgcaaattgataatcttctctattgttttctcttgttttcctacataatccttttcaagttatggacttttttatttgattgtcaaataaagaactgaaccttggatactcaaatatttcttatgatcaacttcaatgaagaaaatttatcataagtttttatgatttcaggctccccctcgtgctgatgtcgtcaaaagtttgaaaaacggaataattttgaatcttcttggtatgggctctgcggtcttgggattgcaatccactgttggattactggttgcaaaggctcttactacatcaacaactcctttctatcagggtaatcctggcgcaagccctgtccttgctttggacgtatttgtggtccaggtaagtcttgaactacttgtacggagataattaaatcatgtatatatgtgtaccctatattcagttgctcacaa

SEQ ID NO: 785 - DNA, 259 bp, Amaranthus rudis
gttgtcttcttcccaccttccttctatcttcttaacaaaatcgataaaaatggtgcaaattcttcctcgaatggcgacttctcctacatctaccgattacgcttcacctgttgatgaaactgaccaggttaaactcgctcaggtcagttatcttgctttgattttcttttatatttctaggttttgagctcgcgagttcgcaattgagatttggtatttttatgtagcttcaattataagctagtttgtttcagtagtg

SEQ ID NO: 786 - DNA, 534 bp, Amaranthus rudis
agatatttcaaacggttgggtacttttggattctggggacagctagtgtgcacacttgttgctgctgtgattctttcgttttctgttttaatcaccgggaagatgacatcgccagctactttctatgctacagctggtggaatcgctgctgcgtttatatctattttttggtcatttggttatattcggctgtcagataaactacggaaaacagcaaatgacccatcaaaggtaggatcaaagcaaaaagtaaatgataaccactggtggaattgaaatcgtttaagcctcttttttccaatgttgtatggacacatcttcaattctgattctacgtttacagaatagtacatatggcaaccgaactatatttcccttctgtttattatccagttagtagaatcactagaaagcctagggtgtgttcttgatacgattgttgtcatttatattttgttagcttcagaattcctctcagaatgactgcagtacatggaaattggaatactatttaaactttaggtcacaaatatc

SEQ ID NO: 787 - DNA, 1097 bp, Amaranthus spinosus
aacttgaacaacaaaaaacccattttaaacttcaagaatgcagacgctgctttttccggctactcgctccggcgttcctccaccgtcaccaccgccatcgacgatggcacaattacgtgttccgaggcaaatactaagctttggtcggttcttatctcctccaaattctatctccgctttatcgttgtcttcttctcaccttccttctatgttcttaacaaaatcgttaaaaatggtgcaattgattcctcgaatggcgacttctcctacatctaccgattacgcttcacctgttgatgaaactgaccagattaaactcgctcaggttgctaaaagactagaaaacacagcgagatatttcaaacggttgggtacttttggattctgggcacagctagtgtgcacacttgttgctgctgtgattctttcgttttctgttttaatcaccgggaagatgacatcgccagctactttctatgctacagctggtggaatcgctgctgcgtttatatctattttttggtcatttggttatattcggctgtcagagaaactacggagaacagcaaatgacccatcaaaggctccccctcgtgctgatgtcgtcaaaagtttgaaaaatggaataattttgaatcttcttggtatgggctctgcggtcttgggattgcaatccactgttggattactggttgcaaaagctcttactacatcaacaactcttttctatcagggtaatcctattcctggcgcaagccctgtccttgctttggacgtattcgtggtccaggcatcagctaacactttactgtctcatttcttcggacttgtttcctctttggaattgttgcgatcagtgacatcacctagcggtcaagctgctcctgttgtcaagacggcctaggccttcttgagcatttcatttcaacatcatacacaagaagattctcgatacttttctagttctagtcaaaagccaaatgtgggctgatgaatcatgtattttattgctgttgataattgtgcagtatgtgaacaagagctgtaaccatgaaggctattagggtactgagaactagagaattttgttcagcgcc

SEQ ID NO: 788 - DNA, 1133 bp, Amaranthus thunbergii
ctgctcacaacttgaacaacaaaaaacccattttaaacttcaagaatgcagacgctgctttttccggctactcgctccggcgttcctccaccgtcaccaccgccatcgacgatggcacaattacgtcttccgaggcaaattccaagctattgtcggttcttatctcctccaaattctatctcctctttctcgtcatcttcctcttctcaccttccttctctcttcttaacaaaatcgttaaaaatggtgcaattgcttcctcgaatggcgacttctcctacatctaccgattacgcttcacctgttgatgaaactgaccaggttaaactcgctcaggttgctaaaagactagaaaacacagcgagatatttcaaacggttgggtacttttggattctgggcacaactagtgtgcacacttgttgctgctgtgattctttcgttttcggttttaatcaccgggaggatgacatcgccagctactttttatgctacagctggtggcatcgctgctgcctttatatctatattttggtcatttggttatattcggctgtcagagaaactacggagaacagcaaatgacccatcaaaggctccccctcgtgctgatgtcgtcaaaagtttgaaaaatggaataattttgaatcttcttggtatgggctctgcggtcttgggattgcaatccactgttggattactggttgcaaaggctcttactacatcaacaactcctttctatcagggtaatcctattcctggcacaagccctgtccttgctttggacgtattcgtggtccaggcatcagctaacactttactgtctcatttcttcggacttgtttcctctttggaattgttgcgatcagtgacatcacctagcggtcaagctgctcctgttgtcaagacagcttaggccttcttgagcatttcatttcaacattatacacaagaaggttctcgatacttttctagttctagtcaaaagccgaacgtgggctgatgaatcttgtattttattgctgttgataattgtgcagtatgtgaacaagagctgtaatcatgaaggctattagggtactgagaactagagtagtttgttcagcgcctaaaactcaactgaacagcacatct

SEQ ID NO: 789 - DNA, 1250 bp, Amaranthus viridis
gtctctcagctcatctgctcacaacttgaacaacaaaaaacccattttaaacttcaagaatgcagacgctgctttttccggctactcgctccggcgttcctccaccgtcaccaccgccatcgacgatggcacaattacgtcttccgaggcaaattccaagctattgtcggttcttatctcctccaaattctatctcctctttctcgtcatcttcctcttctcaccttccttctctcttcttaacaaaatcgttaaaaatggtgcaattgcttcctcgaatggcgacttctcctacatctaccgattacgcttcacctgttgatgaaactgaccaggttaaactcgctcaggttgctaaaagactagaaaacacagcgagatatttcaaacggttgggtacttttggattctgggcacaactagtgtgcacacttgttgctgctgtgattctttcgttttcggttttaatcaccgggaggatgacatcgccagctactttttatgctacagctggtggcatcgctgctgcctttatatctatattttggtcatttggttatattcggctgtcagagaaactacggagaacagcaaatgacccatcaaaggctccccctcgtgctgatgtcgtcaaaagtttgaaaaatggaataattttgaatcttcttggtatgggctctgcggtcttgggattgcaatccactgttggattactggttgcaaaggctcttactacatcaacaactcctttctatcagggtaatcctattcctggcacaagccctgtccttgctttggacgtattcgtggtccaggcatcagctaacactttactgtctcatttcttcggacttgtttcctctttggaattgttgcgatcagtgacatcacctagcggtcaagctgctcctgttgtcaagacagcttaggccttcttgagcatttcatttcaacattatacacaagaaggttctcgatacttttctagttctagtcaaaagccgaacgtgggctgatgaatcttgtattttattgctgttgataattgtgcagtatgtgaacaagagctgtaatcatgaaggctattagggtactgagaactagagtagtttgttcagcgcctaaaactcaactgaacagcacatcttctgtttattagccttagctagagaagccgttctctgtaaacaaaatgttcaacgttccgtatattttgttcaagagttatctgtaagcattctgaatccttt

SEQ ID NO: 790 - DNA, 383 bp, Ambrosia artemisiifolia
ataattgcaggcaggtgcaaacacgattctgtcacatttcttgggacttattttctccttggagctgctacgctcagtcacagtaccaccttcagatttcatcgcggttcctaaggcagcataagcgtctccatttgcagacgaaataaggcttgatttaggttcccggttggttaaacaagccgtgtttgttggttgatgccagttgatggtaattaattttttttttaaattcagctagggttgtagcattttcttctcatgagtcagatatctgtagtgaattcatatgatattttgtttgtaataagaaaatctcatcggaatatcctacctagtcgacattcgagtatcaaatgagcgtctaatagacaaaccgtaag

SEQ ID NO: 791 - DNA, 482 bp, Ambrosia artemisiifolia
agatttcaggataataggattgattagcataatttaggttcttttttaaaggcaatgtgaattgcatgattctttttctgttgtcaaactagagaacgttaagataatttttctatcatctaactcattatagaatgcgcctatctttttcaggctcctccacgtgctgatgttgtaaagagcttgaagaatgggatagccgtgaaccttttgggtatgggtgctgccatccttgggatgcaagccactgtaggactgctggtggctaaggccctcactacttcgtctaacccgtattaccagggtatctcacccgggactagccctgtccttgcattggatgtgttcttggtccaggtattccttgcgtttcattcaagctttgcatatctagccttaccatcaattattacagtatctatatctatactcaattgttatacaaatacaaaatacaacttttaaaacatattgttgacttt

SEQ ID NO: 792 - DNA, 532 bp, Ambrosia artemisiifolia
ggattgttgtgtaggttgcaaagaggttagagagtacttcaaggtatttcaagagactgggtggtttagggttttgggggcagctggtttgtacgattgtggctgcggtgatcctttcgttttcggttgtgattacggggaaaattacgtcaccggctactttctatgctactgctggtggtattgtggctggtttcctctcggtgttttggtcttttgggtatattcgtctttcggataggcttcggaagaccgctaatgacccttcaaaggtatttttttaatcagttttaaggttttaatttaatgcaggattgtatggtttgcaagctacatcgttacgttatctttttgcaatttaacaactaaatactaatatacaatacgacctgtaattgtgtgtttacaactaagtaattggttaaaaaggactggttatataactacacaagaagtggtcgggtcatgggttcaatatttttagaaaacctgctttttggtccggtctggaaccataacgcctgagatcaac

SEQ ID NO: 793 - DNA, 1121 bp, Ambrosia trifida
acaactctatctctccaccactctcctaaactaaactaaactaaacaccaatccacatacaaaatgcagacctttctactgccggcagctcgttccggcagtgcaccgccgttgacggcggcgataaacccaaactccaccgcccttatttcccttcttcacattcatcacccattaatctttcccttccctctttttctttacacacttacagaaacccaatcaaaaccccttttctttcttcagctcccatttctactgccaataataatttacccactgatgattctgaaaaagctaaacttgcccaggttgcaaagagattagaggctacttcaaggtatttcaagagattgggtagcttagggttttggggacaacttgtttgtacaattgtagctgcagtcatcctttcgttttccgttgtgattactggaaaaatcacatcaccggctacattctatgctactgctggtggcattgtagctgcgttcttctcggtgttctggtcgtttggttatattcgcctttctgaccgacttaagaaaaccgccaatgacccttcaaaggctcctccacgtgctgatgttgtaaagagcttaaaaaatgggatagcagtgaaccttttgggtatgggtgctgccatccttgggatgcaagccactgtaggactgctggtggctaaggccctcaccacttcgtctaacccgtattaccagggtatctcacccgggactagccctgtccttgcattggatgtgttcttggtccaggcaagtgcaaacacgattctgtcacatttcttgggacttatcttctccttggagctgctacgctcagtcacagtaccaccttcagatttcatcgcggttcctaaggcagcataagcgtctccatttgcagacgaaataaggtttgatttaggttcacgcttggttgaacaagccgtgtttgttgcttgatgccagttgatggtaattagttttttttttttcaaaattcagctagggttgtagtgttttctttctcgtgggtcatatatctttagcgaaattatatgatattttgtttgtaataaaaaaatctcatcacatccatgaagacaaagaaaaccatatttg

SEQ ID NO: 794 - DNA, 233 bp, Ambrosia trifida
ttttcaaaattcagctagggttgtagtgttttctttctcgtgggtcatatatctttagcgaaattatatgatattttgtttgtaataagaaaatctcatcacatccatgaagcaaagaaaaccatatttgtatccaatggtggattgccttccatcagaatatccaacctggtcgacattcgagtatcaaataagcgtctaatagacaaaccattcttacgaaagcttaaggc

SEQ ID NO: 795 - DNA, 295 bp, Ambrosia trifida
  unsure (1)..(295): unsure at all n locations
gccattctcgggatgcaagccactgtaggactgctggtggctaaggccctcaccacttcgtctaacccgtattaccagggtatctcacccgggactagccctgtccttgcattggatgtgttcttggtccaggtattccttgcatttcattcaacctttgcatcatatctagccttactatatactaagttattatacaaatacaaaggactaaaaggtaattttacttttaaaacatattgttgactnnnnnnnnnnnnnnnnnnnnttttaaacgtccacaactttttcatac

SEQ ID NO: 796 - DNA, 391 bp, Ambrosia trifida
tgttttcgaaaagattatgggccaaagtttcgattgctccgcagcaaatagttctcatcgctaaccacatttggcacaaatatagtatttcgcttaggttagaacactgatatggaacaactgcagaacggctttaatgttcatgaatcatgaatcaaccctgataagggctgctcgacagttgtagaaaatatagaacaaaagagttgaatgcaccattaagcacacatataagataatttttctatcatctctatctcattatagaatgcgccgatcttttttcaggctcctccacgtgctgatgttgtaaagagcttaaaaaatgggatagcagtgaaccttttgggtatgggtgcagccatccttgggatgcaagccactgtaggac

SEQ ID NO: 797 - DNA, 297 bp, Ambrosia trifida
ctcttaccacaaacttgtgtctcgaattttgttaaaattttcaattcgataactgcaggcaagtgcaaacacgattctgtcacatttcttgggacttatcttctccttggagctgctacgctcagtcacagtaccaccttcagatttcatcgcggttcctaaggcagcataagcgtctccatttgcagacgaaataaggtttgatttaggttcacgcttggttgaacaagccgtgtttgttgcttgatgccagttgatggtaattaatttttttttctttcaaaattcagctagggt

SEQ ID NO: 798 - DNA, 303 bp, Ambrosia trifida
tgggagcaggctacaaatggatgcatttgtgagctggtgaatgagtgaatccaatagtaatattaggatgattatgctcactgataagaaagttaaatctttatattgtgaacaagagttatgcggtgttgctaaaaacgatatggttgtggtttgaaatgttgtgtaggttgcaaagagattagaggctacttcaaggtatttcaagagattgggtagtttagggttttgggggcagcttgtttgtacaattgtagctgcggtcatcctttcgttttccgttgtgattactggaaaaatcac

SEQ ID NO: 799 - DNA, 285 bp, Ambrosia trifida
ccctctttggaaagcaagaagaccaaccactctatctctctaaccagcctcctaaacaccattccatataccgaaatgcaaagctttctactgccggcagctcgttccggcagtgcaccgccgttgacggcggcgataaaacccaaactccaccgcccttatttcccttctttacattcccaatcacccattaatctttcccttccctctttttctttacacacttacagaaacccaatcaaaaccccttttctttcttcagctcccatttctactgccaataat

SEQ ID NO: 800 - DNA, 372 bp, Ambrosia trifida
gttgtgattactggaaaaatcacatcacccgctacattctatgctactgctggtggcattgtagctgcgttcttctcggtgttctggtcgtttggttatattcgcctttctgaccgacttaagaaaaccgccaatgacccttcaaaggtaccttttttctccttttcaagtttaaggtagtttttataaaattaacaacttggtaaatagtttattagttctagcagttaagatggttactcatcgacactcttgctatttgttcattaccctttcatcacaatgattgcatgctaagctaaagtaagatattagtttagtaaatcctagaaggttagaagacctcataggagttaatcaagtaactgttga

SEQ ID NO: 801 - DNA, 519 bp, Chenopodium album
ctgcttttaccggcggctcgctccgggttccgccgccgtctccggcggtgacaaaggcagcgcatttacaccggcgaataccagtctctactcgctttctctctcctccttcgtcatcatcgtcttcttccttcctttctctctcctcaacaaattcgataaaaatggtgcattggcttcctctaatggcgtcgtctcctgtttccactggtttctcttctcccgttgatgagtctgatcaggttaaactagctcaggtggctaaaagactagagaaaacagcgagatatttcaaaaggttgggctcattcgggttttggggacagctaatatgcaccatcgtttctgctgtgattctttcattttccgttgtagtcactgggaagatcacttcacctgttacattctatgctactgcgggtggaattgctgccgcatttatttctgttttttggtcctttggttatcttcggctatcagagaaacttcgtaaatcagcaaacgatccttcaaaggctc

SEQ ID NO: 802 - DNA, 472 bp, Commelina diffusa
ctagtatgcacccaaaaaattacattaaaaaaaaatcactctctttctacaatgcaggcgctcttgcgcccgccggccgtccgccacgtcatctccgccgccgccaccggccgccacgtcatctcatccgccggcgaacgccacgtcatctccggccgacacgtcatctcggccgccccattttgcttctcacctcgccggccgttcgaaaccctagcgccggccgccaagtgggccccactcgccggagtcgtcgccggagcggccgccggctcgccggcgtttgatgtggagtccgagagggccaagctagccctggtttccaagaggttagagaaaacctcaagaatctttaagcgctggggcagtcttggattttgggggcagctagtatgcactcttgtggctggtggaattctgtcattctctgctgtgataactggctcaatcacctctcctgtaacattttacg

SEQ ID NO: 803 - DNA, 547 bp, Convolvulus arvensis
tgcaaacactacttttgccggctgctcgctccggcagcgcactgccacctttaccggtggtggcgaaaccctcgccgctcaatcttctccaccacaaatagttccccacttcgtctctcgttatcacacactctcactcccttacagagtcaacattttctctccccaccgcatctaactctcaattacagaaggattagaatcctcgccgcgacgaacgttattcgaccgacgattccgaaaaagcgaagctcgctcaggttgctaagagattggcgagtacttcaaagtatttcaagaaattgggtggctttgggttttgggggcagctggtttgcacagttgtagctgctgggatcctttctttatctataggtatcactgggaagatcacatcaccctttacattttactcaactgctgctggaattgttgcggcttttgtttctgttttctggtctttcggttatcttcgattgtctgcaaagcttaaagagaacagccagtgagccttcaaaggctcctccacgtgctgatgtggtgaaaa

SEQ ID NO: 804 - DNA, 1232 bp, Conyza canadensis
gagagaaaactttggaaagcaagaagaccactctatctccacatcaccagtaaattcccaaaaatgcaaactttcctactgccggcagctcgttccggcagtgcaccaccgccgtcaacactaactaaacaacactcatcaccgaatctccggcgacctctctccgccctaaagtttccatctttaccaactcacacccccctttcattcacacctttttcactacaaatttatcagaataataatcaaatttcaagaaaccccataactaaaattgcttcagcccctatttctgccacctataattccccaaatgaagattcagaaaaagcaaaacttgctcaggttgcaaagagattagagagtacctcaaggtatttcaagaggttaggtagcttaggattttgggggcagcttgtttgtacgattgtagctgcggttatcctttcgttttcggttgtgattaccgggaagattacgtcaccggctacattttatgctactgctggtggtattgtagctggtttcgtttcagtgttttggtcgtttggttatattcgtctttctgacaggcttcggaaaactgtcaatgacccttcaaaggcacctcctcgtgctgatgttgtgaagaacttgaaaagtgggatagtcatgaaccttttgggtatgggtgctgccatcctggggatgcaagctactgttggcctgctagtggccaaggccctcacaacatcatctaacccctattaccagggcatctctcctgggaatagccctgtccttgcgttggatgttttcttggtccaggcgggtgcaaatacaatcctatcacatttcttgggacttgtgttttctttggagttactccgctcggtcacagtaccaccttcagatggcatccctgttcctcgggcagcataagctttttcacttgcagactgaacaaggcttactttaggctggtgttacaaacaatgagtggctgaacaagccttttgtgttgcttgatggtagttatatcttttgctctgaaattgaacaatttggtagacattgtgtagtgtgctttaaccaaggtctagtgatctcttcccaagagtaagaaatttgttgcatatatatacgttttcagtgattttgtaacaatctttctttccaaataagaaaatggcagttcatacatcaaaaaaaaaagaaaaaaaaacaaaacatgtcggccgcctcggtctcta

SEQ ID NO: 805 - DNA, 16388 bp, Conyza canadensis
  unsure (1)..(16388): unsure at all n locations
agaaaggaaatggaaaagacttctcttttttgtttgcaatggagaaagggaatgaaaaaggagaaagaggaattgatttcattctctccattctctacaaattgtagagaatgggtgagaatgaaattttatttttatttttaaagatgttatatgtaataaatgtattattatttaaagttttattttttttatatattcattctctgtgggtacttaacaacgaaatccattctctttccaaatactcattctctttctcgctattttcattctctattacatttccattctctatgattccttcctaccaaataccatcttaagttacaattattgggccaaagtcaaaacaaccaagagtaattacagataacgtttattgtttatataggcttctgcaaaattcaggctgacccggttatccccacaactttatccgataccggcctatgcccgacctgcctgactagcttccagaactccggtctacttctaagggccagttttattcagttttgggccgatccggtgcaaaatctaacttaccggcccattgacccaacctatagtttacaacattatgtttttcaacaggctagtagcccacatggccacatccaagcctatgtcaaaagtatatatatttgtactccgtattattgttaggacataatcaacatacatgtaggggttggttattgtaaaacaagtattaaactaaaataaataggataagatcttgatcgttagatcatgataaaattgatgcatgcaaattcacgaaacacgagatgcatgatgattttcatgatgcacggttatttttaataaagagaaatatattgttttatttgtttnnnnnnnatacttgttttattttacctagaattcatacatgtacgtatttattttcttggcaaagggagatgccaaatgccgaaagaaaccacacaacattcaaaccaattttatgttatctaaaataaagggctttcaataattttataggagtcctattaattaggaaggaacacatttcatctctatctctctaaaactataaaggtataatcaattctcaaatacaaaattgtgattacaaaaataaaaatattcttaaactttgaaaatatgagtgttgcatttatcgatggcccaatggttcaaaagttcgtcgataattctgaagcatttgaaaaatgcatcgaagaacgatttaacgtgttagacgtcaataaagatggagttttgtcacgggatgagctccaaaacgagatcaaagatccgtcatcggttgaattagagttgcaaccaaaagaagaggttgattgtctatacaatgcaatatttgagaaatttgatgctgaaaagaaaggaacactcggccgcaaagagtttggttcgttaatgaaggaagtcatgcaagccaaggctcaaggttttggtaatacacccgtatgcattattcttcaagaggatagtctgcttcaaaaggtggtttaatatcatcaatctatcatatgtgattgaatatttgacgaaatcactcgttttagggttaatttctttggtatgccaagtagagaatgtatacccgatccttattcggcctcactattaatatattgttgtaaatcaattaagaagacaagattcgtttatttgaataacagatacctacacatgtacataactatgtatactattttaacttgatcctacaaacttgcttaattttcggttctaatcctaaaatagtcattcgtataagtgagccatccctatctcaagatccaaaatcgcttaatcaattaggattgaattgacaatcgatcagtagccttcttgaacgtgttacgggtccatgtatcatcaaaatctatattttcatgtgtaaaactttctacagattaaaagataataatggtattcatgcaatgatgcaaatattcttcctcaaaaagtttttacttaacaaaggttattctcaaataacaatcattttttccccctctttgtgatgatttaactagactttgcttatgacttatgagggtttagccattttcccgaccactccaagttatgcctatgtcaacagaatttgaacatgagatttctcatgagaaactaggatcccttatcactagaccaacttaaaaatttataaaatagacaattttattgtccatatataatgttttggtagacaagatcacaaaaacatatcgacatctagaatgaacataacttatatgatttatgtaaaattagacaaacgcccgcgtgatgtggcggcgacgatgggtggtaacgttggtagcgacgacggtggcaccggcggtagctgtgtggttatcaatctaaaagtaactaatgtaaaaatggtagtgtaattatttttatagttgaatgatgcatgttataaataatttcaaaagtattataagaaaattttaaattgatgaataaaagagagtagttacagtttatcatgttttttctttgaaaactttagaaaagtgaatgttttattaggtaatttagatttagatgatacatggcccaaattaacgtgcattaaaatgatacatggcccaaattaacgtgtataccgagggagtgagggcagttttctaccatccaaagccatatgacattcaaatgcatggtaaatttggaagtgattgatgcacattagtcaatcaagatgtgatatagcgcttgattcatggattgatggatatagctagacttgatcggttacttagaaaagctaggattatatttggatagacgtaaatcttacacaagactattttaaagttttgaccatatatgaatacgacatattttgtcattaaagttgtaggcgatttacgatttgttctacatgttattagattggtgcctgcacgttgtagcgacaaaatagacacattcgaggttttgtgacaatgtttgaggtgggacgtgaaagaaggggggattatgagttagggtttttgttatgtgtatttgatgtaagagagagatagagtctgcaatttttgtaaagattttttagtcatagaatgaaagtacgaaatgtattaagatgaacaataaattaaaaatatcaagttcttaaaagttttcgagatgtcagtttattttataataaagtatatattaaaacattcgtaagattttgtttgttattcacacttatctattatctataatacaatatataaaaattcacgctcgtgtggtaaattatagaaattttatatgcgaaatggcatttctatatttctggccagatccgtggcatcgtcatgatactttctttagttagtatttatcaattgtaaacactaaacactaataaatccacacaacaatagaaatgtttgaaaataaatatttacaccaataaagaccttcaataatctgtgttaagataatcgtgataaaactttcgaaacaacataattcataacctcctaagtttattcaagattatacgtcgccttgaatattattgattttatatagatattagataatagaattactttagatttcagatttggtattttgttcgaacattcaaacagtatatcatttgggaaaatgttaggtaagacatgcggtacctatcttaggtaaaatagagggatgttatgtcaaatttaaggggttatatatgtttatcaaattcaannnnnnaatttgtaactttttttaaagtggtaatacctaagcttaggtaaagtctgcaatacagatcattttcccatatcatatataggaaactttactgtataatggtgaaatcgtacacatatcctaaacaacgattgactatgggcattcggaggaaaaccctaaaatttgttatccaaaagatcgaactcaagatcctgaataaaatcaggaatgtgttgggtaaaatcgagaatcacctctaatttggtgctagatatttgatagataattaatatttaatgagtacaagtcattaagcaggaaattaaatcccaattactctaatcgatcccacgttacatatttctccaaatatataaacagaaaacacttcacacagtattaccaaaccccctccaaaaatctccctattttcccctccaattccaatacattataaaaaccctaaaaaatcatcatgagcgaaacttcagtttacaatgctttaggtggtggtgcaggtaacttcaactattcttcttttaattacactttattattcatccattatatatatgtatatatccttgtatgtatcgactgattgattgattgattttgtataatatggcgattgcagttgcagatacattgttatggaggaaatgttacagtggagtaatattgttgattggatcaactttgatgtgggttttgtttgaaaaagctggatataattttttagcatttcttactaatgcttcactacttttggcttttattctcttcttttgggctaaatctgcttcccttcttaacaggtatcgtgttcttatttttattttaaattttttttttttggtttggataaatgatcggttttaatatgtatgtttgtgcattgaaagttgttaagtatgtggatcgaattgtaaatatgtgtggatgtatgtggatactggcttttcggtctatcggattatggattagggtagttgtaatataagtacacatcgaccgtctaaagggtctttggtctagcggtatttgaggtcacccgttaacctataggttgtcggtattggtcctgtaatgtggatgaatggtaaatatgtgtgatgagtgtgtgtttgcctttaaaataaaataaaaattccacgtagagccgtaaccagtttctatttattttaccgtttaacggtgcattatagttatggagtgaaattactgtgggctgtttttctaatgacgggttttagtagcatcagtttgtttcacaaaagttattttcaggaatttggttagctatatttttattgtagtgaatgcgctttgtgttgataatctgtttaattcgattatatgtgtgtaattgtagacctctacctccaattcctgacctggacatatcagaggaaacagttatagctgttgctgatgaggcgcgagtttgggttaatagcgctttagcaaccttgcatgaaatagcggttgatggaaacttaaagactttattttcggtaccttttactatgaaatttgctgttaacatttctctttttcaagagttctttcaattctacttgtaggcatttgatatatgattgtttaatgtggtttgatttgtcaggctatgtttggcttatggttgatttcttacattggcagcttctttaactttcttacactgatctacattggtgagccattttccttgctattgttccatcttttctatgccatttgacattatctgtctttagacttgacgatatatatattggttttgccacaggtgttcttcttagtctgtcggttccttttttatacgagagattccaatcccaagttgatgaaaagttgatagttgtacacaagaacatgagtatagtattcaagaaagttgatctcatcttacaaaaaatttcaatgtcccaaaagaagcaaaagaagactgaataggctttcggtaagcatgcaaccaccctacctccatttaggaaaacaagtgaaattaagtgtgcatgtttagttggctcatagttttctgagatatgtgtgtagttatgtttttttttgtcaaaagttgctcatgattgcccttccttacactgaaatacaggtgtttattattagggtacaatattgataggattatatctcaagtggttaacttatgtatctgagcctgcaaataaacattctgatttgaggttttaaaaagtattgtattaagcttgcaaccttagtacatgtttcacgggtgacctgtagactaacagcgatgtggccgatgtcatttatgtaacaacaagactatcgtgagtaacttgatcatattatattttggcatgtaaatttaagtgttaattaagtttggtaagttgaaggtaaatattagtttgaaaatggttgagttgatttgtattcaggtttggtagttgactttacgaacaggtcatgccgaaaattgtaaaaataagaagccaaattaattaactttgtcgttttgtgtttgggtcatttcaagtggaagtccactagctacttgaaagaagtaccagttttaagctgtcatgtacacaccacatctttcactatataaagcagcctatactgaactaggtgaaaactgtaacttatgaaagctcttcatagtctacataagttgttgtagtttgcacttccacccgtgtcgaggttgagtgtgtttacttttatgagaagtgtgtggggtatctgtttgtaaggatcaaaaaaatgtttatcactttttccatagctataagtcagaggcagctattgtgactcaggcaccattggtgtatgcgactattttataacttacaactgaaagtgtaccagatagattgaatatttagaaactaaaagtcgtaagcttgattgaggttcgactgaagggtcttgtccgtgtttcattatgtttgattggtccaatcttacacctttctgccacattggcaaaacctagtaattcgataacatctaaaaggtaatggtagaagatgtgtctttactgcttaactgatctacaaatcgataggttgttgaacttgtggtttctcttgttgtgatttttttggatatatacactacataaagtaagttatgtatcctttcttgttaggttctgtaatttgcacaagacttccattcttcaatgtcaactggcttactgtgacttttgaatgttttacctagtgctctcaaatacaaagacaaatatgataattttttacatattagagacatccaggtattgtcaaatcttaaattagcacatatatgctctagatgtaaattgttgtcttcttaaatagaaatgggttatgatgttctttcgaattcttggatattgtgcaaaaaaaaaaaaaaaatcttgttatgtatgatattgactactttcagtgaactgtcattaaggcctaatttgttatgtttatgcttaagtctaatcggttgctaagatatatatttttttgtaatgtttacacttaatgttaactggttgcctttgtttatattcaattgcttacttattattgcttggttcttataacttcatttacctttttactccatcttcaggtttcttgtttgggaattggtaaagtccacataggggaattgacagatatgcttacaaacagatctcaaaggctgatactttgtttttgttaatgtcatacaagtctttttgaaatttctctccaccataactaaacatatgcatgctggaaggttaaacttcaagtctgcaaggcttgagcagttatgtgaattactagtgttacatacttttggtacacgtattataggagaccttttaatggttggaaagaattatagtaattttgtctattgagcttatattgccatgtgttttagttgcttatttgatgctgaaactttaatttcattggaagtttgtatgctaattgttcctttttccctacctacaaccagccaagatcatttatatccccatatctccgcattccgctttaaactcagattatcctcgagcatagttgacccctttcctagccacatcttcagccggtgacaatgtcatgtgtttcttgtccaactccaactttagttgttccttccctcaatctgatttcactcatgacaattaattattgtcattcccaatctcctggcaaaccctttctgcaaccaatgagtgaaccctagcggtcctccaaactcatgacgatcatgcctaattgaggtgatatataatgatgagataggaatttagaatatatgaatcaaatatgactacttgtctagtatagtgatcatcagaaaatgtccatatacatgaattttgtatgcaactttttaaaagaagtgtaacataggtttataatattgacttttagtgatttttttcttattaaaaacaatgtcgcgcaaaattcaaaatgtagtctggttttcaacataggtcttttcgacgtatggacgaccatacccctttttttagaacagttttgtaaagttacaattttttaagtacacgacacgaatttttttttatatgtagagtaagtatgtatctcttgctaatatgagatcaactgatccaagaagtctaaatgtaaatgtattctgaaaatctcgtagatgatatcatatataataaggataaggatgatttgtaagagcatattttaaatgaacatattgtaaaatctgctagttacgaaaaagtatgactggcttatatttcctttattttatgttagaaatgtagttacataatgtgaagtgtagttttagatgattcagaagaatataaataaattgtagtgtacgtgaaatttgaaaattttttttgatacatgtatcaaaaattaatgatgaccggtgtttttaattgctcaatatgctaatataaaatgaaatggtgataataactttgatagtatttaaaatttaaaaatcataggcaagtgttttataaaagaaaagtttaaatttgaaattatacacatactaaaaaccaatgtgccatgtacaagtcttttaatcatgaaaggtacaagttattaaagcacatactaattttaactaaatttcattttaacccttttaattttaacctcataaaatttctatttttttaaaatttttatctcatttataatatactaaaaacctatatgaatgtataagtgttttatgcgtagaatgtacaagttcttatagcacataataatttttatcattgttcagtttacccctgaactttatattcttttaacttttgttccacatcaaaacttttgttttaatttcttgacactaagtttttgggttcttaatttttcatcaaataactttcacgtgattacgattttacttttaaacatttggtttgactatttttatccgtctttatatatatatatcaaagtttttgttttaattttcttaacactaagtttttggattctcaatttttcatcaaataactttcacgtggttacgattaacttttaaacatttggtttgactatttttatccatctttatatatatatatatnnnnnnntatatatatatatgtttttattatataacgttttaatatataataactttctttatcgttacgtcttagtctcatgtaacatttaaatcattaacatanntattgtttatgttcttatacaaaaggtctatacaaatttacaaatcctttgtgccttacaagttcttataacatataataatttttactaattttttcaatcttttaacttttgccttacatcaaagttttcattttcgtcacactaaacttttggatttttattagacaactttcacacagttacggatttacttttaagcatttgttttgattattttcatctatatttttttataaataatgttttttatataataacttttgtcatcattacgtcttacattcttataacatttaaagcattaatatagttattgcatatgtttttatatatttttttactcttttgcatttttttattgctattactacatgtttaattgtatttttaaaattttgaattctaacacataaattttgggagcaataactttgtcgtaaatgttacactacaccatgtattttatttgggaaatgctaaggttgtatttaacgtgcataaaaaaacttgtacctttcatattaaaagtccgccccataatttttatggtaaatatacaaataatttatgcactttaacagacctcattttatttttcacaaggatcaaaaaaagagagaaaactttggaaagcaagaagaccactctatctccacatcaccagtaaattcccaaaaatgcaaactttcctactgccggcagctcgttccggcagtgcaccaccgccgtcaacactaactaaacaacactcatcaccgaatctccggcgacctctctccgccctaaagtttccatctttaccaactcacacccccctttcattcacacctttttcactacaaatttatcagaataataatcaaatttcaagaaaccccataactaaaattgcttcagcccctatttctgccacctataattccccaaatgaagattcagaaaaagcaaaacttgctcaggtatttcatatgggttttttctatattgatacattgtttatatataattgttcataattcaatttattgtgtgagtacattgtgttattattagaaggccaaactacactgaaatgtttccaaatggtacacgttttgttatcgtatgtattcggctacgaaacatttctattttaatgtactaaacacccaaaagaactttactttttcggtatgtgttagtatagaataatatatcatttcggtcatggatattggctttttataatgtgtatgactgttatgttgctatttttttgaaatttatggttgtggggtgtaatatgattttgtaggttgcaaagagattagagagtacctcaaggtatttcaagaggttaggtagcttaggattttgggggcagcttgtttgtacgattgtagctgcggttatcctttcgttttcggttgtgattaccgggaagattacgtcaccggctacattttatgctactgctggtggtattgtagctggtttcgtttcagtgttttggtcgtttggttatattcgtctttctgacaggcttcggaaaactgtcaatgacccttcaaaggtatctttgttataatttatggttctacttattatgtatgatctgctagtggcattgatatgttagtttatagcgacatgagaacaaatttacatgtcattgtttgctttttatgggtgtatctcacaaaggggtaacatggaaattatggttaggagacaatctatggataaaaatgcacagtgaatcagggaaatatatagaacagaacacgtaggatcaaaaaaccgaacctctggactaggtcagtgacaatcacacagaagggctgaagttggtagcctaacttatgacttttgttctaggattgatagttacataagagatacattagtagcgtcgaattacgctaagttttcttacagtattctacaacaatagagtcttggagtaagttgatcacacaaaatttggtgaactggccagtttagtggagtcccgcgagatggcggggcctagaccgtatggcaactatctaagctatacaacttaacaaatagcactactgcactagtagttcagataagtttcttggtactcttgttgatttttcattatgtgttcattgattgttctttttccttaaaatgagttccaagttaaagcaaagatgagtttaataatattaattcctaaaagacctcacagaagttgaacaactaactgactcttgattttgcagtactgcttctgaaatgtcatatgtagcatattgttacttttctttaatatgttgtgtgtcgttgtttgcaaaatatcattatggattctaagatatagtagcagaattaagttattattttccccaccctattgtaaaaaatgaaaataaaaagtatgaatgtatgatgcatggatcaactagatttatcttcactcgttattagaaagttgtcaagaagcgattttagcctccaacatgtagcctagttgatttcaactttttggaaacattagaggtttatcttgatctaatagttatagggttcaacccatgctatgcattttatatgtactcaataagtattagcattctcattttggttttctcatcaataatttgtggtaatttccttcaaagattctagacttatttcttgtagttaccatcaggaattttatagatagaaagaaacctattttgttggagtgatactaattggattaaggacagcttgaaagtcatgtttcattatgaaccatgtggcttaatcaccaacttcatatggaaggaggctaatttgggtagtctagaatgataaactcgtttagcaacaaatgcacgaagaatcagtttagactgtggtgctactaaagcatctctatgttgtatgctacatgtgttaccagtttcttactttcttctgagtgtatgtattcaatcttggttggtatattttgagtgttaagtttcaatcacaaaatctgtgagtatatataaatgaagaaaccaattacatttgcagttaatacatggagatgatttttgtacctcttctaactggtagcaaatgcatttgttgttaaacaatcctattatctagcaatctagcatgcctgaattttagacttttaagttgaatatcaatgctgctagtgaagacataaggttcaaaatgaacaaaggctttttggtggaccttgatacaatccatgtgaccaccaccaaaaacgagtcccttccaattcttttgttgataaaattccttaatgaaaattagaaaaggcatgtatgtgcatctaacttatatcagacaacaagcgttatacccggcggttggccggggataaccaccggacatagacttgaatgcgggtcatgaattttaaaatgccaatcgttaccatcagaccaaagaaaaacacatggttaatcaatacaccgtaagtcttaaaacacaaaactttggtggcgaagtacaaaattgtaaactttattggaagataaaatgagaagctaaaacattgtgaaaataggaaagataacactgtagcaccatgagttcccaacataaaactttaatagtaaaattaaaaagctaaaagatttagtggttaaaatgtaaagcactaaaacattgtcaccctaaaaataatatagaaaaccaaattataagtttttttccaagaaggcaactgcgcaacacgctacaaaaaagaaagaaaaaaacaagcagacaagctgctgaggcagcttccagccaagctgcttcactattcacatgaattctgtttatatagtatataatataatatggcaatgcttttcaggcacctcctcgtgctgatgttgtgaagaacttgaaaagtgggatagtcatgaaccttttgggtatgggtgctgccatcctggggatgcaagctactgttggcctgctagtggccaaggccctcacaacatcatctaacccctattaccagggcatctctcctgggaatagccctgtccttgcgttggatgttttcttggtccaggtatgtttacatgtcaactcaatctttcggatagtttgttttaccatcaattatattagtataaactaatgtttggtgtttgaggtttatagtaattccagctgagaccttggcaccccttgtactcctttgttcttaattctcatggtgcttgatggttgcaggcgggtgcaaatacaatcctatcacatttcttgggacttgtgttttctttggagttactccgctcggtcacagtaccaccttcagatggcatccctgttcctcgggcagcataagctttttcacttgcagactgaacaaggcttactttaggctggtgttacaaacaatgagtggctgaacaagccttttgtgttgcttgatggtagttatatcttttgctctgaaattgaacaatttggtagacattgtgtagtgtgctttaaccaaggtctagtgatctcttcccaagagtaagaaatttgttgcatatatatacgttttcagtgattttgtaacaatctttctttccaaataagaaaatggcagttcatacatcaagcaaacatagccacattcttgtgttatgtccataaagtcttgccatatgtccataaagatagaaaatattgtcttgaattggataagattgatgcttatcgttagcctattgggttttatttttttggttccatctggaacattcttatatttctgtaagaatatatgatctttcagatctgttccatacttccatgtgcttgtgtacaactattattagtcttccatctatgatctacttcaccctggaatttgtcatataagaaagaacggctgaactaagaacaacccttgagaaaataagaattttctttcaactcaagagagatacatagcatttgatagtatgaactctggtgatgtagcattgcaaaattggcagacctatgtagatcaatgctagaaagttacagactaccaatatatgaaatcaaccacaagcaacattagaaatcaatcctatatgatgcaatcatctagcaaatgcttgaaacagtactccaagacagttttcaagtttccatcaactgggatttgatgtatggttgttgacctaaagcggcatctcattggcagtcgcaataacggatctctcttctataccaagttcatgtcttgttgagttggagacaaattaaaaagtgagggttttctttgtttggattactcgcaggggtggagctagtaggggaactaggggtgcttagcccccgccaaccattcatgttttccattgcaaggctagctcatagccaactaatacaaatgtttttttgaagcaagtcaccccagatctataaatgtatgatttctagtcatgacatttcaagtaaaacatttatatttggtccataaaactaaaccatcgcaataaaattctattttactaacattctattaaatgattacgtctttcacattatattgtatacaacgatcgagaaagaattacgattgagcccccctcaacgtgaaatcttggctccacctctaataactagattacataccatttttttactcggatataacgccctaattatgttatcttgtccctggccagttccaaccattttcctgaccatgcctagacatttgtctagggtagtattcaaatatatttgcctagggtatttgaaagtgagttttttttttggaaaacaaaacttcttgttatgagatccgttgatgatgcttttgagttagtcgaatgtctacatcaaatgaatattcaagttttggttttcttaattatatgttccgtttgtcttcaaaacacattttagtgcaattgaatagttttaagttagaatatgaaaatttgtccaaaaagtatcaagtcgaaccataataaattatagaaattttttaagagatatgtaaacgaatcaactgtaaatactatttttttaaagataaataaatgctatagttaaggatgctactaaacttgttaccccgttccaatttagatgtcatagtattttgggtatttcgtatataactttgactttcaattattttgtttgtgttataaaatacttgatgtaaaaaaaaagtgaatggatagagttttaaatgcattttacattgatataactttcatcaagtattgtataacacaaacaataaaattatttacggctaaaattatgaaaaaagactaaatcaaattagaacatttaaattaggacagatgtacaatctaacgaaaatagccaaatcatatgtacaatttactaaaaataacataaagtataaacataatcatacatataattattaaaaaaattaaaaataaaacacatgtacaatttactaaaaataacattaaagtataaacataatcatacatataattataacaagggtcactttcgaataccctaggcaaatatattagaatactaccctagacaaatgtctaggcatggtcaggaaaatggttggaaccggccacgggcaaaataacataattagggtgttatatccgagtaaaaaaaatggtttgtaatccagtaagtcagaggcggagacaggatttcacgttgaggggggctcaaccgtatttctttctcgatagttgtatacaatataatgtgaaagacgtaatcatttaatagaatgttagtaaaatagaattttattacgatggtttagttttatggaccaaatataaatgttttacttgataattattatggtagaagtgtaggtataataagtaaattaattgttaattttgtcattcatcttttatcaatcttcaacttttagtaaattaattttcggattaatttacacttctagcatattattaatccatacagtcacttgcatatatatattattaagagttaattactgaaatggtaccccacgtttgcgccatattactggtttcatacctttcctttcgaaattacgctgat

SEQ ID NO: 806 - DNA, 8547 bp, Cyperus esculentus
gtcacatgaatctgacgagaacgttataaacctcaaaacatgatatttctgtaaacatgaagaaagaacaagggggatatagcttttggattatcttcttggtttcatgaaagcagtgggatttaacaacttattgaacactaaactgttgaattatggaaaacaagcataaacgtgttttgtaaaataacttctattacaggctccaccacgtgcagatgtggtaaaaagtctgaaaaatggaatagttctaaatcttctagggatgggtgcggcagttcttggcatgcaagcaacagtgggcactttagttggaaaggcgctcacaacatcagcagtgccatattatcaagggatatctccaggccaaagcccagttttggcattagatgttttcttagttcaggtatctcttacttctctcaacgaagttgtcatcgtttaggtatcatgaatgctctgcaaaatttggaaatgtcatcttccctagatacaatccggataatatcattcacagtcgtgcatttatattaccagaccatttcatcctctggctaatggaaattagtgagcgagaaaatacattactttgggtaacttttgttgaaggtgaataattgagggtaatttggggaagttttctgaagcgtgaatgtgagaatagtttatgtattgtccatgcaggtcgatttcaaatcagacccattatttgtttcattgaagttaacacattatagattatcagttaacttgttgagacataaccagaaaatgaagtcaatataagatattagtttgtcctatctctatttaaatccaataaggtataattttgaaagatgcatctctagtcctgtcatgtactataataacaggcttctcttatcacaggcttctgcaaatacaatactctcacattttcttgggctagtctcttcattggagctgctacggtcagtcacactgcctcaacttgaagtcacacctgtgccaaaagttgcttgaatgggttttgagtttcagcattctgctatgttttccactaattttgatgcttgttttgaaataaaataataattgtctgtactgagagcagctatatagttttaacatgttctcgctagagagcatattacttgttcaatggcaatttttgttatctgtgtccgtatcgtattctacctcttagatactactgtgagtctcttcagcatgtgtcgacattattacttggtaaaagaacaagttcccaaagaaagagatatacaaactatcacataaaatgattcagcatctgcattcaggtcctctgctgcattgtaccataaagcactgaccatgatctatgcttaatcaatcagagtgcatcgggattcatgtgtatatcttgatggtccgttgctgttttactttctttacaaggttacatattcagatcggttgcctggcctcctaaaacaaagctgctaacttcaagctccatttttgtgtcttaatgattaatgattataaagacgtcttcctagtctcctgcttcagcaaatatttattattaacttgtgacatgactcatacttctattacccgtaatgtaatttgtacattagcatctctcatttcatatatgattgatgatatattgaactttgttgcaactgatttcttggcaaagttacgttttaacattttttgagtcatcctgtaatgaaagctgcactgtgcaaagcagcacgctacactgaatttttaaggggaattggagtatgatctgaatttcaacaactcgacacgaacattgatgaaaagccaacatggtgagacagcagaaatctgcgttagcacttagcacacgatacaaacggggaaattatctaatatcttgcaagattagaatcaacattcttttgacttttcaactgaaattgtatccactcgactcgataatatgacattgtgagtaccagtagcaatcttccaaatacatctgcagcaagttagacagtaatgtcgagcaaaatattctcaatctccaaatacgatattgctccccagccttcaaatcttcgttcgcatacttttcctacctcaataatattaaaatgcaattacattactgacgttcattaatgctgagttgtttttgtgctcagtagttggattactttattgtaaggaaatggattccattccttggtacacaataacatgtaaaaactgctgcttggtttcaatcaaaactggtggtattataccacttttaatcaaaaatatatgcacaccgtcacacataaaacaactcaaaattacttgcatttcttttcttgtcaaggtattaccatgtacaagcaccatgcttgcaacagttaataatcaatcataagaccgtgtatatatctaaaaattttttattactgactgtacttgttctattacaaggctttcaaattaaaaaaaaaaaagaaagaaaaaagaaagaaaaaaaaaagaaactctcactctcttttttcacctaattctctgctctgctctgtagctctctataggaaatttaagaagtcacagcaaaagggaggacagccccttcgttcttgttttttcagccttctctcaatcttgcattgagcagcaaccaacaaatcctgtcaactatacaagtaacaaaaatacagccagagaatagataattcaaaaggaggaaactgtgcatcaaaactaagatactgtcaatccagcccttctcaagattcgaactggcttgatcagctcatcatccatctcacaatctgagttctcaggatctgattgcaccacctccattgtttcaaatgcatatccagtcaagtgagacccacactcatcccttgcgtcatgcaggctaacgaaatccccaaactgcccacgagaaagcaggtcttcacaatttttctcagagttgactggtttggtcatgtctatgctagactcaaagtagcgaggacggctgccaggtttctgcaaaaggctcacttttcttattttggactttgattttatttttggatgataaagtttgcacttcggtcccaggaggcacttccccttttcctcgaactcagggcatgtatagctgtgcttcctacgacactgctaacaaaaaaaaattccacaaaaattctaatatcaaaaaggctaaatggctagagagaagatgtttaaatttttatcataatattcacagggattcaataaaagctgatttattaatggtgtcagatttgcataaccagatggcatatattttcgttttcctatttgtttgggctcagagatgcaatgtagtgaagcacaaactggaacgatctggtatccaaaaaaatctttgagacctacatttaggaaaaaaaatcctttccctacctcatcaccatcagcacagtaaccctttagaaatccctcacatacaggtgctttcggattcacattaacatgtctatatgaacatgtcaaattagtgcacaatcctgcaaaaacaatcacctcatgtgatcaatgagccaacagggatgaatcaatttaaaacaagatggaataaaatataaataagagagcacttgccttggaggaaatatgaacaatctggcattctttcagggattatctgtaaaaagtatgtcagaatatatcatgggtttatctaaactcacatatttattaattttctttttcattttaatttctggagcctttatagttcatcggtcacataatatgattgtctaattccttctaaaaccgtcccattgactcaaacatcaagccaaacagagagcaaaatacaaatctatagcagtaacaattatagcagaaattaactaaagtgcaacagtatatgtgtatatatatacaataatagtaagaataagcaagactattttcaaacctgatgagtaagtttacagtttgtatcaacacaaatgcccctgagaaacttggtgcaaatagcaatcttcgcacgatcatgtatataatggcagttagttttgttgcaccgaccaaatcgagtgtaaaaaacacagtactgttgcttttttcgttttgcatttctcaaagtgtgcaggctcctctgtatcttttcacttgctagtatgcgtaccagccttttcggatctcgtaccaactggttgcctttgctggcccggacatatctgaagagagggaacaaagttcatggagggaataaaatggcataagaatggtagaatttgaggatgcctcctcacaatgatcagagttagaatgacaaaccattcatgaaggcacacaggtgtttttaatttttcagtcaaacacgtaaaaaataattggaatattaggtatactggatttaacatcgcaaacatagttgctcatattcacatagtaaaaacatacccactgcaagcagaaagtctgttaagatgagatcctatttgttttccatttcctgtgtcacctgtagcaaacagagccttcacagctgcaaggcatgtaaaattctatagtcatatcctacttgttatcagaagataagctaaaatctgcattaggtgaggcagtgcctgtacaagcgcgatgcatatagaattatatccatgcagctattactcagataattgtgtattgatcaaccatgatccctacctctaagtagatgagagaaaagcaataccttttttgcccttattatcaagagaagcacgttttcgtttctctcttttctttcgttcagcttctgcaactgccaatgtagcttcctaaagagatagttggaaacaaaaagtatattcttagtccaaaaagtttctttcagttcacccccaaaagcattgtatttatatatactcatttacatgttaatttacataacaaaataaatagagtacaaaaaaaaaagacaacccgtccataatcttgctttacatgaaaatactttgaaagcttctgtaaatgacaagagacacagaagcttcaaggatatatcctacatctttccaagctcaaagataaatttcaaaaatgcctaatgaacaatttgtataatacctcacaagcctttttcgaacatttttcaatggatctagaccatttcaagtgtcgcatgccaacggccaaaacgccagttttacgtaaagagaatccatcttttgacactgcatatactgtgtcccttcttctggctagtaataatttcctgccaatgcaaatttgaaaactatttaactcatatttacaagcagatgcccatttagtatatacaaattagttaggctatgttgcatacctgataagccaggaagtagaatttctatgcaaaaacggtcttttgaggggcgaattcttcaacagtgtagtccgtttccatggaagaacatagggaattgacttgacaaacctgtttgttgttgtactggtgccatcttttctttttgattgcatatttgaaagagtccaaacattggggtaacttgccaccttattcatccgtctgggagctaatatttatatttacataaaaaaaaaaaaaacataaccaaataagcaccttgcatcaaggatgagcataccagattgaaattgtaaattctgtatgaatcagcaaattatgatacatcacaacagaactattttttatttgtaccttggagtaagcataagataagtacctttgtcaatgtttttgcttgtcattgtactatctgataaataatgcaccaagtccttgttatcatcagaattcgagtttgaagtggaagcagcattatcaagtggtataaaaccttttgaattctggctattgcttgaatgtccgctattgagcacaatctgattgttattcgttttaaaatataccactttattattgctattttgaactcctcccatatccaaaccttttttatcctctcctaattcaggcattatagaggaaatagcaacagactctctgctcatgtcaagaactggacggttaggatttggactaggtattcttggaattggacttttattcggtacagtcgtaccattagctgacctaattagacgatggtcgcccatacggacataagaattttgaggcagtgtattccttactgaagaaggcttaggcagttgatttggggctgacaagccagaggtgatacagtcactagcctctctacgccatgtcctgtgggtgtgcctaggtttctgaacgggaaatttcggaactggactaactgacacagatttttgataaacaggcttttggatttccctgtgattcttctgaattacctcttgattgaacttagctttgctgacataatctccatttgtagcaggtccagaaaggttgtttttagtaatgacattcttttcattgtccggaatgttgttcttacttgtctcagtagatcctatagaaccatttcctttattctcactctgaggcaagtactgacccaaatccaggtctgaactacaaacttcctgcggttttagttgtaagcagctgtctaatcttgataccgcaagtgcatcacctgaagcaggctccaccttgttaggtgcttcattctgtaaagtgtcatcagggggacagttcttcatttcctgatctttatgtccatttgctttttcttcagcaacataatgatttacttgtatttcttcttctcttggtacgtcaacttgcatcttgttctctatattttcatattcaatgccattattcaacctaggagacatcatttcatggccatcatctgttggaacatctgcctgttcgttcttttctttaacacagtcgccaccaacaagagaacctacattagaaacaatctcttcttctttaatgcggtcttcacctacaggagaactaatagcagaaaccatctctttttctttaatgcagtcttcactccctatggtaaaagcaatctcattttcttcattttgtgttgctgtcttgagatttgaaggtgcttcatgaactgactctataacattaatatcagaaactttattaggagaagttgcttctacaatttcctctttagtacataatcccgtacgggaagtaccaatggcagtcataccatcggaaatagttgagttcttttcatgtacaaccaggctcacatttttgccatgatcagctttagattctatttcatcagcactcttctcaggagaaagcttagaaccttcatcagatttcttttctgaaaacacttcattaacaagttgtcttactatttcctcattactttgtcttactatttcctcactacacatactagcctcacccggggcttttgccgattttttctttttgacgagcaagacccgtttaacccttctcttagcacctgtaatattatcagatgcagttccttctgcaataggacccactggtgaagaagaggatactgtagaatcatcaattgtacctttacctttctttttaactatcctcctcctaataacaacctttttctttttcttaccagttacatctgcaccagtcacagctgctttgagaccaggagccaaatctttttccggtccaactgactgagccgatgcctctgtctcaggtttattctcttgtgaggcccgttgcgtactggcacgattagaaagatttgatgaagaaggagatgctgccaaggaagggctttcttcaatccggttccaaacagatatcctcgatttagcccctggcttctgcggggtagtccgtctctctgggtcccgaatttctctcttttctttgtcataatgtctataattgttgcggggactgctctctcttaccgtgttatcatatgaagacctcgaattcctctctctcaggtccattgcagcatcatctgatcgtcctgaaaccctaggtctctttctatcccgctgatccaaagtcccggacatcgacctggatccagataactcatcaactgcgcggtgatgcttgcgaattgatggatccgggttgaaccccgatacatcgggtcggcagtagaccaattgctggtgctgcatggaagaggaagaagaaggggtgtaatggcgtggggattcagaagcggtggatctggtggaagtgctgaggtaatagggcggggcggtggtggtggtggtggggtaatgagtggaatgggatgattggaagtgagggtaggaatggggatgcgagggatgggaggagtgggcgaggtaatggtaggtggagcgggactggtcttggtgggggtgggggtgggggtagcggagggaggaggaggaggcggaggcggagggacgccgcggatcgtacggcggcggtggatccattagggtttgttggtttgtgttgttgggtcgcttgcaagttgcaaaggagaggtcgtgacttgtgactcgtgcgaagagagaaaataaagaaacgcgggggagggagtcggggagctaatagcctaattctatttggatttccattctatttggacctcaaacaaacttattgcttatactgtgactaaacacctctctcccataatcacaatt

SEQ ID NO: 807 - DNA, 689 bp, Cyperus esculentus
accttcagctttcttcatctcactccctaacactaacactaagagacgcccacatccacatccacctctcgccgctccctctccctctcccgcccagccccccctcccctctgacgatgactccgccaagctcttacaggttctctttcttcttctccatttccttctctctcaattacgccatatatattccatcattctatcatgctcctcatgtgctttaatcccaccaggtcaccaagagattagagaaaacagcaaggtatttcaagcgtcttggctcactaggcttctggggccagctcgtctgcaccgttgtctctgctgtaatcctatccttctcaactgttgtaagtggaaagatcactgcgcctttcaccttttacgccacagctgctggcattctcgctgcttttgtctccattttctggtctttcggctacatccgcctcgctgatcgcctcagacgcactgcaaatgaccctgccaaggtaataatctatgtgtttctgtgttcaacattgcacaataatattctcaactacttccagatgcactaatttcattggactgttctatgtatctttcacgtcacttgtcgattttgaagaatttaggagctaccttgatgccattttccaattacaaaagacagtaagtcgagttaaatataaccattaccttggagt

SEQ ID NO: 808 - DNA, 680 bp, Digitaria sanguinalis
agcaggttacaaagagattagagaaaacagcaaggtatttcaagaatttgggtaccctagggttctggtcccagctggtgtgcacaattgtttctgctggaattttgtcgttctctactgttgtgacggggaaggtgactgcaccctttacattctacgcaactgctgctggtattgctgctgcttttatttccgtcttctggtcatttggttacattcgtctctcggaaaggcttaaaagatctgcaaaagaacctgctaaggctcctccacgcgctgatgttgttaagagtctcagaaatggaattgtgcttaatattctcgggatgggtgctgctgttctggggatgcaggcaactgttggcgctttggtagcgaaagctctcacaacctctacagtaccgtattatcaggctaaccctggccaaagccctgttttggctctagatgttttcctagtccaggcttcggcgaacaccatcctgtcacacttcctggggctagcgagcaccctggagctactgcggtcggtgtccttgcccccagctgaagccgccccgacacctgcccctgcgcgggcctgaggcaaagcccattcctgggctcgtctagtacatctcttgttccggtttttgttttagtttttgtgaagttgttccgtaacccccgccacgtgtgag

SEQ ID NO: 809 - DNA, 1401 bp, Digitaria sanguinalis
ggcggcggcgccgtcctcgtcctcgccgggaccgctctacccgacgcctccaccttccgagcaggaggttgagcgggtcaagctcgagcaggtgcttcactagcctctcatctgccatttatttatcgattcgacgccccagggtgtgctccgtggtgggtgaagtagggtttatgcgatagttttattgggaaattgacaaattgtatgtagccttggtgagattttcaggcgctaggcatcaagaattgtagttagctgtgcactaagtagatagtttcttgtttgaggaaatgcagttgggcaggatggattttggactaggcgagacacgtgtatgtttcctttaaagaggaattgctacagcccatggagaaggaatgcaaacaaactactgggagctagtttaaagggtagatctttgttggtagcccattagttgataattatccagttcaacagtggcatcagtttcttatcagagagtcgaccatggctcatcactgattttgaaaatattcataatttctggttgaaactcttccttcagcatttttcctttctgattgagaaggcatctgattacaaataaactttccagctccatgctctgtttactacttcatgattcatgcattctagtacttatgcccccatttaaataactgacatgaacagcatatctttgactccaatttgatttaatggagcttcaataaattgcctcttttctagtatgatgtgctggttagcctgtgcatgcttttattttgaattatgtcgctcattttacatggtgatgttattaaattggttatgtgttttcttgcccatctctaaatggtctagaacctgcatcatgattctgaaatattggtatctttctctgtgggctgaattgacaggttacaaagagattagagaaaacagcaaggtatttcaagaatttgggtagctttgggttctggtcccaattggtgtgcacaattgtttctgctggaattttgtcattctctactcttgtgacggggaaggtgactgcaccctttaccttctacgcaactgctgctggtattgctgctgcttttatttcagtcttctggtcatttggttacattcgtctctcggaaaggcttaaaagaagtgcaaaagaacctgctaaggtaatactttttggtaaaccattcttttatacattgttagcagcaatattgaaacactatttcacatgaacgagccacattgcagctccttgcacactggctctgatttatgtctatcggttttacctgcctactgccattcccgctgctgtcgtttgataatcgaactggtgttttcacttttcacatcatgttattcatcacaaagataacttgtacctacttttgggcagattgt

SEQ ID NO: 810 - DNA, 781 bp, Digitaria sanguinalis
ttgctttccaggctcctccacgtgctgatgttgttaaaagtctcaaaaatggcattatccttaatattctcgggatgggtgctgctgttctggggatgcaggcaactgttggcgctttggtagcaaaagctctcacaacctccacagtaccgtattatcaggctaaccctggccaaagtcctgttttggctctagatgttttcctagtccaggtactgcttgcttactaattttttaccatttgcatgaatcattatctcgtccaactgccgcacttaacttcattttacctgaatagaaagcatctttggagttcactaaatgtttggggtagtgaaatcacatttacactatacactgttttatcattttcttcagaccatcttttgcttgttactcttttgtaataatgccttttgtcaacatagtatatagtaccagacatgtgaaaggcatgcgaaaggcgtatacatacataggaatagcaccaaaattaattcagcctgcagggtgacaatgtaaatacctgtgtgactcagaaattagaatcatgtagacatcgcctactcaaaaccaatataaattattaggccgcacaacgaacaaaggtatacaagcttgcatcagtgccagagtagcggttgtccagttttactttatttcacattaatgcttagttctgcctacaatcatagtttgttagtattattgcattacttcacattgatgtagcactaaactttgtgatttttcacctcgagcaggcttcggcgaacaccat

SEQ ID NO: 811 - DNA, 953 bp, Echinochloa colona
gagggggttaatgtaacagagcaggacagcatcatcgccatcgcaaaatgcaggcgctcctactccccgcgccgccgccggcggcgatgctcaggcatcgcgcagttcccgcgtccgcatgtgcgtcgcagtctcgctgtgccctactctccgctgccggtcggctcagcttgggggtctgcgaagcgcccggcggcgccttacagtggcggcggcgtcgtcctcgtcctcgtcgaaaccactctacccgacgcctccacccagcgaacaggaggtggagcgggtgaagctcgagcaggttatcaggagactagagaaaacagcaaggtacttcaagaatttgggtacctttgggttctggtcccagttggtgtgcacaattgtttctggtggaattttgtcattctctacggttgtaacggggaaggtgacagcaccctttacattctatgcaactgctgctggtgttgctgctgcttttatttctgtcttctggtcatttggttacattcgtctctctgaaaggcttagaagaacggcaaaagaacctgccaaggctcctccacgtggcgatgttgtcaagtctctcaaaaatggcattgtgcttaatattatcgggatgggcgctgctgttctggggatgcaggcaactgttggtgctttggtagcaaaagctctcacaacctctgcagtaccctactatgcatcgccaggccaaagccctgttttggctctggacgttttcctagtccaggcctcggcgaacaccatcctgtcgcacttcctggggctagcgagctccctggagctgctgcgctcggtgtcactgcccccagcagaagctgcgccagccccagccccagccccagccgttgcccctgcacgggcctgagccaagtgagttgcctaactacatggcatgccaacaacgcaagaagacctgctcacctgta

SEQ ID NO: 812 - DNA, 1067 bp, Echinochloa crus-galli
ctgcattatcgccatcgcaaaatgcaggcgctcctactccccgggcggcccgcgccgccgccggcggcgatgctcaggcatcgcgcagtttccgcgtccgcatgtgcgtcgcagtctcgctgtcccctactcgccgctgccggtcggctcagcttgggggtctgcgaaagcgcccggcggcgcctcacagtggcggcggcgtcgtcctcgtcctcgtcgaaaccactctacccgacgcctccacccagcgaacaggaggtggagcgggtgaagctcgagcaggttatcaggagactagagaaaacagcaaggtacttcaagaatttgggtacctttgggttctggtcccagttggtgtgcacaattgtttctggtggaattttgtcattctctacggttgtaacggggaaggtgacagcaccctttacattctatgcaactgctgctggtgttgcagctgcttttatttccgtcttctggtcatttggttacattcgtctctctgaaaggcttagaagaacggcaaaagaacctgctaaggctcctccacgtgccgatgttgttaagtctctcaaaaatggcattgtgcttaatattatcgggatgggcgctgctgttctggggatgcaggcaactgttggtgctttggtagcaaaagctctcacaacctctgcagtaccctactatgctacatcaccaggccaaagccctgttttggctctagacgttttcctagtccaggcttcggcgaataccatcctgtcgcacttcctggggctagcgagctccctggagctgctgcgctcggtgtcactgcccccagcagaagctgcgccagccgctgcccctgcccttgcacgggcctgagccaagtgagttggccaagtccatggcatgccaagaagactcgtttaccttcattcccggactctacacctgttgactgttgttccggattgtatgtagaaccagcgtcaagttcgcacatcgatgtttctttgttttttttggttaattgttgaaccaacatgtccgcccgaccccgtctaatctcatgtggcgcaagt

SEQ ID NO: 813 - DNA, 835 bp, Euphorbia heterophylla
gaccaccactccatcgcctcctctcctcccccgccaccgattaaactctcaacgacagctcaatttcctgaatttctcaccgaaattcactcaatcgatatcactcgctgcagctccattatcctacgatcctcttcatagcatagaatcaaaagtatccttcactagaacaaatgcttcttcttcttcttcatcggtgtctaatagttccgtcccttccagtgatgaatcagagaaagccaagctcgctcaggtggcgaagagattagagagcacatcgagatattttaagcggttgggcaatttagggttttgggggcagctaacatacagttgtagcagctgtgattcagtcgttttctgttgtggtgaccgggaagatttcgtcgccttttacattttacgctactgctgctggtattgctgctgctttcatttcggtgttttggtctttcgggtatattcggctttctgataaactccggcgaactgctaatgatccttccaaggcacctcctcgagccgatgttgtgaggagcttgaaaaacggcgtagttttgaatctgttgggaatgggagctgctgttcttggtatgcaagcaacagtaggggtcattggtagcaaaggctctaacttcctctgcaaatccttactctcaggggatttctcctggtaacagtccggttctagcattggatgtattcttagttcaggcatcagcaaacaccatcctttctcactttctagggcttgttttctcgttggagcttttgcgatctgtaacgttaccaactacagaaagcattccagcaccaaaatttgcctaaatcctcc

SEQ ID NO: 814 - DNA, 408 bp, Euphorbia heterophylla
agctacaccttgttggtaaagatattatattgtaatggagtagtaatcaataatcatagattgaatgaaatatctagatttctctcatcaaagttgatcatatccctcaatgaagttttctaatgcccgaggactcgaggagtttaaaagctaacaagggataatacctcttccaacttggatgatagattcatctcgccttcgaaatactattgtttatttaagtttcaatcatcgcgctaataagatgatatctataatggcatcgtcctatatcgtgtggttcataccacttttaatcctcgtgttttgtggtcaattgtttttgcttcttcaggcgcctcctcgtgctgatgttgtgaagagcttgaaaaatgggatagttttgaatctgttgggaatgggagc

SEQ ID NO: 815 - DNA, 1098 bp, Euphorbia heterophylla
tatgcaatcagccatagttatgccccattttttttggcaaaaagacctttttaggccttgtggtacctatttggtccttgtgttattcaatttgttaccttttttgtccctttagaaccaatcacgtgaatatcagtatatcacgaataaagtctctaccatacaaggttcaaaaagataacaaattgcatagcacaagggcgaaaagggtaactattacctagcacaaccaaaaagtaatatattgcatagcgtagggattaaataggtaatacagagaccaaatgggctaggcgtttatagtacagggaccaaaaagttccctttgcctattttttactgatctcatcgcctaaaacagtgccttatacctgtaattacagctgatagcaagttccctatactgcaatgagttactacggttgttaaaatactaaattgtacagttctagattgaattgttcgattcgggaagaaaagtaatgtaaatgtgatacgaattacaatctctcgaaactatttaagttgtgcaatatatacgattcttatcaattccacttccctctaatacaggcatcagcaaacaccatcctttctcactttctagggcttgttttctcgttggagcttttgcgatctgtaacgttaccaactacagaaagcattccagcaccaaaatttgcctaaatcctctctgttgtaccgagtttctgccgaaaaagcgtgaatttttgtagcccaaagtgtcgaaccttctcggttatgatgagaacaataaaagaaatgtggattgtgaagggcgaaagcaaaatatctagatgtgttgtgaggtgatttaaggtttgttcctatgctttctgtaaattttcctggaaaatcagacggaacacctttttagggccatagaaagcaacgacaaccgcctggcttttttgccgataggtttgtaaatttgacagtgagaagtttgtggaaggaatgaattgagcttgaatgtcttattatgtatttatgtttgaacttcaagttgcaagtttgtctaattataatacttttggccacataagaactaaacttactatgtggcaaaggctagtt

SEQ ID NO: 816 - DNA, 2099 bp, Euphorbia heterophylla
  unsure (1)..(2099): unsure at all n locations
atatttaatcttccaaatattaaaaatacttactttttctaactatttaatctaaccgatttaacatcaatttaccccaaataattcatcgacacctaactctcaaccttcaccagatcgagtggcaagaccgggtttgacaatttcatgctcttatattaccataggtccatcaaatggtatcaaaagctcaaagttagattccaaacaacaattgggcttataaataggcccaactcatcggacggttccgattcaaccgcttcatcaaatcctcactgtcaattccaacaacacaaacaacactcacttcactcaccgcttgccacactcgtcatttcaatatgcagaccctcctcatgccggccgcccgctcaccggcggcgactacatctccgaccaccactccatcgcctcctctcctcccccgccaccgattaaactctcaacgacagctcaatttcctgaatttctcaccgaaattcactcaatcgatatcactcgctgcagctccattatcctacgatcctcttcatagcatagaatcaaaagtatccttcactagaacaaatgcttcttcttcttcttcatcggtgtctaatagttccgtcccttccagtgatgaatcagagaaagccaagctcgctcaggtagtttcccctttttgcagttctgtaaaatttttcggctatgaattgttgttagtattttagtgtaattagatcacctagttgcccaatgcagtcaggatatacggagtaagcacttgttcgggatcttgtagcccctaactagggctggaaacgagctgagcagagttttagagttttggcctgttcgtgtttgcgtatttagtttttaatcgaacacaagtcgagccagcttgattcgagctcaaatttcggttatttcggttcgtgccatgttcatttgttcgagctgttcacgaacaactcatttattttattcgtaaacagttcgttaatttgatcgcgaacacgtaaagttttggattttcgcggttataagcggttagtaactgcaattggacgaaaatgactgcaaaagctgctatttttggatggttatttgcagttttctatgtatagaaaacggatttggattctctaaagttcaaacatttcacttaatataaaccatccattgagttttaatgatccatgttcagttttagtggtttgtgggggtccatagtgggaccacagtccaataaatctgggccaaatggttgagattgagtaaaatgtacagctcacaaaaaaaatttcattttgaagttcttgagtttccgatgattgaaatgttaggtagatttgccaaataggtttcagtctgaaagttttcgttacgacttcatatttatccaagttatctcgtatttccccaacagttgttttgttcaaaatgtggattttggattgagactgaaagcctgtatattgtgctgtgtaggtggcgaagagattagagagcacatcgagatattttaagcggttgggcaatttagggttttgggggcagctaacatccacagttgtagcagctgtgattcagtctttctctgttgtggtgaccgggaagatttcgtcgccttttactttttatgctactgctgctggtattgtagctgcattcatttcggtgttttggtcttttggatatgttcggctttctgagaaactccggaaaactgctaatgatccttccaaggtattctgcttaatttttgctttcttatgcttgtttaggtaagacttaagaatcatcagatttttagtggagtgtttaatattatgtcgatttcttgtttagcctttgtgttgttcatttagtgttcaacttgactttatccatctgtgattgtattaagagcttattgacgaaaatgagttgattggcattggaacatgggcattcgtacgagaaagtaattgcatttcattttcagttgatgtgtgctaaatgatcaaacgctaaggatgagctatatgttatacatatacttaaagatattatattgtaatttttttttttggtaatannnnnnnntatcttcattgagatattcttgttcgggg

SEQ ID NO: 817 - DNA, 892 bp, Euphorbia heterophylla
ttgaatctgttgggaatgggagcagctgttcttggtatgcaagcaacggtggggtcattggtagcaaaggctctaacttcctctgcaaatccttactctcaggggatttctcctggtaacagtccggttctagcattggatgttttcttggtacaggtatacactcaattcacaaatctttttcaatttagaccttataaaaaccaacaaaaatgaataagcaaataaaatgtgtcatctttttcgggaaagacattacttctattgagcagtgttcatcgaattggtgatttgtatgcaatcagccatagttatgctccattttttttgggaaaaagacctctttaggccttgtggtacctatttggtccttgtgttaatcaatttgttaccttttttgtccctttagaaccaatcatgtgaaatatcagtatatcacgaataaagtctctaccatacaaggctaaaaaagataacaaattgcatagcacaagggccaaaagggtaactattgcatagcacaacgacccaaaaagtaatatattgcatagcgtagggattaaataggtaacctgtacaccacagagaccaaatgggctagacgtttatagtacagggaccaaaagttccctttgcctatttttttactgatctcatcgcctaaaacagtgccttatacctgtaattacagctgatagcaagttccctgtactgcaatgagttactacggttgttaaaatactaaattgtacagttctagattgaattgctcgacccggaaagaaaagtaatgtaaatgtgatacgaattacaatctctcagaaactatttaagttgtgcaatatatacgattcttatcaattctacttcctctaatacaggcatcagcaaa

SEQ ID NO: 818 - DNA, 1593 bp, Festuca arundinacea
gattatgctagtgttcttagtttttattttgatgccatttgctcctagttcctattttagaagaacaggccatgattcctcatacctgaagccacattctgatagtgttcttcttttccatctgctagtgttcttttccatcctcatacctgaagccacattgtagtagtgttcatcttttcccatttgttatgtgttttattttagtatggttttgtaaaaacatgtgatcattttagtacacataatggttaacctgaataatgttgttcgttttgaaattaggctgtttcttcacatggttaaaattacactgcatattatctcttgattctctgtaaatacaagtttaagccacctgtcgtgactgaagctggcatatcttcatcccttttcaatggattaaatggacaggttatcaagagactagagaaaacagcaaggtatttcaagaatctgggttccctagggttctggtcccagctggtgtgcacatttgtttcagctggaattttatcattctctacggttgttactgggaaggtgacatcgccctttacattctatgcaactgctgctggtattgtcgcggcctttatttcagtcttctggtcgtttggttacatccgtctttctgaaagacttcagaaaacagcaagtgcaccctcaaaggtactctttttctcgaccacagtacccatttttcacatttttaccggcaaagtaaatgatctgttttcatattgaaaaaccaaattgctactccttccctgctgcctgtgacccatcttgtttacctatgtgtctgtgcatcagtgcatcatctgacagttaaactgttgtctttttaccacatatggtaggcaaagattactcccatctgtttttgaccttgcaattttatgttgtttaatgcatgacaagatatacttcagatatgatttgctttataatcatcagaatataaaacagtggaatgcttttccaggctcctccacgtgctgatgtgattaaaagtctgaaaaatggcattgtgctcaacattcttgggatgggcgctgctgtcctcggcatgcaggcaactgttggtggtttggtagccaaagctcttacgagctctgcagtcccctattatcaggcaacttcctctggccaaagtcctgttttggctttggacgtgttcctagttcaggtattctattgcttatttatcatgttcatatttctagattctgtgaatgcaataaatattccaagtattgtgaagttaggcgtctcacactagagtacaatcaagatgataagcatgtaaataaaataagatcacaccatgactctgattgtattgcaagtttctcataagccaataggaagtgatgtacactattctctacatcatcatctgcttggggtgatttgtgtatactatactctaataactcttggtctgtctgagaaatttataacgtaaagagtgtgcccaacacatctagaaataacaccaaaagcattcagtttcataacgcctaatctgatatatatgatttagtgtcagaactttgaatcctccaactttgcctgtaaaatcatgta

SEQ ID NO: 819 - DNA, 1059 bp, Ipomoea hederacea
cccaacacggcaacgcaactaagctccggtccggtcagacagtgaactgaactctattcgctatgcaaacgctacttttgccggctgcgcgctccggcggcgcactgccacctttaccaatggtctcaccggtggcgtcgaaaccctcgccgctcaatcttctccagcaccccaaaagttccccatttcgtctctcgttaacacacacaccaactgccttacatagtcaacatttgctcgcccggccgcatctaactctcaattacagaaggtttagagtcctcgccgcgacgagcgcttatccgagcgacgaatccgagaaagcgaagctcgctcaggtggctaagagattggagaatactgcaaggtatttcaagaaattgggaggttttgggttttgggggcagctggtttgcacagtcgttgctgctgggatcctttctttttctgtagttatcactgggaagatcacatcaccctttacattctactcaactgctgctggaattgctgcagcttttctttctgttttctggtcttttggttatcttcgcttgtctgcgaagctaaagaaaacagccagtgagccttcaaaggctcctcctcgtgctgatgtggtgaaaagcttgaaaaatgggattgcgttgaaccttgtgggaatgggtgctgctgtagttgggttgcaagccacggtaggttggttgtcagctaaggctcttaccacctcaagtgttccatactatcagggtatttcccctggtagtagccctgtgcttgcattggatgtgattttggtacaggcatcagcaaacactattttatcacactttcttgggctgttattctcactggaactattgcgctcagtaacattaccgccaccttctgaaagcattcctgttcctgttcctaaggttgcatgagctctacttaaaaaagtgtaatctggtgatggttaacactggaataacattgtcgtttaattgtataagtgaggtttagctttgtatgttgcatccattttattatcaaggacaggactgtactgcactttgttgg

SEQ ID NO: 820 - DNA, 6078 bp, Kochia scoparia
  unsure (1)..(6078): unsure at all n locations
tattgcaggccaagtttagaatgtagccaaaacgtaactattaagggatttaaggcccaacaaaatatcaacagtaatcttgatcagatttccgaaactcaaaaatattcacaaacctcttctaatttttctctctctcactctcttccttacaaaattttacaatttccaaaattctttatcatgcaaacgctgcttttaccggcgtgtcgcgccgccttaccgccaccgtctccggcgaaagctgcggcgtcgcattcacatttcccgaggcaaataccagagctcaatcgctttctctctcctctaaattctcaatgttttctcttatcctcttcttcttcttcttcaaaccttaattgtatctcctctttaatttcgagaaaaatggtgcatttggtgcctttgatggcgtcgtcgcctgcttccactggtttcgcttcacctgctgacgagactgaccagattaaactcgctcaggtgagttgattttttctaattcaatttgtaattcatgcatttctccttttgtaatatatcctaggttttggttttgtgtgcgaaatgctgaatattaggtatgattttgagctcattagagtggaattgattgctagaacttttgattaatttgaattgaagaccaattgttttaatgtagtgcatataatgtctctaaaattgctaaattgagtatcattcttcgtattatgaatctatagttatttaagtagcttagaaatgcatttggtctggaaatgtagcttctgctgttataattgtatagcttttgacctaatatgattctaaaggttaaagttggaattgctttgatcttaagcaagcgaagtgatagtgtagcttgtggctttcaagctaaattgagttagtaactgattgttcatattgattagtttagaatggagcatattagaattgagcttttgatgtgattttaacttcaacattagtttagaatggagttttctatttttcaaattcaattctagcatagtgctgtagttggtaaaaataggtttagatgataggttgaataattaagaaggcgatggatcgaaacttcctccggactgtaagaacttcaatgttaaagcggcacaggcttttcgttgatgcaaatttgtccttgcaactttagtggagatttgactgtgttccaacttaaggaattaaatggacagacatttggaaggcataaatgattcaggggaatgctgattgcctagtggcttgtccatcaacaaatactccacatatactctaccatttttctctgttaattttccatgcttatgcatcatgcctgtaatttgaagttcacttttgatgtttgcatcttggcataggtagctaaaagactagagaacacagcaagatattttaaaaggctgggcacttttggtttttggggacagctagtgtgcacgatcgtcgctgctgtgattctttcgttttctgttgtagtcactgggaagatcacatcgcctgccaccttctattctacagcaggtggaattgctgctggatttctttctgttttttggtcatttggttatcttcgactatcagaaaaactccgcaaaacagctaatgacccatcaaaggtatctatagcaatattattcttttttttcttctttttgttgttgttgttgttattgttctcaattaaaattttctccaatatgcgttggattatctgcggagatggtagaatatggcacacaaactctggtttctacccctgattctttaccatgattcatgctataaaaatccctggcatggtcttcaacatattcagacaattgtagttaagaaggttctttgaccagtgaccacaccggaaagaaatattatctcttactccatatcaaaatatcatcaatgcttttttctttcaaatttatcaatagcctttaaaattcaagtagtgtacgtttatgaaatgattacgctttaatagttctttcacttatgcagtcataatattgactcagcataaaggttttctgaagtttcattacctatttctgttcatgtttgagtacaatgtaggtaaaagcttttggtgttagtgagaatgtttctcagagtgattgtcgtttatataatactataggtaattctgatattcaagtttttatagtcttaattatgcaattcaggtattcagtttttacagtcttgtctatgcaggattgtttaaataaccttttgctcttccatacgtgagtgattacttcactcttttctgcagtcttaactcttaaggaaaaaattgacactgtccaagttcaaagttgacttctcatattaatcccaaatttgagttggttttaaacaaccctgactttaatgttttgttttccatattggttcccattgcatagctacgtgctttctctcttttctctctctcccttctctccttccctgaggtgttatcatcattctaagtgtcctacaatcatcaataaattcatacctccaatccccttttgaattttaacatgagcctcaaaatcaacacatcctgaggccccattcttcctcacctgccttaattcaaataccatttaccaatttaagtacaaccctttagccccttcagcgtttactgaaaaacaaatcgcactttatgtgtacgatccttctaccacctcatggtaacttccatgtcaaattttccttgtaaatatcgatgttttgtacttattttctcgtcttttcaccatttttcctctaggatttggacttttgtgttttttttatttgcgtaataaacaacaatctaagtcgtaattgttctccatatgatcgtgagcagacttttggtcaaaatttattttggatgggtgactatatttgaattcaatgattccaggctcctcctcgtgctgatgtagtcagaagtctgaaaaatggaatagcattgaatctccttggtatgggttctgctatcctgggtatgcaagctaccgtaggattacttgttgcaaaggccctcactacatctgcaaatccttactatcagggtgtagctgctggctcgagccctgttcttgctctggatgtgttcttggtccaggtatttatcattatctttgaaacctaagttttgagctacatgaatacagatctgcactatggtgttcactttcacacatccgaacctcactgcgctctccttagatgcaaaataccagatcctattgagtgtcatgttattcaactgttttgcttataattaatgcacacaaagtatagatttgttattttactggtattcataaaagatgagatatataaatatgttgcagacttgcagtgatactttaaagtgatgaataggttgcagttgcacttaagggacagaaaacattcatatgttgcattggtattctatctacctgcacaaatattcacacatattcattctttctctagtgtatcggtagataggctcattatttggcatgaacaaggatgacagaacttacataaaacaaccttgagctctaaaatcttagtttctttacttcgatgtattttcttgtttgaaatataggttgtccaaaactacaaattttgaagctagcattatagtttaggatggtttaagcttatcttttgagttgaaataagaaaccacgcttatagccttatagcgcatttctgaaagcctaaatgttaaattcagaggcaatgagccaattaagatttattatcggttcgttcaagttcaaagattacatgatatcaccttaaatgtgtcatgccaagagtggagagtatcaactaaaccaccaatatcgaaactgtagtctaaatcttatcatggattaacaaattgataagttatttaagggaagaacctaggaaaatagagtttttgataagctattatccattgggagatcatttttttttttttcacttcttatattcaattcccacacttttctaactcatttaaccattccacttgcaggcatccgctaatactataatgtctcacttctttggtcttgtttcctccttggaactgttgcggtcagtgacattgccaactggtcctgttgccaagacagcttagctagtaaggctttcttgtgcacttcatttgaactgtatactagagaaggttccaatgaagttttgtcgtggttacaaaatgtatgcagatgaacccttgtatttttatttattttttcttgttgataggtgcgtgaattacgtcaatgacaattgtgaactcgaaagctaataggccaaggagcattagaaaattttgtttaaagacataaatattttgaagttgcacgtcatttgcttggtcaccttcaataaaggagtcattttctgtaaactatccttgtatgtgatacgagcttatcctcccatatctgatggcaatctttaaaatccatatggtattttttttttcaaactttgttgtattggaattgagtagtgatagtcgaatatttatgtaaatcaattattttcgtatgtcaacgttgctgcacttcccagtcttcatgtgatgagggcagaaaggaattattctggaagaagaaaatgaaggcagacgagagcaatgagggctattgggagaacaaacattcaatggtttcattttctaaattttgttagtttgaaatttgccagatcttgaaaaagcttggttatgtcaaactctttcttctttgttcaatttaattatgaagtatctttaataattacttagtcactttattaggtgtatttagtttatttcaagtctgtgtatatttcaacaaataagactccatttgttttggaataaaatattttcaatgaaaaatgattttccttggaagatatttttcggaggaaaattagaaaataaaattgttttccattgtttgtttatatgaaaaattgtttccctaaaatcattttcatttatttgtttgaataaactttgtttatttaaagaaagaaaaaatattttcctttatttttggaaggaaaatgtttttcttgtgaatggaaaatagttttccatccaagttttccttttctttgggttggactaaacaaatgatggaaaatgagaaaatagttttcctgaaaatcatattactctaaaacaaacggaacctaagttatataattagatattcaaaatcaaattattccttggtaaaaatttacttctacgaacaatgatatcaaatttacccccataagaattactggagggaaggtaacactggcacacattctgtaagaaagaagaaaaatgtttagcacatttcaacaatacatctacattcatggcactaactatttcagtatttccagcttctcgtttttccgtcactcaaaaagtacaacaaagtaaacctaatgctaatgaattacactaaagtatatcaatttgcatcaagaaaaatgatctcctgttcaccactgttcaaaaacaaaactgacacttgggaacaaaagccgtaaaccccgccaaactgagggcaacaaatttcactgtcttgtaatgcaaagctcgagtctctcaaaaaccattttccagctacaaagagggctgcacattgttgataagcaagtgtagtatgcacatctcgaacatcctcttgaaaaaaatctgaaataatataattcgtatgaggttaacaagtaaccgaagagtagaagtgcaaaaaaatttcttagtgtaacatatcaattgcttgaattgtaaaaaaagatgacaaagactaaatgcttattcaaggctcaagaataaaagtgcaaaaccaatttcaaaggtctcctttcatccaaaattgaaaggctagttcttgataatgatatactgcctcttagtaataataattttacttcacttcagaaaaaagtttctattgaaaataggaaaaagttaaagtttttaagggaagctaaaagtggaaataatatcaataattgatcatttattacatnnattagtgtattattttgtcttgaaattacaaattatttccattttacgtaatatatttatatcttata

SEQ ID NO: 821 - DNA, 621 bp, Lolium arundinaceum
gtttacctatgtgtctgtgcatcatctgacacagttaaacggttttgtttttaccacacatatggcaggacaaagattagtggcatctgcttttgaccttgcaattctattttgttttatgtatgacaagatatacttgagatatgatttgctttagaatcagaatataaaacagtggaatgcttttccaggctcctccacgtgccgatgtgattaaaagtctgaaaaatggcattgtgctcaacattcttgggatgggcgccgctgtcctcggcatgcaggcaactgttggtggtttggtagccaaagctcttacgagctctgcagtcccctattatcaggcaacttcctctggccaaagtcctgttctggccctggatgtgttcctagttcaggtatttcattgcttatttatcatgttcatatttctagattctgtgaatgcagcaaaaaatattccaagtattgtgaagttaggcgtctcacactacagtagaatcaagatgataagcatgtaaataaaataagatcacaccatgactctgattgtattgcaagtgtctcataagccaataggaagtggtgtacactgttatttacattatcatctggttggggtga

SEQ ID NO: 822 - DNA, 280 bp, Lolium arundinaceum
atgctcattcctttccgatggactaaatggtcaggttatcaagagactagagaagacagcaaggtatttcaagaatttgggtaccctagggttctggtcccagttggtgtgcacattagtctctgctggaattttgtcattctcaacggttgtttctgcgaaggtgacatcaccctttacattctacgcaactgctgctggtattgttgcggcttttgtttcagtcttctggtcatttgggtacatccgtctttcagaaagacttcggaaaacagcaagt

SEQ ID NO: 823 - DNA, 615 bp, Lolium rigidum
atattatgggacggagggagtataatctatccacgaatcttcaacttctttatagtaaatttccaaattgttgggttacatgctcttctaggcattctacagttattacgatctgtggctagcggttaacactgtgaatcgactgattcggcacctgtttcgccatgtggttttcatggtccacaaccacacttggttctgcacatgctatttacttggcccgtgtatttcctttcctccgtgttaacttttattggttgcaggttagcaaaagactagagaaaacagcacggtattttaagagcctggggaccctgggattctggtcccagttggtgtgcacgactgtttcggctgggattttatcgttctctgcagttgccacggggaatgctacatctccgtttacgttctatctgactgcacttggcatcgttgcagcctttttctcggtattccggtcatttggttacatccgtctctctgaaaggcttgggagaacatcaacggagcctgcaaaggtaatctggttgcctaaaacatgttccgctgcactatagttctttgttgaaaaaattgctgctagctcactgtttttgcctacaatgtggcatg

SEQ ID NO: 824 - DNA, 326 bp, Lolium rigidum
tatacgtagtaatatttggttctgtttaaaagacgcatcatagccagaaataaatcgaatggctccttctacaggctcctccccgtgccgatgtggttaaaaacctgaggaacagcattgcactcaatgttatcggaatgggtgctgcacttcttgggatgcaggcaacagttggtgctttggtagctaaagctctcacaacctcttcggtgccctactaccagggcatatccgctggccagagccctgttcttgctttagatgttttccttgtccaggtatgacattgttcttttctccttccctttcatcattcgtggtaaaaa

SEQ ID NO: 825 - DNA, 206 bp, Lolium rigidum
catatctcttgattctctgtaaatacaagtttaagccacctaccgtgactgatgctggcatatcttcatccctttccaatggattaaatatacaggttatcaagagactagagaaaacagcaaggtacttcaagaatctgggttccctagggttctggtcccagctggtgtgcacatttgtttcagctggaattttgtcattctct

SEQ ID NO: 826 - DNA, 7097 bp, Portulaca oleracea
tcttgcattctccactgtagtcactggaaaaatcacatcacctcctaccttttatgccacagcaggcggaatagctgcagcgtttatttctatcttttggtcttttggataccttcgcctctcagaaagacttcgtaaaacagcgaatgacccttcaaaggtatgccattatagaatttactgcttcttacagtgtgagtttggactgttgtttttgcttttctgtcacccatgacttgcttggctctgggttgtcttggaaaatggatcagagacgctaattctatgtcaaatgaatagtgcttagtacatgccagagggaatgtaaaatttgcccttggttcctggatgactgcttagggaatgcaaactgcttcttacagtgtgagtttgtagtgttggttatgcttttgtttttgctttcccaccatcgatgactttgcttggctctggtttgtcctgaaaagtggatgggagacgctgactctatgtcaaatgaatggcgctttgtatactccagagtccacagggaatatgaactttactgttaattggttcctggattgatgttcttattatttcagttaagtcgtagtatttgtttctcttaataagaaaatccttggctaatagtataatcagctgtctacctgatccatagggatgttattatcatttcattgtagttttgtgtaaacatgcttaagttattgctgtagatatcatttgagattactcctacggtgtaacactgtaactggatactttaagaggatttaagtaaaggctataaacatcctcaagtcaccagggttatgtggatttgcattcaggtcttgacatagacataatatttctgtagcaacttgttggtcactatatatcgctgcacttgattggatcctaatagaaattgtctgaacagaagaatctttattggtgtatgctttgcatattctattttagagggttcttgatggtttcaggctccccctcgtgctgatgtcgttaaaggtctaagaaatggaataattgttaatcttcttggtatgggttctgccatcctgggattgttagcaactgttgggcttcttgctgcaaaagccctcacaacgtcctcaactcccttttatcagggtatatctcccggatacagccctgttcttgctctggacgtgttcttggtgcaggtattgtcttcctcccaattttgagtggcttaatcttgcacacctaattttgtaacattgactccttgaattctccagtgaagatgcttatatctttgtttcttcaattgaactgcaggcgtcagcaaacactatcctatctcatttcattggtcttgtttgctccttggaactgttgcgatcagtctcattgacacctgcccaaacagctccgattcccaaacttgcttaggtcttgacaatgaacttggtttaaatggttccagagtgtagcatccagaagaattcaatgttctagagcacaacctgtggatgttttttgctaggtgatcttgtattccgttgctgttactgttcatgtctgaacaatgtaaataacatctttgaacaaataggttcgcaggctactatcgataatttcgattaatgtgatgtaaaacaatgaagtcatctgtatatgcttccagccctaatgggacagccattgtctgtccattgaattttgcgagctccttatgtgatcctgaccatctacaaatgatcaccatattattccagttgttaattgatgtatgtgcagacgatggacctccatcattaattcttcacccaaaatatccttaaactaaagcacagaatccagcatccactttcatatccttccatatcacatatggctaccagaggagaaagagtgtggaagtcatttaccccaaagtgctactacagcaaccaactgaatattcaacctcacgacaagatttttcctcagccagtatcactcatctgaacttctttccatgcagggttcaacgggccgtctatgtggacttcaccgactatgccatccttgatagtatcaatatcttcttcttggatttgcggattcttttctgattccagcatatctaccccttagaagcgtctgtacttgtatagaaaattagaaatactcatacagtttcaaaggaatgcccctttttatgaatcattgcttaacagaattacagaaacaataagaagatgctattctgtaggttcggcatgactcaatagtatgcataatatatgcctcaactagttagatgtgatgagttaattgaaccaaggtactgtcatcgccatctttagcattcaccgaatcatcaccttagctaccaaccaacaacttaagggctttgactaggctgtatatagcagccaaatgaagggcagtttcatctttgacagcttttggtggctacacacttagcaattccccaatcacggcatctctcccattgcttgatggcctcttacccttattcaagcagagacgaccacaggggtccacgttcataatcttccatactacaccaacatttccaattgcaaaagctaagcgattgaagagaacctcattaagaactggaaggaataactaacaagagttggtctaattgataagaatatgcgcttataattcgaaaattccaatgtcgatgtcagtcttattggtggacgatctgtaaatatctttgtaggtgctttttgagcatggaggtatagctttagctccgtaggcctttcgctagaaatgcaaggcttctctttaccttttttttttttataattcaaagcccataataggtaggaaaagcaaatataaaatgttaaatagcagcttagcacaaaatgaaaataacgccataaaaagctacaacactgccaaaaaacagttaaaaactcgaacaaagagcacaaacagagaatccaaaagaaactctcaaaacaaattagtcactcacaccgctcacgctaccataacttgctattgcctaaaagcatgctattttcattacttctaattctacttgacctatttcatcgttttcttagggtcatgaattttcaggaatccatatttgcaaccgagctgtactattatcagatttatcgctggaaatgcaaggcttcccattactacctctccatatcttattatatgtgatgaagttgacgtagtcaagatgtgaatatcttcgcatacaacactctacttcgcatacaacactaatatcataagatatataaaatattaactttttttaagaagcatactttcccttgtacatgcctgataccgtatttgataagatagacaatcttatttctaattttcagggtaggttgatgtccaatctagatctagtttgtattggtaatattggacaaatatcgataaaactaatcgaaataataagaaaatttaagttggattaaaatgaataaaattgcatagctgtctctagaagcacactcaattttggccctattgaattgtgtagtttcgctatttagacacctgtgcaaacgcactacaaaaacaaaagactatatggcacacatatagtacatcaggagttaagacagaagtcgtgcccactaccaagcattcaacagaaataagacatcatcatcaaaagtaatggggtgctgaacagtcaaaattaacatgcagaatcatctggtacaactctgcacttgagaaaagcgtatcaacaaaatccaagaggaatgtacttcagattcccaagacaccattaattcttccaggccaatgtggagtcttgacgcttgcaagaataatacaacaaaccaaagctaccaacgtacttcctataaaattgagatgacaaacacgttctaaagaaaagccgctatatactactgatcagttacacagagatctagagtaatttctacatcaatttgacaatcccaagttcaccacctaaaacaaatctcacatcccctcttccacactggtaacaggcttcatcatcagtgccccattctccagttaaaaaaatttactggctcctcaaaaccaagcaaatgccgaagttaactcctctgccattagaatctagaggacgagcagtcaccaacatattatgtgcttctaggaaagtctatattatgcacaataagaacacccagccaagataatcctgcaaagagaacaaaatcaaacaaaagcacattaggcaatcctcccacaaacaattaaaattctccatttcacaaagacaagctaagaaaggtttgcgcagttccagacatgaacattatagtcttagcatgcctaactgcctatcacatgaactaatactgtaaaaaaatagagacagaaatgcaacctatagcagtcttaaatcctgcagaaaaagcctcttcaaggctgaaagcctgtgatacatctctttaatgcattaggataccggtcatgcatccattcttttgatcctaatatataggagactaacgtgtttcatttccctgatctaaacccacaatttcagctgattaacatgaacaaatatgtagaatcaaggataggaagataaaccaataaattggaaaaaagccaagagaaaatcatcccaaatattcaggctctgtaccacaatgtcttatgttaccttctaactaaggcatccatgtattgcccaaatcaaatctggaatccaaacaaaactaagttgcacattccgcttgaatatgacccagatcacccaatcaaagcaacattagtgttatgtttgtgtgtaatgatcaagcctagtagtaaacagcacaatgtgctgcacctaaagcaagaacaggaattctcagtaaggattctaccaatagtgaggtcctttgggagcaagatgcaacttactgtcagatgtacatctactttgatggataatccttcaatttctaaacaaaggttgacaatctattgttcttattaaaacttattcttctttttaaaaaatgggtattaagaatcattctaagggtgccttctgtaggggggttaaagttccttttaattactcaactcggtctttcccatattttcaacactcaacttttcaactattacctaaaattatcaacctttactatacccaatctttccatacacctataaagaacacacgcagagtgcatattatgacacgagtaataagttacaagaatgttttcaaggaaaattcagcaactcatctccataacgtaaggctcgtaaatgttgtgtgtgagatatgatcataattctatcatgtagttgtggaccttgcttggccaaggtgtgaacctagaagccaagctttttcccaacactatcccggtttctccaaataataatgcactggattcattgggacagtggcataaacgacatggattttcaagacacaatacaaattacgcaagtgctatcctcaattgcatagtgaactgaaaccaaagtacatactagaccatatttttctccaacaaaaatttcgccatagttttctcattcaatacaactctctacgattgaacaatgtactttcacagaaatatcatgacctagagacagcttgaaaagaaagccacaaaaattttgacgattagactccaaaaaggatcaaagctatggaactcttcattcaaagtgattgatggaccaacatcaaatgtgtgagcactatcacttatctagattaaccaagaaaaaacgactataaccacatgatcatagatcaaaggtggctagccagaaaatcattacacaaaaggtcaataaattttgacgattaagactccaaaaaggatcaaagctatggaactcctcattcaaagtgattgatggatcaacttcaaatgtctgagcactatcacttatctagattaaccaagaaaaaatgactctaaccacatgatcaaagatcaaaggtggctagcaaaagttaaaaataactaaatagtctatacaaacaattgaaacaaattggttaatcactatgaatggaattagttcttgacacgaacctccattggaccaaatgctcaattttcttgaatacaacaacaaaccccagtatatccagctaacgcagggtcgctcaattttcttgaatggagatgacaaatatgcatgtaaggagagatgtggggttgtgggcaacggcagcaaagccattgccaagtccctatggaatgaatttggaattataaggggggatccaactctatcaacaatatggtttggcctgacctatccagtgcaaacatgccctttttttcctttttggatataccccgagcccccagggtgattagctatctaacccaagcatctcgcattgactagcatatagttgaaccctagattaaaggattgttgactagctagtaggtactgctctacaatacaaaaaagcacaggtaatccagcaaggcattttgctcttactcaggtgtttaactcgaagtttccaaaaccctgactgcatttaagtgtatacttattgctagttacaccatgtctaacagctcattgttttagtattagtaataaaataataaacaaatcatactacctccattccatattaattgtcgtctttggaaattgcttcatcaaacttcaaaatttttgaccatagatttatcaatatatacgacgactagtatataagatcactaccattagattcgtaacggaacatactatcgtaaaaatttaaaaaaatattgcaattgtgaataaaatattatataagaaattatcaatgaaagagtgatattggagaccgtgacagtcaactaagtgctaattaatatggaatggagggagtagtagacttccaatttcactctgaaattatatactccgattgcattccctgcacctgacaggtcctgaacatatccattgccattaccatcagcgaagatcataaaattcaaatgatgtacagagtggtattcttaaatcacaagccccattgtataatgctcgtcaaagggaatttcataatgatgatttgataaaaacatgtatatcgagcccacaatgttaatgatgcatgtaagtatggt

SEQ ID NO: 827 - DNA, 4795 bp, Portulaca oleracea
gtccttcatggtcaataaccctagccaataatcctaataaaaaagggttaatgaccaagaaggatggcccagaacaaattttgccactttggtactacctgaactgagaagtcctaatttttattaaaggccatgcttagctgactcatccattcatctccctcatcttctctctctaccaaaacaggggatctcctcttctctctctctaccaaaataggggaaggcagcaacgagatgcgaggatggcagttgctgggtggtcctggcgacggtcggggacaaccgtcggcagcccatacgccgaccaaaaaaaaacctaaagaccttcaatcataaaccatcaagcagtagtagtagcattgacgatacctgagctggttcttttaggtatgacaaattcgattatttcgggaattcggtcatgtacatttcaatccaatttaagagcaagtgaaggtcccgattccatagcaatagaaaagcgttctctccatatagtcaaccatttagtagaaaatcaatctttttgtttctcgttggttaacccagaaaagtacgcatttagggcatgggttccgacttgggtaaccgggtcagtcagcccgttttcaatcgcaactctggcgagattgatgcgttcttcggggggaaatctagggttcgtcttgaggatgtagtatcaaatcgccgggacgtattttccggcgtaacttttgccggtgatgtagatcggacgagatttgaagagggggtgtaatcggaggaagtattggatggcgatgaagaggtgttttgcgactccgatcttatcccgagggatttccaacgggtttccggcgatactggagccggttccgatggggttatcgaggaagaggaggccgaagaggcggttccaggcggcggagttaggattcaggcggagggttttggagttgatccatgtccactaatcaataacctcttaaatcccccctcctcccctccacccagattcatcttttgtctttcctatccctaaattgaatcaaatagtgccacaataattgagacaagaaaacctaattatccgccaaaattcgagtactaacgctaccgagaactaagatacaaacccaattgcccaccaaaattcatcagtaactatggcgttgggttaaccgttttcattcctccgaccaatttgcgtagttggcgtatgggtacagaggagagagaagagagcaacccctgttttcacgccggaacagggatgaaatggaccgcctatggctgccgacggttgtccccgacagtcgccgccaagaccccccagccactgccgtccttgccgctcgttgttgccttcttctgttttggtagagagagagaagaggagattccctattttggtagagagagaagaggagggagttgaatcgatgagtcagttaagcatgacccattttttaataaaaattaggacttttcagtttagacagtaccaaaatggcaaaatgtattctgagtcgtccttcttagtcattaacctaacaaaaaaaaatagaaaaggtcgagttaaaggcaataaaaggccgtggaaaggccctaatgatgatgtaggcaggtagcccaataatgtaacccatttaccagtagtattttagtggacaatttagcatacaaggttcacccgacccgctccgcccaaattgacatgtctgaccatattacattattacacttatacccccgaacttgtgtagtactctgctatactactacggactaccatagcggcactatcaagtatcaactattatcaacaagcaagcaagaggaaagaacacaaaggtctctttccaaatctttctccttcttcattttctcctcccaaattctccgattactattactatgcaaacgctactcttgccggcgacacgctccggcgctcctccaccgtcaccggtggcggtggcggcggccaatcattcatgtcttccaaggcagacgataccatgccgatgcatcatcatcaatggctttctccctcctctaatttcccgcacctctcgttcattgtcttcgtttaatcctctctcctcgacgcgtgcgttgaggtcggttcctaagcttcctccaatggcttcgtctcctgattctgctggcttgggttcatctgtcgatgagtctgaccaagctaaactcgctcaggtgactctaactcacactcaatttgattcgtaattcgtcaatttcgctagcaattttgatattcgtcattcattttgctatgattttggagcgtggagtgatatagatacctgatttttagctaaaccttaatttggaagcttttggttgtatgattatgcttctcaattgtaactgttgaaacacatttggacctatagtgctggtatttgtgcgaaatgttgttgaacacaatgccaaattgaatcctttaatttgaaactgcaacataataacgcattttgcggctgtacaagggtttgagatactaaactggaggacatgtcatcttatcttcttttagataaaagttgaaatgaaggtcaagtgacttaaggcttcagacttcgcgaaacttgattgaaaagagctaatttgaatactgtgactggaatattgcctaatgaatatgtgaaacttggaagagtgctctactttttgttgcctatgagtgtgaactgggtgaaactacagtcagtggtgatgcaataagttatgataaaacctgctgaaatggcaatatattggtgagtgatgaccgtttgaatttctaaaggtaaattttgcgttcgctccattgcacaagctctcttcccacgtgatcggcaaccttagcattgaatgggttataaagggctgaactgacttctatgcccctttccctaaacaactatgagctgtgagtttatctgtaccattgtaggctgcagggacacaatgtatgtgtgtagcttggaatccgattcatgttctatggttcattatggaataagctgattgaatttacatgccatggatcattatggaatcagttggcagaatttccatgccattggagcaacatttgcctatgaaaatgaaattgttgcttgcgttctagttgctggttttctgagtgtagtccaattttctcagcattgcatcatctgcatgtgcatttttgtcctttgggaaatatatgagcatacttgtgattaggacttcatcagcatggttccaagaaaaaaagattgattgctattgggcacaccaaggacttttgtagtttctgggtttttcatctttgtttaaatttgtggtgaggaatggtattgcattttggtatataggtggcaaagagactagaaaacacagctaggtacttcagaaggttgggctcgtttgggttctggagccagctggtgtgcactgttgttgctgcggtgattcttgcattttctgttgtagtgaccgggaagatcacgtcacctgcttccttctatgctactgctgggggaatagctgctgcatttatctcggtcttctggtcctttggatatcttcgcctatccgagaaacttcgaagaactgcaactgaaccatccaaggtatgtcaccagtgagtagtgtcaccttccaccgtttccaatcgtttatggtttattttaattgccattaacagcggacatctttgaatttctggtgcattgctgtgtatcctatgccacaatgatttacaacgaccatcgtgtataatgttttcacatacttgtgcaattgctgtccatatgtgtccaaggattctggagttcaatacttgatgaattaataacatagtttataaggtacttcagctcaggctacgaatcacaggtgttctacaatgtgttggttgtactgctttcacgcttaacagagacctttgttcatctccgatagaggttctagtgtacaatagggttcttatgcctttgcctatcttcatgcttgtcacaggtttacactttttttaaggcttaattaatatggtcattagtcaacattttatatgattgcatgatgtgacgtgctcaaatttaatttcaaatgcatgattgtagtattccttccacaatttcaggctcctcctcgcgctgacgttgtcaaaagcttgaataatggaataattgtgaaccttctcggaatgggtgccgctatcctgggaatgcaagcgactgttggtttacttgttgccaaagcactcactacgtcttcaaatccttattacccaggagtggctgctggggctagccctgttcttccgctggatgtgttcttggtacaggtatacctctgtttttccagtgtagattgcataaatagtgcaatgttccattagcactcccctcccctcccctcctctcagcacctcgtcctaaaggaagagagaaaaatccaggaaaaggtaagttctaaaaaggaaaggagaatagcagggcaagacaaagtagtagacattatttgtctccaacaatattgttgcataacagaatctcttactatcccctctttattcttcatatgttctttttttcaacatggtgggtagttgtataatggtgtatggattaccatgcccactctttattcttcatatggatagtgatcccaaaatcactaatagcaagaaggtaagcgatccgtcctcatctaccatctgaaaatgatgcttgtgtcttagaacgataactaactataatataaatttgataaagaagcacatatgtgatattcagtgatagccaaaaaccatcactta

SEQ ID NO: 828 - DNA, 12031 bp, Portulaca oleracea
  unsure (1)..(12031): unsure at all n locations
aacaatgtccgaactctgtttcataacaccatttatgccaaaaaaatagttttgtcggggcatgatgcgtctgcgccgttcttctgcagcaagcgatcgccgcgcgacagattcaggccggggatgagaccgtcggcgatggtggagtcggcgacagattcgtctgcagttgggggttgagcaggcacagagagtttctttcttgtgaatcgtttatctgccgaattgaaacttctaaccttttttttttttgctacttaagggcaatttagggataacgcctacgaaatggattatttttgttattaagcctaccatttggaataggtaaaannnnnnnnnaccacttggaatacccaatagttggtgnnnnnnntttggaatttccctaaattttatcaaagaggtctgtgaacacaataaaagtaaattgtggcaattcaaataatttattttgcaaccaaaacaaaaatcaaactccaatttatgttggtttcgttgtctttctcgcctaacatgtcttctccatatttcttcaaccaaatcatgttggagttgtgcgtgtgttatcgggtcatggacaatttccaattgtcgaaggtatgtctcataacatggatggtgatgacactgcacattaatgtctgtagttgaactgtctatatgagtcactttcatcttcgacaatcatgttatggagaattacacaagccttcatcactatctcatgtcatcctccaccatgaacctagttgggccacgaacgatgccaaagcgagcttgtagtacaccaaatgcccgctcgacgtctttcctacacatattcttgatgctcagcaaataacttttgctttggaccttgggggtgcgggattgttttcacaaaggtagctcatttaggatatattccgtcagatagaaagtatcccattttatattgttgaccattcaccacatattcacatttcggagctctatctagatataactcaagaaatacatgggaacaatgtaacacatttatgtcattcagacttcctggttgttcgaagaaggcatgtcatgtccaggtgtcatgtgaagcaactgcttcaaggataattgttggtactttgtgaagtcttttctcataagactgtctccatgcagttggacaatttttccaagtccaatgcatgcagtcaatgctccctaacatgccgggaaaatcacatgtcttccctacttgtagtagacgatcaacatcggcctgtgtcggcttccttaagtacttatctccaaatacttcacaagtgtgtgtgttgaatatctttaggcactctgtagatgtactctcgccgatatttaagtattcatcaacacaatcggcaactataccatatgctaacatacgaatggttgcggtgaacttcgttagtggtgtcaacccaagccgcccagttgcatcgtgtctcaactggaagtactctgaatgattaccaagagtctccactatacaaaggaaaatatgtctttgcattcgaaatctacgtcgaaattgttctttagtgtagacaggattatctgcgaagtaatcctcatataggtgactatggttttaatggcggtatgttgtaatggccaaggtggcaacttcaacgatgagttcgagccaacctttagtggagacagggttcggatctacggtcgctccggttagattctcttcctcaccctagaccatgcctcagggttcggtttccgatccaagaaagggtacttgtacggaaggattgatatacaaatgaaactcatccctggagactctgctggcactgtcactacattttatgtaagtcattttttatccacttaatctgttaatacaaagttttgtgctttaatcaaattaatggtgcgttatcattacttaatttaccagtcttataaaggctgaagcagagtgccctttgctgattacatgatcatatggtttgtcaaattgcagttgtcatatgaaggatctgacgcacgatgagattgactttgagttcttagggaatggaagtaggcaaccttataccctccatacgaatgtttttagttaaggcaagggagatcgagaacagcaattacacctttggtttaatccaaccagaaacttccatacttattcaaatgtttggagcaccaaactaatcatgtaagtatggactatagaaattaatactactacttagcgtttagtttggcaatctccatttcggccactggtctccaccttggaactgacattaactctgcattcgtgaaggagtcaatgtttctaaatgtagttcccttaagtcaacacttttggaggtggtttttgaatttaatcaatcgcatcctgaggattagacaatttccgcaaaagaaactactaattaaaccagtagtggagatggggaatggggtggaagatctagatggagcaaaggatgagcatgtgaacattaactctgcatgtcaacgagatagttctattaccataccatcagaattgatgcaacatgcttctgggccaaattattggaatggtaaaaaaatcaacgacaagaatgtgaatacttcaatggatgaggatgatttaagttgtttgacatcttttaacaaagtagatgacatttagacactcatgggtggaacaaacaatattgaggagatggaaacaagttcacttgatagaggtgttggtggttgtgatcaagatatggttattttttatgtgcaagtaagtcgggaaattttatgagaatttcctaagaagtctaccatcaaatattagaaagacaaaatgtgagttttccctgcaggaagcgccaaagtttttaaaaagtttcgaaggtttttgcttttggtcctacaaagatgtcacttatggacaaaggtaaaagggatgaggaagttgaatcatgtataagtatggttggaccttaggaattggtacataggatggattatgaggaacaacaagaagaaaatgacgacttagaaactgtgacatctcattccccacatgttctagaggaccgaatagatctatcaagtaacaagcaggatgacgtcatcattttcaagtcttagtctcaatccctggaaagaaagcgaacttctaaaaatgggtagatttctccacgcaggtatggtagtataaacagtatcagaaacaagcaatatagatcaaagtccttcggaataagtgagtgctctcttagtaagtcttttacttttaaaactacttccatttacatgaaactggtgtatactagcattaaagcaaaaaggaaacgtgagtagggatgacgataggtcgagttccgggcgagtagagatgtactcttacccgtacttgttttcaaaattaatacccttacctttacccatatttagagggtactaaaaattagtacacttaccgtacccaccgggtatgcgggcataaagggtactatttagatataaataaagattaaattatacaacccattttatacccatatgcacaaatttacggatcgtattcgagtgctttaactacaattttagggtttgtttaagtgcgagtggaggaatttgaaggaaccttaaactagcatcttgataacaacccaaatggaaaaaaggaagaagaaagtgtactaactttcgaatttagatgtagtacaataatattaagggtttttggccacaaataatccgtattgaaggatgtgactaataataatccaaagtgacttttcggtaactggcagtctgtactttttcactattttctcatagcagtccagttcaattttaatttcggcaccgaaaagctgacatggtgaccggaaagtatgtttattcaaacttcaaaaaggaaatgtctggtctccacgttagttttttagtgccggaaatttattctggactactatgcgaaaatagtcaaaaagtacagactgctagtggccgaaaagtcactttnnnnnnnnnnnnnnnnnnnnnnnnnnnnnacggattatttgtggccaaaaacagtagttttcatgttttttttttcaaaagtatgggttgaaagcgtgaaacagctaagtccaatttgacgtggagtatggactgcgtatgcgagcattgtatggattttttaagtgtgggtcgggtgggtacccaccaggtcctcctttgtacccatacccgcatattttcaaaaaatagtacccatacccattttttcagggtcggataggagcgggtacccacaggtacgggtattattgccacccctaaacgtgagcaaatgaagaacggtgccatacctctggtccgaaaaagacgctttataaggaagagatgtgatggtaccatacctccagtcaaaaaaagattgtaattatggatttggaaggagaccaatgtatacataaactgatatattttgtttatgaatgatattgactattctgaccaaaaaaaaaagaaaaaagaatacatttcaaagtgaaatttctttgataacttcaaataagctaaaggttcaaagggaaaaagattctcaagtcatgtgttgatggcttcttcttattagcttatatgcacatatatattaatccacataacccgatgcattaacttgtacaaaaaaaataatatagccggtcatttatcaaattacttaattaatatagccggtcaacgtacgatatatgttattaacaattgtactcctccctccgtttttatttatatatcgtccaggaaattgtgttaaaaattttaacaattaatattttaatttgtataatgattcatcatgtaaaattgatttcattcgattcctaataaaaaatacaattaataaagtataatattatatttttattgtgttaaaaactttgacagtcaatattttaatttgtataatgattcatcatgtaaaattgatgtcactcgattcgtaataaaaaaatactattnnnnnnnnnnnnnnnnnnnnnnnnnnnnnnattttatattagaaattattgatcgaagattaatattgaaaaccgtaaatgacagataaaaaagaatggaaacattatgatttagatccaaaactaaaatgtaagtgaaagagtgtaagtacttgtttggtatagaatgtttttggagttaaaaaacacaaactaagccaaatagtgttttttttttagaagctgataattatttttcggaaacagttttgacaaaaaacaggttcaaaagcataaacagtaaatatttgatgaaacctacacatttacttgtacttacttttttttttatcaaaaggtgcaacttattcaaaaataatattttttccaccaaatctttattataaaaaattatcaaaacttaacttttactatctcatctatttcccatcaaattttataggttgttaggtcaaatagaaacttgaaatagagcagtatcctgggggtgtccaacaaaaaacctaaaccaaaaatcacaccgcaaaatcgcataaaccaaactgctaaaagtgattaaccatttaaattttttgaaagttgcagttaggttaaccaaatcagtttaagtggtttaggttacggttttgcattttcgtgaaacggttaaccgcggttaaccggtcttgattaatttagtagcaaaatttgaaattttaaagaaaaatgttcatttttcttccttgttattttaagttactaggaaccgacgattaaccgcagttaaccataaaaggacctaaaaagtagttaaccatgttatcaatgcggttaaccaacagattcggtttctagtttccaaaaatggttaaccacaaatcagttagtcgcataaaacggtttaggtttagatttataaaatctgcaaaccacaaatacggttaactagttttggacaccctaatcctaggcactcgcggattggggtgaatctttcaacattaattgttagtattgtaagtttgtatggagtttgtcgattggtttgcttcattggcaaccaaccaaccaccccatccttcatccccttatttcatccttttcggactttgaataatgaaaaaaaacttagtcttgaactttatctttgacaattttgaatcttgaaacattttaattttgaaacattatcaaactaattttatttatttatttattttaaaaatacaatactgatatatgatgattgaaagttgaaacacatacatacgtacacatccataagattgatatctattgacaaattcactgtacaatactctaaacaaaggcaaaataattatacaatgagataaaattagaggtgactatattgatgatgtgcactaaccacacatggttgatttttattaccgcaactcatcatgctaccatgccatgattatatacacattaataattaacttgccaaatttcatcttaaacaggcctattaatttaaaagccctaaataacccaaccccgttcaaagccctatatgtccgtttgcaccgaccaacccattacgataatctttaatcatatttagaaactttttctttttcatatttccaaaaaattaaaaaattcagtaaaaagcactatgcaaacgctacttcttccggcgactcgctccgccgctccaccgccggctgcgtcgccggctccggtagttcatttgcattttccggcgaggataacttgtgctggtcgttctctctcccctccgaattctctgtctatctcttcgttttcgtcttcgtcactttcttctctctcctcaaaaaatgcgatcaggaatgttggcgttctactaccttccatggctacttctcctgttgcgactggattttcttcatcggcgtttgaatccgagcaagcgaaactcgctcaggtaactttcctggggtaagctgactatcagttgcgaattttaaagtttggtttgtatttgagattttctttctcacctgctatgctcactgatacctggaatatcgggttagacctgattaagatgtcattgtgatttttcgcgtgtaattgactggagttagcgtttgcaaattgtgcagtaatagtaaattgtttctcacgaagttggataggagcttttgtttgaaatcttagagcaatttgtaagtgcataagggtttaaggtagcatttaggaggaagagattgaaaaagtgaaattccagcgcataaattttgtgtgttttgattaaatgaaatcacttaattgagttcaagtttgtacaaaaccgggttaaggtagtctggtttccttggaagttggaaggcaacttatatactaaaagaaaacaatgcatatatttctatttgcttatgctgatggatcttgtgtgagttgtagacttgtagttgttaagctaattcaatgaggggttttctctttgagatctctgagtgaatttcgttcaaatttgttgattacttgaaaggatgtgatgttttatgctcttagctttgcaattgaaatctgctcgtcacaaaatacgcttgtgaatggcaacatgagaattgggcctatctgactgccataaatgttgggataaataattacaagctaatcttggttaattctatagttcaaattattgataatttggaagcgtttactgctgtcaaatcaaagtctacttcttgaagatgtacaccaggaaatgccaacacaaaacttgctttgattattggtaatctagggttttaacatatttgaggggacacacgttccgcttcttagtcagttataatgatttctgcactttgatgagatttttcttgtggcttcaatttaaggtatatgtttggattttggaataggtagccaggagattgcaaaatactgcaagatatttcaaaaggttaggcagttttgcgttctgggggcagctgttgtgcacgattgttgctgctgtgattcttgcattctccactgtagtcaccgggaaaatcacatcacctccgaccttttatgccacagctggtggaatagctgcagcgtttatttctatcttttggtcatttggttaccttcgcctctcagaaagacttcgtaaaacagccaatgacccttcaaaggtatgacattatagaatttactgcttacagtgtgagtttggactgttgtttttgtttttctgttgccaatgacttgcttggctctgggttgtcttggaaaatggatcagagacactaattctatgtcaaatcaatagtgctttgtacatgccagagggaatgtaaaatttacccttggttcctggatgactgcttagggagttcaaactgcttcttacagtgtgagtttgcacagttggttacgctttttgtttttgctttcccaccatcgatgactttgcttggctctggtttgtcttgaaaagtggatgagagacggtaacgctatgtcaaatgaatgatgcttcgtatactccagatggaatgtaaacttcacccttaattggttcctggatcgaagttcttattattgcagtaaatcgtagcatttgtttctcgtagtaagaaaatccttggctgatggtataatcagttcatgcagctgcctacctgatcctttgtgattttgttatcatttcattgtatctttgtgaaagcatgctgaagttattgctgaacttataatttgagaatgtttgtaaggttaactggatattttaagaggatttaagttaggctataaacatcctcaggtcaccatggatatttggatttgtgtttaggtcttgacatagacattatatttctgtagcaacttgttggtcactatatatcgctgcacttgattggatcctaatagaaactgtccgaacagaagaatcttattggtgtatgctttgcgtattctattttagagggttcttgatggtttcaggctccccctcgtgttgatgtcgttaaaggtctgagaaatggaataattgttaatctttcttggtatgggtttctgccatcctgggattgttagcaactgttgggcttcttgttgcaaaagccctcacaacatcctcaactccctattatcagggtatatctcccggatacagccctgttcttgctctggacgtgttcttggtgcaggtattgtcttcgtcccaattttgagtggcttaatcttgcacgcctaattttgtaacattggccagctaacactatacttatatcttcgtttcttcacttgaactgcaggcatcagctaacactatactatctcatttcatcggtcttgtttgctccttggaactgttgcgatcagtatcattgacacctgctcaaacagctccgattcccaaacttgcttaggtcttgacaatgcacttggtttaaatggtacaagagtgtagcatccagaagaattcaatggtctagagcacagcctttggatgttttttgctaggtgatcttgtattctgctgttactattcatgtctgaacaatgtgaataacatctttgaacaaataagttcagaggctactatggataattttgatcaatgtgatgtaaaacaatgaaatctgtatacgcttccagccctaatgggacagccattatctgtccattgaattttgagagctccatatgtgatcataaccatctacaaatgatcaccatattattccagttaattcttcacctgaaatatccgtaaactaaagcacagaatccagcatccagcttcatatccttccatatggctaccagaggataaagagtggaagtcatttaccccaaagtgctgctacagcaaccaacttaatattcaacctcataacaagatgttcctctgccagtatcattcatcttaacttgtttccatgcagggttcaatgggtcgtctaagaagcatcagtacctttatagaaatactcgtacagtttcaaagaaatgcccctttttcgctgacaatgaatcattgcttaacaaaaacaataagatgctactctgtaggaattgtcgtggccatatttagcatttgcctaaccattaccttagctaccaaccaacaacttaagggttgtacatggtagccaaatgaagactcttatccttattgaagtagagacgacccctgtcatccacattcataatctcccatacaacaccaacatttccaattgcaaatgctaagtgattgaagagaacctaattacaaagtggaaggagcaacaattggtccactcgataagaatatgatcttataactcaaaaattccaatgtcgatgtcagagccccattggtgaacgatgtaaatatcattgtaagtgctcttagcaaaaagagtatggaggtatgcctcggtcctaatgagccataggacccaactcacctaaatgttttctacatcaaacaaaaaaagtggtgtgggttatagctttagctccataggcctttcgctggaaatgcaaggcctctccatatcttattatcgacgatgaagttgatggagtcgagaagagtaagaggtacacttaccgatatggtggcatacaacactctgcttcccagttcacttaataattgaactttaaattagcacaatcaccattcaggtttagcattgttgttgagcttcatgagcactcatgatatataaaatattagcttttttagaagcataattttcattatacatgtatggtaccgtacttgataagaaagacaatcttatttcttattttcagggtgtgttcctctagagataaggttgggtaaacttgccctagaacactcagttttggccctgttgaattgtgcattttattatgtgcctaatttttgtgctaataactttcactatctagacacctgggcaaacgcactacaaaaacaagagtatatggcacaaatatagtaaatcagcagtttaggcagaagtagtgccactgccaagcattcaacagaaataagacaacatcatcaaaagtaatggggtgttgaacaatcaaatcaacattcagaatcatgtggtaaaattctacacttcagaaaagcgtatcaacaaaaatccaagaggaatgtacttcggattcccaagacaccattcattcttccaggccaatgtggagtcttgaggcttgcaagaataatacaacaaagcaaagctaccggcgtacttcctgtagaattgagacgacaaacacgttctaaagaaaagccactatatactactaatcagttacacagagatctagagtaatttctacatcaatttgacaatcccaagttcaccacctaaaacaaatctcacaacccctcttccacactggtaacaggctccatcagtggcccacgctccagttaaaaaaatttactggcttctcaaaaccaagcaaatgccgaagttaactcctctgccattagaatctagaggacgagcagtcacccacatattatgtgcttctaggaaagtctatgttatgcacactaagaacacccagccaagataatcctgcaaagagaacaaaatcaaacaaaagcacattaggccacaaacaattaaaaatcaccatttcacaaagacgagctacgaaaggtttgcgcagttccagacatgcacatgatagtcttagcgtgcctaactgcctatcacatgaactaatgctgtcaaaaaatagagacagacatgcaagctatagctgtcttaaatcctgcaggaaaagcctcttcaaggctgaaagtctctttaatgcattaggataccggtcatgcatccattcttttgatcctaatatataggagaataatttgttaaatttccctgatctaaacccacaatttcagctaattaacatgaacaaatatgtagaatcaaggataggaagacaaacctataaattggaaaaaaaccaagagaaaatcatccaaaatattcaggctcagtaccacaatgtcttaggctccgtttggtccttgaaaagtaggatggaaagaaaaatttttgaaacatcatttattttccttaacttggctttaaaaagttggaggaagaaga

SEQ ID NO: 829 - DNA, 1232 bp, Senna obtusifolia
attcggacaacagctgaagctttgtcttcttgtagtaatgcaaacgctacttctgccggctgctcgcggcggcattctcacggcggcgacgccggtttcgtcggctgcttctgccggctcacctcctcagctccaccgacttcttcgccgcccgaattcgtcgccctcgctctctcttccctctttcgaatcttctcactctctcacttcttcatcttcactgtcttcttcctctttcggtgttgtctatcgaccaaagaagctctctttctgtgtaaacgcatcttcgcaagtttctgcagcttttactccctccagtgatgaatcagagagagcaaaacttgctcaggtttcaaagagattggagaagactgcaaggtatttcaagcgtttgggtaatttaggattttgggggcagctagtctgtactgtggtggcagctgtaatactgtcattttccgttgttgtcactggaagggtcacatctccggccactttttatgctactgctggtggaatagctgctgcttttgtatctgtgttctggtcatttggatatattcggctatctgataagcttcgaagaactgccaatgatccgactaaggctcctccccgtgctgatgtagtgaaaagcttgaagaatggaatagtagtaaaccttttgggaatgggtgcagctattcttggcatgcaagccacggttggattgttggttgcaaaggctctgacttcctcagccaacccatattatcagggaatctctcctggatatagccctgttcttgcattggatgtatttttggttcaggcttcagcaaatacaattctttctcatttcctcgggcttgttttctcattggagttgttgcgatcggtcacgttaccaccgtcagaagctactcctgttcccaagcttgcataaggcgtgccgagaggcaagtacaatgtaattacagtttaagatgtatcctcctcatttgtagtggttgctgtattgatgaattttgcaactattttagatctcaggcatgatttatttctaagtttgaaaggactagtgtaatgttgtctaataagcatgacttcacctgagaatttcagtatatctatattccatggtccatgtacaacaatgggtggagtttaaccacactgtccacaacttgtatatgtgtttgggttcacacattatggtagattttcaatttatgaatgtcaattgtagaatt

SEQ ID NO: 830 - DNA, 1078 bp, Setaria viridis
gcatcgccatcgcaaaatgcaggcgctcctactccccgcgcggtccgcgccgccgccgccggcggtggcggcgtcgatgcttcggcagcacgcggtttccgcatccgcgtgtgcgtcgcaggcccgccgcccgctacccggctccgccggtcgcctaagatgtggcgtccgcgaaagcactcggcggcgcctcacagcggcggcggcggcggcgtcctcatcctcatcgggaccaatctacccgacgcccccaccaacagaggaggaggtggagcgggtcaagctcgagcaggttaagaagaggctagagaaaacagcaaggtatttcaagaatttgggtaccctaggattctggtcccagttggtgtgcacaattgtttctggtggaattttgtcgttctccacggttgcgatggggaaggtgactgcacccttcacattctatgcgactgctgctggtattgctgctgcttttgtttcagtcttctggtcatttggttatattcgtctctctgaaaggcttagaagaacggcaaaagaacctgctaaggctcccccacgcgccgatgttgtcaggagtctcaaaaatggcattctgcttaatatgctcgggatgggcgctgctgttctggggatgcaggcgactgttggtgctttggtagcaaaagctctcacaacctctacagtaccgtatcaggctgcccctggccaaagccctgttttatctatagatgttttcctagtccaggcttcggcgaacaccatcctgtcgcacttcctggggctcgcgagctcccttgagctgctgcgctcggtgtcgttgcccccagcggaagccgctccggcccctgcccctgcgcgggcctgagcacattccgaccatgccgagcaagaaagagatctgcattcctggggctctgcacctgttgttcctttttgtatgtaagaactagcatcaggctgacgcatcgatgcttttgggtttaattttaaaccaacgtgttcccgtattttcgtggcgcgagccttcgcacaagtaattacatgtggctctagtgatgggctggctcgtttgctt

SEQ ID NO: 831 - DNA, 1153 bp, Sorghum halepense
ggatagcatcgtcatcgcaaaatgcaggcgctcctactccccgcgcgggccgcgccgccgccgccgccggcgatgcttcggcagcgtgcggtttccgcgtccgcttgtgcgtcgcaggtctgccgcaccctactcagcgcctccggttgcctcagctgtggggtccacggaagcgctcgacggcacctcacagtggcggtggcggcggcctcgtcctcatcctcgccctcgtcgggaccgctctacccgacgcctccacccaccgagcaggaggtggagcgggtcaagctcgagcaggttatgaagagactagagaaaacagcaaggtatttcaagaatttgggtagctttgggttctggtcccagttggtgtgcacaattgtttctgctgggattttggcattctctacagttgtaacggggaaggtgacagcaccctttacattctatgcaactgctgctggtattgctgctgcttttatctcagtcttctggtcatttggttacatccgtctctctgaaaggcttagaagaacatcaaaagaacctgctaaggctcctccacgcgctgatgttgttaagagcctgaaaaatggcatcgtgcttaatattcttgggatgggtgctgctgttctcggcatgcaagctactgttggtgctttggtagcaaaagctctcaccacctctgcagtaccctattatgctgctgctcctggccaaagccctgtcttggctttagatgttttcctagttcaggcttcagcgaacaccatcctgtcgcatttccttgggctggcgagcaccctggagctgctgcgctcggtgtcactgcctccagcggaagctgccccggcccctacccctgcacgggcctgagccatcatggcccgtggcaggtcaagaaagaaccctcatcccttcggctctactagacacttgctgttctttgattgtatctacatcttgcatcaatcttactgaagcttagtgcttacagacacatcgcatgccttccagttcagctggaaaccaatatgttcgcgtaatcctcgccgagtgtgtgtgagctcttgcatgagcacgcgcatgtttgctgtacaagtgagtgtactggctcgctcgttcgttcctaattattgtacccgcttcttcg

SEQ ID NO: 832 - DNA, 3609 bp, Sorghum halepense
tttctttctaatgggaaagtttgttttgtgtagtctggcatagattatcttcacacaaatattggaacatgggtccacaactgaaaatcaatattaattttcatcataactaaagctctagacctccattaatttttaaagtccaactcatgttggtccaattggtattactatatttgcttgacattgtggcagtccatttctattgtttatttcaataactagtattttcgctatgttattgctgatacaagagcactaatcgttttcttgccatctacaggcttcagccaacacaatcctttcacatttccttgggatatccagctcactggagctacttcggtctgtaacattgtcccaaacagaagctgccccagtgccaaaaccggcattgcggtctgtaacattgtctcaaacagaagctgccccagtgccaaaaccagcatgagcgtggctgcaaagtcctcctgagtcctgacctgaagagtatatcaccagtttttttggttgtcttttatattgtatagtccaacgcggatctattgtatccatggatctccgctcgttttgaaccatatgatcttaaatcgatctaagtttgaatgacagcttccaaacatacgaaagctgcctcacagaactaccgcattgctgtcaggttagaaacccggttccagctccagattatggttttctttttactgcagggagcaagtttctttgcttgcacatcatcaagatgtgtctaaaggcagaaattaacaaatttatttatataaccaaaagatgtgcagcacaatatacacaaaacaaaaccttcatttcccatgctattgtaaagcactgtttgttacattcaactctgggtaatgttcaaaaaacacaggttaacagccagtaaccctcatggcctctaccactgccatatggacggaccctgtatatttcctaagagatgtacaagatgaacaaaatcaaaccttcaaccaagcaaaaactgacgccctgtcagaaccagtctccaagaattagaaactccagtcagcgcctatgcctcgtcatgcatagcataacataaccccctgacccagtaacactgcagctatatccaacaaaagaactcgtcaaactcttgcagtcctcatgatccgaagtggcttgattgtcgcttcaagattgtcagcctgcatgtcgagattccctgagtccaattccatcggctgtatgtcatccgaagcatccgcgtcttcagggacttcaatatcggaaccaagttcaatgaagtcagcaaagtcctcaccagagacttgctctggtttttgtctctcttcttcctccaaagaaactatccttgctccactgccatggccaatgcttgtctcaaaataccgaccccaactgttgttttggacggtgtctactttgcttctcttggatttgtttttcttcttggggtgatgaagcttgcatcttgattcttgtgggcactctcctgtcgcctcaaagacggggcatacatagctgtgctttttacgacactgctcgtaacagagattgtttcaagtccatgaaaagattagtgatcttgattcagaaccataaaggttcatcaaaggccccagaagtttaaaagatgaaaaagctctgttttaaagcagagacgtgtttttacaaagcagagacagcatgcttttccagcataggtttcccccaaaaggaggcaacctttctgatctatttatctatgaagaatcaacactccactgaattagattatcctaaaggaactaaaaggtggatattttaacactcttatgtcctataaaacatttcatgttagaacgaatataaaaaggaaggacaccaacctacatatattaattctgataaaaaacaagccagtggaagcaagctttatgctacctccataagaaatcatgtgcctacctaccctccaatgcaaggtgcggaacaaaaatttaagatcaatataaatctagtgatatcataaatacctcatcaccatcagcacaatatcccttcaaaaaatcttcgcaaacaggggcgttcgagttcactttcacatgcctatagggacaggctgtgttggtacagagccctgctagcaatggcaaacatacatgtaagaaggcaatcaattgcaaaggatagtaaacaacgatacaatgacactgaaatgaatcaccttgcagaaagtaagaacaatctggcattctttctggcaggacctgcaggacagatactcatgatggaaaagaatgaagccatgatcaccagtagaatcaagaagaaatcttaccttgtgagttagtttgcaactagtactagaacacaagccattaagaaatttagtacagatagccactttagctcggtcatgaatataggggcacttgccaccagattttttacactcgccaaagcgagtgaagaattgacaatattgctgtttctttgccaaccgtcttctaacagtgtgcaaactccatcgaactttctcacttgctagcatgcggattactttctttggatttctgaccagttggttacctttgttaacacgcacatatctgcttatagaaagacaggtagagaaagagatgtcatgattctgtctgttattcctaatacaagatacaatgcaacatggtgcgaaacatactctgaagatgctctgctgctatttgttaattgattggcagcaactgatgcagaatatcgatctgaaaacaaaatgggaatcatgaaccgcaagtgaaaacaacacaagtctagtgagaagtggaaagatcagatatgataattaggagactaggtactgatagctcaaaaaaaggtagccaaaccaaagtgttccaacatgggaaggtacataatcttgaataattactaattttcaaccatggatcttaaactgggctacaaaaagtacatgtctcacatgttagacttagacaacacaaattgaacatcaatttggcacatcagtaactcattaaattttaaggtgaagaagcatgaaagattgaaagtcatatgaaaaacagaacaattgcattgttgcattgcatggaattatacagttacgtatctcatgcatatgatattttagtttatcggaagatacctaatgcattaccattccttcctttgttacggagagactgtcgttttctcttttctcttttctttctttcaacttcagcaactgcctgcgtagcttcctgcaatccagatttgagattccttatgtttgatcaagcaaaaattgtgcaaggcagcagctctataaactaaacaaaaataatgttcttggtgttgaaaacatagaaactatgcaagttactgattctgaaataacatttaatttaacaaatgaaacaaggaaacaagatagtctagtctatgttctgatgaccctactaacagtctaataaatgttaactctcaaacagggattcattcagaattaagaataatatttatatttgagatcagccaacaaacttcagttagaagcttcaagagctaaaagaaaaatccagttatatttaaatctatcctaacatgtttccattgaattcc

SEQ ID NO: 833 - DNA, 2022 bp, Sorghum halepense
  unsure (1)..(2022): unsure at all n locations
ccttggtaagattttgaggctccttcgatcaagaaatgtagttagctgtggactatgcagatggtttcttgttcgaggaaatgcacttgggcaggatttgttttgcggcactgggtgagatgtgtgttatatgtcgcttattaggaattgttacagcagggagaaggaacggaaacaaatttgtggggagctatttaagggtagatctttgttggtagttgataattcttgatttttcactgtagcatcagcttgttgtcagatggttgataggcatgattactcttgtccaattctaaaagcatcaacgaaggcttgcttgcagtttagttccatgtgcttattaggatttcttagttcatgcttaggcccttattaatacaagaggcatgaaaaaaatagttttaactcatataccatttaatcgaggtatacaaattgtggaagttctagtacaatgagctggtcaatctccagtcttttttgtttgaaatcatgttgcttatttgcatggtgtcattgttaaatcgatcatgcgttccttgctcatctctaaatggcctcacacatgtacagtgattctgaaatatcggtttttctctatttattttgtattggctaaatggacaggttatgaagagactagagaaaacagcaaggtatttcaagaatttgggtagctttgggttctggtcccagttggtgtgcacaattgtttctgctgggattttggcattctctacagttgtaacggggaaggtgacagcaccctttacattctatgcaactgctgctggtattgctgctgcttttatctcagtcttctggtcatttggttacatccgtctctctgaaaggcttagaagaacatcaaaagaacctgctaaggtacccccttttctctactgtgcactgattttacattgttagctgcaataacagaactattcacatgaaagaagttttcccaaaagtcttcgtagacctctttccagtgaaaaatctctgcacctctttcccactggctttggctcatcatttttttttacctgcctactgccattccctgtgctactgagcgatatttactccctccattccaaattataagtagttttggtatttctagattcagatatatgtctaagtgcacagcaaaagttatgaatctagaaaagccaaaannnnntataatttggaacagagggaatatcaattatcatagacaacttctagctgcttttcaacatatgtattgtatagttaactttgttagcaatcttggttaagttagaaattaaactgttttttgtttgcataatttcattaagatacatatgaaattatcaattaattgcttttcaggctcctccacgcgctgatgttgttaagagcctgaaaaatggcattgtgcttaatattctcgggatgggtgccgctgttctcggcatgcaagctactgttggtgctttggtagcaaaagctctcaccacctctgcagtaccctattatgctgctgctcctggccaaagccctgtcttggctttagatgttttcctagttcaggtactcgattgtttactcctattaccatttggcatgaatcatcctctcatcaaaatttgcacatgtaacaagtcaaacagttcaaattctcttgttttcagcatacttaatcagcctttcttggataaagtagcttaatcagccttggcctttggttttggagtactgcacttaacttcatttttacctgaaaatagtccttctgtagagtttacaaagtgtttgcttagtgaaatcacatgtctcataaaaagcattttgtcactttcttgagatcatttttgtcctggtagattcttgtagtagtagaacaactcgacatagcactgtaggagtacattggaaaggcgccatgacttctaggaataacatcaaaatcaatgcagcctgcgacctgacaatgcaaataattgtaggacactccaagattagaatcgtgcagacatttgctactct

SEQ ID NO: 834 - DNA, 15614 bp, Spirodela polyrrhiza
  unsure (1)..(15614): unsure at all n locations
ctgtagagatctctcgctataccttggaatgaattcatagtttgttatcccaacaacattttccttttgagacatcaagaaaggattagccttgtaaaatatattaaaaaaatatatccaataaataactattaaacctggggataaataggagataacttacactagtccatttgcatttcttctttttgccatgatatggataacttatatctgtgtcaacacctccattcataatgacaaattcgtaggcatagtgaacatggccagtgttacagcatccggtctttctcatttcacaatccaatatttgctgctctgaaagagttactaattcaccagtagtgatttgatttaccccttcaatggctgctatagcagaaaatgcccaacaacaccctaaattcaaaataaaacatggcgtgagttcataatgtcatctaaaataattttagtattataggaaaacttattattgtgggacttttatagcagtaattgaatgtattgatatattaaaatgaatcaaataaataaattgatttgacaaagagcctatacaaataccatagagagtttagaatttgtaaaataagtcaatggcatatattgataaaaagaaaataaaaacttgtgaaataaatatagttttttcttctctaccatgacaaatcaattgatttaatgtaggcatttctctttccttctcaaagataggagcatggataaataatcctagcactcacattgaagggagtcttagcaaatccagcgccttttattatatatatatatattaccttgatgagaaaattaaatacttaattagttgatgccatgttgaaagcatgcattcttctacccaatgccttaaaaattagcacacgatggaccaataggagatatttattgaaaaactaaaatcctatgtgcatgtgtttcgttaataatcatactgggtaaataatattgtatactggaaacaaaaatcatctgactttgaggaaagctatttaagtgtgcaagagctaccgaacaaacttactacatcttccttgatccttcacaagggcaacagccccgctgaacctccaatctacgaaatcaggcagtatttcgccatccttgtacaggtatcgattactctcagagaagatgaactgttcagttgtgttagtgtaggtattgaggtaatgggaagcaaattctttataggtgagatccgcaaattggttgaggccgagggtatatgaacggttgttcttgaggcgattgtgttcctcaatgaggtgaagattttctttgaagatctcaaatctctgctccctctcgctgagctcattgtacgacttatcatgcacaaccagccactcctcatacagccatttaatctcctctccagcctttgagaatttctcttcctctccatctctattggaacttgtgaggggcgaatctgatgaagaggagagagagagagtagctgaagtaaggaagatagccaccacaaatgcagccccataaccccgccccatgattccaactacagtcagggctcccaagagtcgcttaaaaatcggatggagaacaaggggcgaccatgcggagaccagaacggaaaacactagtggttgcgcggtaaagaagctatgtagaactgaatatatgtgtctctgcgtgcgtgtatatatatgtgttgaggaagggagagagagagaaagatggtcgcccgtggattgtcactgatgaatacttcgtgggaagcatgaaacttaccctttaagcgtctttgcgcatggccctttgtcggcgcgtctcacaagaataataggaccctcggctgcgtcgaccgacgatttacggcggcataagatggcggctctcttgccagcggccatgcgagtgcagtcacgagcgacggttgtccccattgcgtcctaactcggcttttaaacgaggacagtagcgcagggaacgcttgaaaggcactggcaggccttcttcttattgatctaagcacggcttccacgtgttctgcacctgggcaatggatggggacagccatggcgcgacgaccggcaaagagacccgctccagacatggacgcagcagcccttgcttccgtctccattttcgtagacccgaactagggctgagctgcagccttactgcgtccggtgggctcttcttcacagcgcaggtgtgcccatcttcgtcgtgctccctccttccacacggccgcgttcttcagaagtttcagcatcaggcgtgcactagaaaatgaataaaaaaaatgataaacgtagcgcggtgagcgaagaatctttccgcgatgaaaatctaagtgcatgcgcggtcgccatcgcttccgcttctatttcgaggaagattcgtccgggcagtgtcggcctccagtacacctccattggctgcacagcaccttcgcattgtttcatgagcaagcaacgagcgtggcccccgagctctatttggcttccgctggaaggccaggccgaagccgaaaagaaaaagagttgggtaaatccaggcaaccaaccaagctttgaaaggctctgtctctggaaggtatcgaaacgagagaatttcaaaagttttagtccaaacttgaaaagaaaaacagaagattgtcagccaggaaagcgtcggaaaaagatgacagtgaaagatctcagacggatacagcccaatctcactcagtctcccgcttccattttcagcctggtttccaaggacccatagcttctttcatttttggtagtacctacccaaaagcgtgtaagaaagttgtgcccatgaagaattttacccaagttaggttttgtgcaaccagttgaattggcgaagcaagcatcgcagctttcacatcatgatacatcatgaaaaaggcatgtgatataatgaggtacatcatgagcttacagtatattattctctcgagccaggaagcatcacaagatgggcaaagggtgaggaagagatgacggtttcaacaaatagagccttgtctggtgaagagagaatcattctcgtgatgcagattgaaagatgaagaacgccgttagggccccaaccaatcccgtcaccgccaaagcgactgttggcaatggtgtcgtgagaccaaaattctgaacaaaagaaaaagaaaaaggcaaaacagaaacttttcttagaagaaatcccaaggcatatagcatgtagcttaaatttctctagatacacgttgttatggatttacaagtttcatgcacatgttcaactgaccaagacaagacactgactgatgattgcaacgtaaaatcacacttgtcagatattacaaccttcgaattccgcgttgaatgtaataataaacattcatagtatttcccactcttttatgctacgtagatgcggtgatgataaatttgtgcccaacagctgttccattggagtgaagtggtggttaaccttcgagtccgtccgtggtttcttatcttccactttagagcagaaactgatatttgtcaccagatgatcagaatctaaggtccggttattcatactagaccatgtaattcaggaattccgtttccctgcttaagcacgttactgggttggggtagaaaggcgccaaccaaatagccatatacagtggaaattaaactagtttctgattgccggatcaaaaacgtccgaatcataaccagacacggtaccaaaaataaaataaattccattttcatgccattggacggtaatgggttcaacagtatatatacattacggagagtgtataaaaattacagttataaatgacatataataacacatcaaaaagaaaagaaagcctaatctgatgtgtcgaaaattttcagttcaattataatataaattcacaagttaaaatttaatgggaagatgattgtacccaaataactgaataataggaagtaatttataaggaatgacggacataatctactactaggaccttcacatctacaagatccaatttttgaccacaaatctacatatattcaacattagttggctacaagtatggaatgaacaaagcatcccctacttacaggctatgtttaatcaaccccataacaaacacatttccattcacccacaggttagtggctgtccttcatttacaaagtgaaaggtattgagcagttcttgaatgtgatacttaccgacagttttatcataaacggaacagttatttccttctacaaagtagaattacttgggcaaagttgacattcacaacctacctgatcgataaccaaataaacattttcctccttcaaagaaagacttaggaagaacttgcaaaatagcactgtccaagttgcaaacccaaaaatctattccgtacacaatgcaagcagatgtgaaaaaaacagcttacggttacagacgagtaaaacaaaaagtattatttggcttcgagacaaatccatgcctgcaaaatatgagtagagatagcccatgaacccaggaaaagttttgatcaaagttaagcctcaagcaatgagcacctaaattgcatcgcacttgaagggggtaaatatgcaagaaataagtgatgtataagaaattaaccagctggattgaacgacttaaaaattacgagggtttcggcatatgggtggggccaattcgtactccaagaatattcacgaacactattaaggaacgcctaaactgttaagaacacaaaatgaagcacaggtatgaaccatgtctgttagcataaaaggtaagactataactgaagcatacctccaaaaggccccgccctgtagctacttcagtagcgatagctgctgcgaacccaaccattgctgtccgacctaaccaaacgtctaagccgttgcccccttttgtgctctgctcgcatctcaccgttagcggtgtagccttctgtccaaatttttgttgaccagagtttctccaaacaactgccagagcaatggaactcttaatgctgagtttaaattattaatggacagatgtataaatgattccaagcatccttttgcataaacaaaagccaagtaaacacaacactactcatttggaggaaaactacatattaatatgaacatatgttgacgaaagaaaactaattacacaatcagataaatcagaacttctttcgcgtcgaatgcatagtactaatttgcatgtacaatggtcgtcatctcaagaaaatataaaagacttgagagcttctaacatgtagttatttttacatatatttctgacttctagtacatcaagaaagctcaggagcaggctttttgggtcagtaggcactgcattacattattaaaaaaaactgtcttcaattgcattggaaacaaagaaacggacacttgaaaagatccaaacaagataatggaagagttccacggttttgcgtttattctggagtagcataagtgtttaatgcacatttcattgtgtctgctaattttctagcattgagaacatatttttatgtaggttgattagtaacaaaatgagaaaattatgatctagaatgaaatatcaataaaatcttggaatcacgagagagtaaagattttcactgggagttggtcgtttcacaacactcttctttctaaaacatttatgattgccgtgacttttagctacatgatcaactgttcatgagtccacaaatctcaaaagcctgctcagtttcgacattgatttctctcggcaaatttcctcaattaaagcacgctctccatgttcgactgcaaggttcatttatatttccccgaatcctcctacacctcctgcatcaatttttcttcgtggaaatgctaagatgggtgtaactgtgaaatgctgaagtcaaccgtccttactgtcacaccagtctctactcagagtaatagcagataaattgaggggttattgaaagagccagcaacgaaaattcagaagcgttcccttcatactaccactttgctactagttccaacagatttgcggccgttggaaagatacacgaaaacagtaataatcaacacaacatcctgcgactcctcgaactcacgcatggaaataaatacacaccagaaaacgcaattccgcacctaactattatgcagaggtcgaacaggttaaagtagaggaagccttactgagaggagagcctcccttgaaggaatgcaatgccaatcccggaaccgtcctggagcccgcagccgaagggatccgcgggaatgccagaagagctcggacaggaaagccggggccggcacctgcacagttgaagggaaacggataggatatcccaggaatcaacaccacgacagtgaggcgaattcgagagaagagactgagcggagggagaggacagaccgaggacggggacggggcctgaggaggggactcgagcttgagcggccatggctcctgcggaagggttcgacgaggagaggagagacagccgggaggtctgtaggggggagggggggagcctacgcttggctgaggatggccgaacttgttatcgccacccttgttccgcttgtggcggtcggggcttctgggcgggcgaaacacattaggcttaacatgacttcggtgaccgtatgggaaataacaattttaaattaagagaaaatccaccaaaatacatcgattttcctggaatgcagagccgaaattgactttaatcccataaaatatcgccaaaaatttatgaaattactgaataaatagttcatataattaatttaatattccttaataagaactgcctctcttttctcttgcctcctctctgccaccggtggcgaacatcggcgccatctgctcattcttcttctcctgctcctcgtcctgctccggctcctcctccttcggcgacgcgctccagcaggtggtcaccggcggcgctgtgccccacagttcttgccgctgccccggcgtatgcttgccgccccggttcggtgtgatcgcagtctacgaaggagcttaaatcccacgatgagagttctccgtgggacgattagagcgtacgaaaacggagcgagttctcatgctccgatcgttccgtctgagggaaacacgtcgacaggaggaggccgacaatggctgtcgcttgccgccgaagagtcgaatcactactcctctttgggcggccgatggctgtcgagatggtccgccggcgccaccggatcctggcgtgtgtggggaggaatttttgaagcggccgtcgcgttccgagcatcaagatagagcgcgtttctccgccggccccatgctcggaggaggggaggagggtggagcaggcggaaaatggcatcggtcccacctaaaggccttatataaagatcgagtttttaaggggtccatgccattctagcctaagggcggaatttaccgtcgctgccacttccctctatcggcttccagcagaatctgactgaacagcgccaaccgcccttggcagcgacgggaatgcagacggcggcgatggcgattcccgtgggccgcccccaagggctgccgacggcttctctccctccccgcttgtgccgccctagccggggggctggcgtgccgcggctgctcccgctttctggccagggctgtttcccctcgctgtctattcctagattatcgtcctcttctcctcctatcttgttgtctcgctcgtggtcccttctcatggagccgacgaggaggggggctaccgtctgcgcttcagccggtgctgcgccgtttccgccccctgaagagtctgacaaggcgaagatcgcccaggtttggttctccgtgcttttgccggtcttactagggcactcgtcgcatatccttcaacattgtcggaaatctcggggttgtatctttcttccttgactagggtttatctcttccacttgttttctcatttccatcggaggtatctcggttcttccagatgcgattgcatcatttccatcactggtagccagttgtaccccgccgagcatcgactgaggtcctatactcagacgacgtcctgtggacctggaatcgttccacttcttgttgccgatgaaatatcctttactgattcagttgattcgaactgcgatgtgcggtttgaaaatgctgcatagcctgctacccaatccctctcggcttagatcttcttcacttgcagctctcgcgtggaataacgtaaattcctcatccttgttcttggtgaaatcctcttttatgtatgctacgccccgttgcgctctgtcctagaggggaaccagagttcagagctgctggacatgtgctgacctcgtaattctcagggcctataagggatgcgagttaatgacctaatactttacttcttcgtggcatggagacatcacgcctgctcagatcttaattttatgtagtgattctgatgaagactttgatttttatgtgtatactatgtgcttcacgttggtgtctgtcaagattatgaaaatgtactgacatttatgataggctctcacacagcaacatttgctatcaaaaaacaagaaatttataactggatctcggtcactcacgtggtagctctccacgctaaatcgcggtttcatactgggcgattattcacttggagagatgtattttttaccctttcatcgaagttaaatgccatggtattttcgtctatgaattccacaatttgccggcatattttgtgatttgattgcgtttcgttgtgtttgcatcaaaagaagttaaatcaaatttaatgtgatgctcctttggtttgtgctcaattttaatgattaacatcatatttatgaatgagtctcttcacagctgtgttatgttaagttttgttgaataatgtgcccgaaaagacggttaagggaatgaataaatccactgagccaataggctgactgaggcattcgaatcactctggcctcctcatagcaccttgttgcctatgtgcagcgcgtgatccataaaattcggcttggattattagcttctgaagatccagttttgttagtatgtgaactagtttagtcaggcatcagtctttagtctatcccaaattttcttcactactatacacattttgcagctttttagtctatcccaactcatgcatagaacccagcaatcctggacgtgtctcctcagcacattagaagctgttgctgataaaccgaatctcggaaatctgaccttcaaatttatatgacagaggaagcatgggggaagtacgtcagagctctgggggacaactcatggaacaataacttgaggaaaatcttcggagtgatcaacagaaaaaatccttgtctacggcctcataaactacagatggctttacctcagaaaatccctgccatccctatgttgatcttaaaaatatataccggatattgctttgtggatagtaggagaaaatagaaaaaataaataaaaaaccgagtggtcctcgttgtgctcatcatgttagactacgtgccattgtatgctgttgtttggctcagttagattcaagtgaagacgagtttgatgatggagacattttgcttagtgtccccacagattgtagccttgagtgaggaggcagatcccatgaatccagttcctcatgtgtctgtgctgcatctcatagtacagttcaagatctgcgactcatgttttcaacagctgagaagatcttggaccggaactattttattctaagaataatttcaaaggttcctacctcatcatggccaccctgcataatcatcgaacaagcctctctaggtggagtttatcatcccatgaagccttcaatctctcttagttatgatataaaatcatggaaataaagaactcacattcacatgctgcctgtaaatattggtcgtgtcctttggtttcctctgctaaattgtttctgaggatgcactattattaacttttattgactttattagatcatcattttacattttaatccagtgtttcacgtcataggtttcgaagagattggagagcacatctagatattttaaacggttaggtaccttggggttctggggccagcttatttgtactgctgtggcagctgtcattttatcattctctgctatcattactgggaatatcacatctccagctacgttttacgccaccagcgcgggtattgcggcagcatttgtatctgtgttctggtcttttggatacattcgtctttcggaaaggcttcggaagactgctggcgacccttcaaaggtacttggtttccaatggcttatacttggttttacatgggtgcttcttcattcttgtttttttttcttttttttttgcttgtgcgtacttgaggccagaagcaggttaagttcgatactaatttaattttgagaagggttttttagcgaaaaaaatgtcacttatctctaacggtggctaaatgagattttatttcagaaagatttgcatcattgtaaattctcggtttgcctcgatgcgatctccctctatatgaaaagcttcgcatctcatatttatttggctgagcagtcagtgtttcatatgccaccgttaattattgaaacaactttcatatagttggtggttgttctgcttgctttacaagaattcctaaacaactcttattcataccttttgcactaatcaagccttcttctgggcccctaaaccagaccctgtatactataaaaatatataatttaggggattttctacctaatactagggcgacttagagccctaatattagtgttcagttgtggaacacttgagctgatcttcaacgccatgtggcaacagtcattgagtgtgcctcatggtcactgaaaagactattattagtgtgcctcgtggaatttaaattgtcagaatctgagtgtgcttgaaagatatgttctaccaacacacttcataccaccacgtgcatgagttcgcatggctttaccactggaagtgacactggtgatgtgcaacgagaacaaccaagaatgggctttagccaattgatccgctcaaggtttttgttaaatgttcatgatatatgaaggattaggcgacgccatgcatagttgatgccttatttagaatattgtttcacttaacctactgcttcttttaggtttgtttaaatgatatgcgtctcatgtttccatgagaaggtttcatcagtatgcagcgcatgtaccatcacagacaagtacagcagattaactagcacagcagtacaatttttttatagcaactaccgggggggaagagatggccccactctcatccaaactttaggccttgagaatcactttagggctagggatcgagtttatgcacgaaaagaccgttgaaccaatgtccataaaccatcatagcaaaaggacgtccctgctgtgccagaaaatatactagcgcggcatactatcaagacctgatcattatgccgcggtgatgaatggaaaagagagagagagagagggtaaaattcattgtagcagtcctgtggaggacgatttttctttctaaatctatagactattgtgtttgcagctataacttggccaatcttggtggcccatgacatcagagtaggattcttttattctccccataggctctggcactagaacttgccaccacgccaacccgtgaatggaagagcattgccagaggctgaaagtcctccgttcagttttgaatcggataaaagtggggacagatcctacttactgctactgttctgcttgcgcaaacgagcactctggcctgatttggctgcaattgatgcggtgaaaattggaggaaataatcgtgatatgaagatccggaagggaagtcgcaggaaattgaggtcttgattcatttcgtcgttttttttcaggcccctcctcgtgccgaagttgtgaagagcctgagaaatggtatcgtcgtcaaccttctaggaatgggagccgcggtgcttggcatgcaagccactgttggcctgttggtggcgaaggctctgaccacctcggcagttccctactaccaggcaataccagccggccgcagccccgttttagccttagacgtgttcctggtgcaggtacgggcttcatatggctccttgctgactcttgtccggcgcccacgggcccggtgtggtctgtcgtgtgcatcgattttgatggagcatctcaatctcatgtcgatttgatggggctttcggctctcttttgcttgggcaggcctcggcgaacgccatctcgtctcatttcctgggccttgtgttctcgctggagctcctgcggtccgtgacctctcctcaacaggaaggcgctccaccactgacccgggcggcgtgataatctcacctgttcctcggaagctccgggctggcggtgactcttgtcttcttttcccttctcctcgccctgggcgttacctcccgaaccatgcattcataccaaaattaaaaaaaaaacaaaaaaaaaatgtgtgcttcattcagcgctctgctgctaagttctccgtgcgtcaacaagaaagagggagagagagagannnnnnnnnnnnnnnngagagagagagagagaggcacgatgccgcaaaggagaggttcccaagaagctgcccagatattatagttcgtaggttctaaatcgagtccggcattttacctcacatcatccatctctaaaaggaaagaaaaatgaaaagaaagaagcaacgcacgaggctaaattattacgttcacatgaagctccaaaagctgaggaaaaaaagcatcgccaaattgcggttcccgtgatgtgatcgagctccaagactccaagactcctcctgaagattaaaatatcatcgcgtcagcccagcctttactccgctttctgcagtcagaggtttaaaaactttcaagaaagatgaactcatggagctggttattccatgccagacagacaggaaacataatgctgccaatccccatccccatccccatcctaatcggatgatgagctgcgcccttgaacacagccgtgaaagccaaactgggtagcgcaagatcgaccaagactcgagcccagtggatcaaatccgataacttttcttgcattacaggctccctcctgcaaggtaaccaacttagcttcctcccttccatcattttcgcgtggtttggggatggagaagggggccaatgcccgtgttcatggtggatacgcgggtttttggggtcacgatcagaggatctcggggtggacatgcattgtattgttacatcggttccacattatactactccccaccgcaagctacactggtgaggatctgtgcccgattagcatgaacatcggtcactaatgaatggctacgtaatcgaccaaagtcaaacaggggacttactggaaatgtgagcctttgcgaaagtcacactcgaattagccagagagagccagcctaaagtgcataagtggtcacaggacggatcatatagacggaggcaccagtaactccggagaatctgatgaataaaactccttaaaaagcaaagattcctctaaaacgctttgactgatgactgatcctaacccatcaaccaagagctgcaatccatgcttgaaccactatacagctaggtgccatctttggagccaaaaaaagtatagatatcttatttgacgagaaaattatcaagaacttatcacatatgattctcttccagttacattctcaccaggaactagacaaataaatgttatccaacagtccaaattctttataataaaggcaacaaggccattaatataggaccagcattctgtgcgactataatcacatagtgtagatgatttccaagaaaagaattatgaattctcgggcaaaggttctactagttccaggaacatctctgccgcttcaatgaatgaagatttggaaacacaaggctatgtgtttcgtgtgtttacctacttgacatccaagttcacactcagaaacaagtaaatcataggcagactatctttctattttagacagggtccactaaccactgttgtgtttaaaaaaacggcagctctgcacatcagtagatcagaaaagtgtggaaactatgagctctaaaaaagaaacctgtgtacgggagtatactcttacaacagcaaggtattgtagagaaaaatgatttttgaaaagtcatagacctaacgacactcaagtagtaaaatctccctccgaccacaaaagaacatcatgcactggggtaattttcccttttgagaagttatctcagtttctcacgtttcaaacagcataaagttcgtaaaataagcgaccacatctagaaatctagcgtcgttattcgacgagggttcaaactcaatcaaacaaaaaataacgccctaatgcacatcaaaaataagttgtggcagaggaatagtctctttaaacggatcaaaatttcttataaaaggcatattcttttcctcgcagtcttctagatatcgaaacacgtacatggacataaagctggatgcataaacttgtgtaaagttagagtaaaatataagaaaacagatattaaccgacctgtcactcagttttcttttcctttcttacagatcttcccgtcttcacaaggacatttacatattgattcaagagaaaatgatgagctaaccccactttctcatcaatgtgatcttggtacttgtgatacaaagcgggaattgtgaggcaaaagatgatccctggagcaagcgaaaagaaataagcgtcatgcggtgtgccaaaacgttaaggtccatttgcaatttacaggactttcccatattggaaatatcgacagaaaactatttgggtgttagttctccagtggtgcataacagaaaaacacacggcaaatttttttgcttggaacttaccaaggtaaacgaacgtcaggaagctgaagaaactcccaatatatgaagcaacccacaagaacacaatgaccttgcattagaagataacagaacaagggtgatacagcacggtgagaaattcatttttctaaaagagaaaaaaactttataataatagcaactacctctagaaaacgtttccgatcaccctcaagggctatctctcgtgcaacagccaggacacaattaatccaggtgcgggcatcatcagcaatcttctccgcaacacgatctgggatttccagatttggaaggggaggaaggggcctatagacaagcagagaaaggacgataacatcgcgtgtaaaaatggaaactcaaaacaaaaccagatgagaaaagtatagcgaaaggaaacggggatatacgacgaacgataacctgttgagaagtgaagcagatctggcccaaaggaagagaatggagacgaggaggaggagaacattagcaacgagagagaggaagctgtatccagcgatctcgaagagaaaccaagtgacggtcgtccccgtcaacagcgctacggccgcattcctctgcttccacagcatcacgtcggccactgcaaccagagccctcgcagtcgtcaacgaaaccatcagtaacagcatccacactcccaagtctcagaaagtcaatcgtccaaccgcagagagagagagagag

SEQ ID NO: 835 - DNA, 1006 bp, Taraxacum officinale
gattaataatggtggcaggcgagtgctaacacgatcatgtcgcatttcttggggattgtgtgctcgttggagttactgcggtccgtcacggtaccggataatggcccggttccaagggcggcgtgagggtatgatggtaatttgttcaacagtttggtaaatgttttgtagtgtggtttaattaggtgtttggtgttttttttcttcacatgagtttaaaaatgtggcaaattgcgcgttttatacattgtcataaataaccaccgggtatattgatcgttatttgtaaaatgaacccacaacttcaatagctttatgcattttctcctataactttggatgacatcttaaggtaaaggagttaatatcacggttaactaattgggttaatacaaaaaaaggttattgatcatctttgtgttaaaaacgtttggcactatattggtttcatatactttaagactaaacttgttgggataaaacatagtaaaaatagaggaacattattacgctcgacaagacgacaactgatatcacatgttctttgtgggcaagacggaaaatataataagcattcactataaatattataaaacattcattataataataactggtaaaacaactaattttgtttgttttttttgtagaaacaactggaaccggctgaaaataatttcaaaactagaatcccatttttgaaaaagtttccagaaaactcaatttggcctgaagttttgaacagctgtagtagcatgggtaatatagtattgtatttgtctatatttagtcattataatttttttatactatatcattgaatttttacaactgtttatatttgatcaagcatgtcatagtctgataaatataaacagttgcaacaaattcgattggatgatataataaaaaatgtgtagtcacttaatatggacaatataaaactatgttactcatataagttggggataatgaaattttgattttgttcatttttagtgctaaa

SEQ ID NO: 836 - DNA, 1335 bp, Taraxacum officinale
gttatcaaccacagttaacaagtattattttggtcaccatttcacaaagaagtaataaaaaaattcgagtgaaatacctacgatatattttaacaaaagtttaaaggtttattaagcataataaaaattgcataaaagaaaagaatatataactttgtgaaaataatattgaaagaaaaataaaaagcaaaccctgttttgaaagcgaggagaccactctatctactccggtcgacaaacataataacccgtaattccaaaatgctaaccaacctgttgccggcagctcgttccggcagtgcaccgtcgccgttggcagtagctaaaccttcactaccttgcctccaccgacgtctttccccggtcaatttgccctcatctctctcatcgtctgcctcgctttccttcacttcgtcttctccttttttggtgcacctttatcgaaatcgaatcaaatgccctaataagctcgcttcagctcccatatctgccgcctacaacgaagatcctgaaaaggcaaaactcgctcaggtaattcactctagatatgccactttgaattcttaattttcgtgtcacaccgatagttacgcatatgatcttcttagggcttttcagtatatacgaattgatatctacacctaacagttctgtttaaagttcaaataatcgtgaaatttaaccccaaccgacggatttaataagttcctgccaataaccacgtcccctgaaatgtaattagggttttgagatatttcaagctctaatctaaaaattgctggtgtgatacattgtgccttctaaaccaaatccaatgtaattattcagcaactgttaccatctttcatttaaacaacaaattcatgaaacttaagctacatttactccctttcatgagtgtgactagaactattgtgtaggttgcaaagagattagaaaccacatcaagatacttcaaacgattaggcagcttagggttctggggccaacttgtgtgcacactcgtatccgcagtcatcctttcattttccgtggtagtcaccggaaaaatcacatcccccgccacattctacgccacttccggcggcatcatcgccgccttcctctccgtcttctggtccttcggctacatccgtctctccgatcgcctccgcaaaaccgccaccgacccttcaaaggtactccaaatcatcatctttccacaactcaaaatctaaacacaaaaataaattatcgtactcaggccccaccgcgtgctgacgtggttaaaagtttgaaaaatgggatcgcggtgaatcttttgggaatgggtgctgctattctagggatgcaggc

SEQ ID NO: 837 - DNA, 242 bp, Trifolium repens
ttcagtgttttggtcctttggctacattcggctttctgagaggcttagtcgaactgcaaatgatcctacgaaggtgtttttattttttattctccatttaaataagaatagttaaatttgcttaggaagctaaagatgttaatgtactaaactaaccttttttgatcaatttagacctcgtttgggtaaacagcttaattaaatgtttatagcttagcgaatttatgtataagctatttcta

SEQ ID NO: 838 - DNA, 1627 bp, Trifolium repens
tataacaaaagataaaataaaatagaattgtttttataagctattctagagagttgtgaagataagatgaaaacaacttatggatgtgtcgagctgttttcgtaagcttgctcagaaagtcttgcaaatgtttatgttagtaggtaagctcgaataattcaattcaaacagcctcttaatgtgaaatcagtgttggttgacttcaaacacaaatttagtgattatttaggatataggttgagcgtttagttgtggtttcaggcaccccctcgatctgatgtagtgaaaagcttgcaaaatggtatagtattgaaccttttggggatgggagctgctattcttgggatgcaagccacggtgggattcttagttgcaaaggctcttacttcctccgccaacccatattatcagggaatcgctcctggttccagccctgttctcgcattggatgtctttttggtgcaggtaaaacttattggttgttcaatattaacttgtcttctatagaggaaatttaagttatttatcaatggtattctcagctgttctctttcctgttatttttgcataaattggccttctttgctaataatgctaataaaacatttccattctccagtagtaaaactttgtataaggccatccttttgccattctggattacaactccatctgtattgttttctgtcattagccattgttgctgttctccatttaaagttataaaattggggacataatttggctattgttatttgggggaaagtgtggattggtggagctgattttgacagttgcattgagagcacatataacataattcccatcatgtaaattactttttacaaaattctgtagtattaaatttagatgcatgctagagggtatgaaatgcaaatgatttccaacaataggaaagaaagaccggtgtttggtttattttatgtttttcattttcacttgataagttttcactaataataagaattacttttttcaagattttctaaaggaactggtgacaatgacagaatattatttccaatgcttttgtgaaagcacgaaacaagtaaatagaacaaaaacaatgttatattttgtaattattagtgagaacatatcaaattcaaagtgaaaacttcaacatcaaactaatgtgagtaacattgactgtgtgggatacaatttatggtgtcagggttcaaatagtaagtgtaatactattctttgttttacaggcttcagcaaacacaattctttctcatttccttgggcttgttttctcactggaattgttgagatcagtcacattacctccttcagaagctcttccatttctgaagtttgcataaggtgtgccttaaatcttttagaatgaatttacgcacacaaaaatgtacacttatttctagtggctgttttcttaatgaattttgttgagtcttgatacagcattttaaggtcctcttcgttggtggttgacatcttatattcccaagttgaaaagaacccgtgcagtgttgttaataaacatgaatcatgataacacctcaacagttcgagatccgtggatagagattatcacagtggcaggggtttaccgcactatctacagtttggacatgtt

SEQ ID NO: 839 - DNA, 659 bp, Xanthium strumarium
aagagattagagaaaacagcaaggtatttcaagaatttgggtaccctagggttctggtcccagctggtgtgcacaattgtttctgctggaattttgtcgttctctactgttgtcacggggaaggtgactgcaccctttacattctacgcaactgctgctggtattgctgctgcttttatttcagtcttctggtcatttggttacattcgtctctcggaaaggcttagaagatctgcaaaagaacctgctaaggctcctccacgtgctgatgttgttaagagtctcagaaatggcattgtgcttaatattctcgggatgggtgctgctgttctggggatgcaggcaactgttggtgctttggtagcgaaagctctcacaacctctacagtaccatattatcaggctaaccctggccaaagccctgttttggctctagacgttttcctagtccaggcttcggcgaacaccatcctgtcacacttcctggggctagcaagcaccctggagctgctgcggtcggtgtccttgcccccagctgaacccgccccgacacctgcccctgcgcgggcctgaggcaaagcccattcctgggctcgtctagtacatctcttgttccggtttttgttttagtttttgtgaagttgttccgtaacccccgc

SEQ ID NO: 840 - DNA, 331 bp, Xanthium strumarium
cctcaataccccctcttccctttcctttacatcctcttctctgttttcacaccacatttatccatatcaaattaaatacccaaataataataataataacctcccttctcctccactatctgcttcctacaatttctccactgaaccttcagaaaaagcaaaacttgcccaggttgcaaagaggttagagagtacttcaaggtatttcaagagattgggtagtttagggttttgggggcagctggttggtaccattgtgctgcagtgatcctttcgttttcggttgtgattacggggaaattacggtcaccggctacgttctatgctactg

SEQ ID NO: 841 - DNA, 1438 bp, Abutilon theophrasti
ctcctccacaacgtcatccccaaattgttttcagaaaatctggagatgaaaggtttgcgagtattttttcttcaaccaatcaacaaacttcttcagttggagtcaatcctaatccaactgtgccaccgccctcctctcaaatagggtcgccacttttctggattggagttggtgttgggttctcagcactttttacatgggtagcttcgagcttaaagaaatatgcaatgcagcaagctttcaaagccatgatgggccagatgaatacacaaaataaccaatttggaaatgctgcttttccttcgggatccccgtttcccttttcaacacctccatcacctggacctgtcacatctccttctcctccttctcgacctgcagtaacagttgatgtacctgcaacaaaagttgaagcagccccagtgacagatgctgcaaccaaagggaaaagtgaaacagaaacagcagaaccaaagaaatatgaaacaacagaatcaaagaaatatgcttttgtggacgtttctcctgaagagagtgtgcagaagagtgcttttgaaggtgtggctgagctaagttcatcagacaatgcccaggttcccaaagatgtttctgataatggagctgcatcaaagcaggattctggtgcttttggcggttatcagtcaactggaagcaaaggtcctggcttatctgtggatgctttagagaaaatgctggaagatccaacagtacagcagatggtttatccatatttgcctgaggaaatgaggaaccctgatacatttaaatggatgctacaaaatcctcaataccgtcaacaactgcaagacatgctaaataatatgggtggaagttctgaatgggacaataggatgatggactccttgaaaaactttgatctcaacagtcctgaggtgaaacaacaattcgaccaaatcgggcttacacctgaagaagtaatatccaaaataatggccaaccctgaagttgctatggcattccaaaaccctagagttcaagcagctatcatggattgttcacaaaatccgctgagcattgcaaaataccaaaatgacaaggaggttatggatgtattcaacaaattatcagaactcttccctggcatgacggggtcaccttgattttggttgttcattgaagttgctgttttcggagcataatgtgctcattttatttcaaatggttgagttgatcggatctcggatggaattcctagactgaacatagatcttacatcactcattccaagttttagagtttcgtatttagttttagaatgaacgatgggttattcaaattattcaccctttagcctttactgtattctagaggtttctttacctacctgtaggctgtagctgtacttaaattgcttactttcacaactggttttataaataaagttagtgcctctctc

SEQ ID NO: 842 - DNA, 239 bp, Abutilon theophrasti
ccaagtaaaatctttttatgagtgttaaaaaggcttttacacagagacttcgtcctggtggtcttggtagttgatttcattttaactgaattaacctctttattgcaatctgtgctatttattgctcaaaggaaatgttatcttttatttatttctacagatatttgcctgaggaaatgaggaaccctgatacatttaaatgtaagtccttgcttaaccacttttccttctctgttttt

SEQ ID NO: 843 - DNA, 303 bp, Abutilon theophrasti
tacatggtccctcttctccaataatttacttgtgcataattaacaatttgatcatgcatgtgcacattttgggcatgttttctagtttctttgtgactctgtaacatttacaggaagcaaaggtcctggcttatctgtggatgctttagagaaaatgctggaagatccaacagtacagcagatggtttatccgtaatattatttcgtttcctcaaaacattttattgtttttctgattttctttattgagtcatctttgtgttcctgaggtttagtgtaagtttatgcttctgtcttaatgtc

SEQ ID NO: 844 - DNA, 3470 bp, Abutilon theophrasti
  unsure (1)..(3470): unsure at all n locations
ttgcggggattacctgcaacagtttcaaaggcaagttcttgcaagcatcgagtttgttttgtaacatttcggcgacgatctttttacttaataaatttattatggctttctaccaaaaaaaaataaatttattatggcttatcaaataataataggaagaaaaagggactatattggactaattaaaagtagatggatgacattctacgaaaatgataaataaaaggactatattagacaatttgaatttgaaagtaaaatatgatgtttcactaaaatatatggactaaatagggaattaaccccttaaaaatatgatactatgaagtttaggtacgaagatgtatcaaaacatacaacaatttcggggcgtcgtttccgttcttcgtcccctctcttagcttacaacagtatataatcctaattaccctcggaaataccctaccaaaatcttcactattctaacatgcaacaaattgttcaacattctatttttctttctaaaaatacaaattagttgttacttgttagttttcattgctacgattgtaaggttaggtaaaactatatccttgatttaggctccaactttacaattaaaactctttgcaaaaaaaaaagttaaaaaaagcgagcaaggaccaacttacagagttcatcaaattcttatacagttttatagtcattggtttatgataaatgaatggttgagatgaagtcatcatcccttagaaataagaaagaatttgagggtgattgagggatgttttagggttttaatcattaacataatctaatgattataaaaatgtataaaacttcagattagggaccaattgaaaccatttaaaatgtttttgtcaattttttataaatgagaaccaaattgatataatgtgtaaagtataggacattcataaattcaaaaaattcacttttaagattcttcagatttaaattattttaaataaataaaatgataaaatcaatcttgatccctcaataaataaaatgataaagattgtttatcgcccgtctcaaaaataaataaaaagtttcgtatatatttttgtcacttaacacgtaaaatccctagaaaggactaaaaaaatcaaattattgaccatagttttagtgagcaaacaagaaatttttcaatagtttaagtattattcttgtagtttaccgttattaatgtaattcgcaaacaaattagagtctggatatggaataccgaaatcccattcccgacggaactttccaaagaaacaaacaccttcaaaagtaacataattttagtttaggaatgaatatcaaacatgggtttatatttgatgcannnnnnnnnnnaaaaaaagtttacaccaacagatttaagattgtgacacttgtactttttnnnnnnntaatataccctacatgtcacatgataccctcaatacttcgttgatataaaagattttttataccaccggtgcatcaaaacttttccatatataatatataataacatgtcgggggttgtttatccccgttgtgttcttcgtcccccttctttcactgactcacactcttcttcatctcactccaactttttcttttttctttcttttttctaaaattgaatggaaaatatgaatatggcgttggtttcatcatcttcttcacctccaaattttaatctctcaggatacactaattataatcataatcacactctgaaatccccagctaaaatcttcacttttcaaacttccagaattgctcctcgtcgttccagaatatccagctccgcccgcgccactcctccacaacgtcatccccaaattggtatttttttcttctttctttttattttgaaaagtaatttcgtcttattatgtttttgttaattcagttttcagaaaatctggagatgaaaggtttgcgagtattttttcttcaaccaatcaacaaacttcttcagttggagtcaatcctaatccaactgtgccaccgccctcctctcaaatgtaattcaatcaccattttctctctgttatctttaattgctaatatctacttttaaaattggaaaaaaaaggagcatttgattttactttaatgtttgaattagagagtagtagtctatgtaagaattaatgtttcctttttaatcttttttcttatttgtaactttttaaggagcaaagaaatgctatattattttctttgtatatgaaacaactatatttgaattgataacaagcttcaagtgtttacccaatttttaataacataatgatagttttttattgtttactttgagtttatagcaaatttgtgttaataaaagataatttatttccttgcttagctgcttacatgtgtatattttgtagagggtcgccacttttctggattggagttggtgttgggttctcagcactttttacatgggtgagcacaatgcctagttttctttttcttttccagtgatatttttagttgtattctattaacagtggaaatgttttcttttgttattgtatatatcttaatgaattcgtttgaaatgacaggtagcttcgagcttaaaggtgagggtttctttcatatgaggtatggttgtattgttttgcctgtaagttgtatggttgaatcttatcatatcgttttggaagtagaattgggcacttcaatgaagcaatgaaaattgacaatgagtaaaagtctatttggtctgcgtagtttggaattttgatgctctatacaaattagaagtcttgattatgcttcttgtggcatttgaagactgaaatcgcccagcatgcgagtgaggatactttaggtcaaatcggatattgtgctgttatttcatcgaattattatttcattgattcgtgatatatctttttccattactcagaaatatgcaatgcagcaagctttcaaagccatgatgggccagatgaatacacaaaataaccaatttggaaatgctgcttttccttcgggatctccgtttcccttttcaacacctccatcacctggacctgtctcatctccttctccttcttctcgacctacagtaacagttgatgtacctgcaacaaaagttgaagtagccccagtgacagatgcagcaaccaaaggaaaaagtgaaacagaaacagcagaaccaaagaaatatgaaacagcagaaccgaagaaatatggtaaaatagaacttttactgctgccacattaattttgtataacgtgcaactcttccctctttttttttgatgtaaaatggaacattatatcgctcatttcatgcatatgtaacattaataaaactaacaaatctcatttgtttcttcccctataataatgggtttacttaatatgtggaagtataaaactgaggtctagtcatgtgatggtttttgattcagttaaccgcttaattcattccagctgcggatgtttctgagattgtttcttca

SEQ ID NO: 845 - DNA, 844 bp, Abutilon theophrasti
cttgtgaagattccatctacggcacatcaaattgtttaatctttgctgcaattttctggctcttgattatagctgatatggattttaaagttgatttcttgatgcaacttattgttgatataatttattgatgagatttgtttttgcatttcaggttatggatgtattcaacaaattatcagaactgttccccggcatgacagggtcaccttgattttgattgttcattgaaattattgttttcggagcataatatgctcatttgatttaaaatggttgaggtgatcggatcttggacggaattccaagactgaacatagatcttacatcacttattccgagttttagagtttcgtatttagttttagaatgaactgatgggttattcaaattatagacccttgactgtgttctagaggtttctttacctacctgtaggctttataatgcttacttataaaaataaagttagtgcctcccacttctttctctctagggttttcaatcgatatggccgacacattgagatagaggtaatgcctaatgtaattgtatgaattaagctcgctcggagtatttattattgttattattatataagatcaacttgaataacttatcggatcatagcgccaccgaataagagaacaaaaacttcatcccttactgaattttcttcaatagcagaaagaacaaaaacaacaacaaaacagagtcatagttttgacaaaatatcatcgatagccaaaacaattttatcatagcactgcaaaacccgagactcgtcttcatctcttgccgcataatccaactgcaataattcaaaaatcaaccaatcaaaacc

SEQ ID NO: 846 - DNA, 6583 bp, Abutilon theophrasti
attgaaatcacctattgtactgccagattttttttcaatttaccgtaataggaagttgatatcttccattagtttctcatatactatctaaaggtgctttctctaaattgtcaaaggatttttttgttgaattattatggcaccgaaaaaatgcatattaatttacaaatgttgaaaataggtatgctactgaatgttttgctacaatgagttctcgtgtcataaagacaatcaaaggcgtatggtggcttgttagatatgtaacttaactctctttcatgggccttagtttttttggctgagctgtgcattaatgtatctaaattatagtccttgtttttgggtatgcttaactttctttatgtgctttagatggtgcaattggtaaaaccttttagttttcatctgttattttgttcctttatgatattacctttacattattcagaattatgctatgcaacaagctttcaaaaccatgatgggccagatgaatacacaaaataatcaatttggaaacactgcgtttccctcgggatccccgtttccatttcaagcacctccgtcagccggttcatccataccccgttctccatcttcttctcgacctgctgctacagttgatttacctgcaacaaaagttgaagcagcctcagggactgatacagaagctgaactgagaagcatgcaaaatgaaacagaaacaactgagcgaaagaaatatggtaatatggaacctttactgttacccattagatgtataatgtgcaattcctccttttttgaggtgaaaaggaaattttataccggcaattcatgtttattaaacatatgcaagaccaacagattttgtcctcccccggaataagggctttactatgtacatgatagtataaactgatctctagtatcaacagaattttctagtgcctcaaatgatggttgtagatttagttaacgactggattcattccgatttctgtgctcttgaaattgtttctcaaaaattaatgcaaagttcattttgcagcttttgtggatgtttcccccgaagaaactgtgcacaagagtgcttttgaaaatgtagctgagctaggttcatcaaacgatgtccggtttcccaaggttgtaaggttttaatttttttcttgttaggagttgtgccagcatggagttatttctttaggagtcagagtatctgtttgggaaattaaatttttttaaaatattgtatgaaggtttctgataatggagctgcatccaagcaggatggcggtgcttttgggggttcccaggcaagcggtatgcaaaaagctagttgtagagtttatgattatttggaatggaattgtaggacattttggtctgtatttggctgtgataactgataactgtctgaagaaaacaataaagaacatggagagttttgtaattatttgaacataaaaattatatattcttgaacatattagagattgttaattctaacctcaggacatcgacgtgtgtcattgattgacttgtttgtatattaaaagaaaggaacataaatagatggcagtgtaggaataagggagtaagtgcttaaaatcactggatttgtcatgtgtccatatgtaacaatttttttagttattaatgccatctttgtaaatattcatctctttaaaaatgcattttgttgatatgtttattggcatatctaaattatgattaaatagaagagcccaaaaataattatggttaaatagttggatttataacctcgttgggacagagcccaaaaatactagtttctttcgtgctctatgagttatagttaagcaaacattgtattgcctttgcaggaggagcaggtcctgccttctctgtggatgctttagagaaaatgatggaagatcctacagtgcagaagatggtttttccgtaatatagcttcttttccttgaatattttttccctgaagtttttatttttcatttttattgaagtcgtcttggtgtgccctgaggtgtggtgaaaattgatgctcctctctgagtgtgcattatataatcgttaattctttggaatagttactattcacacaaagcctgtcaaattattaagttacttgagtcttttctcatacaatatttattaggcatctcaatgtttttcgtgaatcaacatgacatattaccgctttaattaacatattagtgaatgagtcctgatcttttgtccttacctcctttatgtccctcaatgactctgatctatgccccttaatgattttagtacctgtttacactggtgtactgaattgtgaatgttgctggtcaaaactgagttatcttcttctttgtcgtctctttccttttctttttccagagtaatcctataacattcagaccttaaggcgaaaatctttttcgaccaatgcgaccatcgtcatttctcctaattcttgtggaccttgcccatgatgttagtgatttataagctggcctcagatttccccattagtcatttcccccgatctttgtgaacattgcacacaaagttagtgattgaaagcaatgatcagatatatcctattaatgcttttggaaagtgacgtccttgcaatttacattgaaggcatggtaatgtgtcaagttggctagaaagtccctcaaagaacttatgaagtgtaaattattttataaaaagccttttccggtttttcacatctggaagtcatttgccaatgttatttgtgaaaattcaaccttaagcatagaaattagaaagtggactatttgggggccagatgtagtataagctggctggttttgattaggttgttagaacttagaacttagaagagacagaaaggagggaagtgtttggatgtgatctttctttggtaaatgtctatcaataaactgaattaacctttcattgcaatctttgtgttatctattgtcaaaaggaaatttaatcttttatttatccgtacaggcatttgcccgaggaaatgagggatcctgaaacttttaaatgtaagtttgcacttttggtaacactgctttccttctctctctctctttgttttagtcaatggaaatagagaagatagcctttttgttctgaaaaaacttgtttcatttcccagtctactcattagaattatttgtttacagaagggatttgttcatttggcgcataagcactgctgcaattttatggatatcatttttgtatgtcccaattttcttactgttgtgcatatttattaacagggatgctaaaaaatcctcaataccgtcaacaactgcaagaaatgctgtaagctttctcctgagtggccgcatttaattaattttttttaagaagtcatcgagagatgacaattgcattaatgtgtaaccaaaatagagtacaaatacaaaaaaaaatgcattgtgagaactggtgattcatcggttgcatttaattagttttagggatttgtctttctcttgatttgcatttaattggtggttcatgttctcttacagttatcctgctcactgttcttactggactttgtgatctatgattccaggtttcttttctttgtacagatttttgaatggtagtgttgggatacatattgctgtaatccaatcttaatttctttttttttttatgatttttcatatagtttttcttaagtatctatatggttcttgaagaataaaaattaacagcgaaagttatcacatgctgatgtgacattctcactttgaaattaacatgatcttagagccgaacctggctatttgaattaccagtaatatgcatggatgttttttttttctttctgatgttagtcaaacttcatacattttgggatgccgaggctttaacttttttttaaaaaaaaaaaaaatttcccgattgtaataacttttattgatatggaaaatttaatcttaggtggttcatcggttgtcaaaaataaaaagaatttggtcctgttttgataaagtgttagaaacttttcaaaccattgaaaactaacatattcaataaattattattttaaatgtgtttgataaaaaaaattattttcttgttaggattttttgctagtgttgaaagtgataagtagataagagtctacttatcattaaatgttgaattttttttaatttttatttgtttctttgaagactaaattatccattaatattttaaaatttacatttaccaaacaatttagttatattcaacacttaattttattttatttatcaatcaaattttatatttaaattcaacagtttatttttcaatgcttaatttttcaacacttacttttctgtataactttttcagttgatcaagaatggtctcagtttatattagggattaagagagtcagaatctactatgatactctgttgattcattcatgatttgtgtatattattatcccatactattctgcgttcttgacttctatgttgaaagttaatttgttgtctttgatagatggaagatattaaacatgatatgaattgttaccctccccttccctattagatttatgatttgcttttggtgtattatttttcttattatttagaattgcatcagttctctgcaactctggatgtttatcttttgtctcggtgattcttttcagaaataatatggatggaactgaatgggacaataggatggtggaaaccttgaagaactttgatctgaacgatcctgatgttaagcaacaattcggtaagtctgaattttagtgtttgagataagatactgattggtgtatatcagctcctcgtttgttatttgtatgtgatataaatttagttgatggattctctgctacttgaatatggtatggcacctgaagaagttcttttcccatttgcagatcagattgggtttacacccgaagaaataatttccaaaataatggctaatcctgaaattgctatggcattccaaaaccctagagttcaagcggcaatcttggatgtatgttttatctagtttatactatgaatctttatatatatgtagatcttaatttgtttttatgttcttgattatgtgcttacagtgttcccagaatccaatgagtattatgaaatatcaaaatgataaggaggtaatcttttccttaatagccattgttgtggagtttttttactgctatctattcttttaaactttttttttaatttttttaatctttcactatatttttgtccaaactttatcatcatttttataataaatttcatcatctttaatgataattgaccaatttcttttttcgtgtttcaggttatggacgtattcggcgaagaaatgctggcgtcgttgcaattcccagtcgcatcgtcgacgaaagcagctgctccttctccaatctactcaccaccgaaatcattacctgtcattcgccgtttcatctcattcccttccaaaaccaaacctcttcccaaagtcatcggcggcaactcaaacaaacatcgcttcttcaccatcaaggccatcgaagaaagcaaggagagcgtggaagactcagcgaccgcaaacgaaccggaagcggaatcggaagtgagtgatgaaagcgagttgagcgcgataggagaggagataaagaaagcgatgaaggagagagcagagaataataaggataatggtattgccggcggagttgcggaagagataagggaaatcgagtggcctccgtttggtaaagtattggggaccaccggcgttgtcctcggtgttattgctggttccagtgtcgttttactcactgttaatgccgttttagctgaactctccgatcgggtttttgccggcaaaggcgtccaagatttcttcagctgatgatattttattatttatactgtatttttttatttctgctaatcaaacaagatctcaaatagttttcttcaaaaaaaaaaaaggttatggacgtattcaacaaaatatccgaactcttccctggtgccggttcaccttgaatttcataacttaattgtagtttctgtgaattaggggtataatgtgtcattttagttcagatggttgcggtgtttgaatctagagtatcaaattcaagaccaaacatagatcttggatcacttagttcagagttttgagagttttgttttcagattgagaatgagttgtaatctagaattgaattttcatgagttgtagttcgaagtcgaatgcgtacattatacataaactaaccatgaatagtgtagtgcgccattatttataggtttgactatttcggtttaatggttacaaagaatacaaatgtacgatcaacatgaactctctaacttcctaaggtgtctagaacttccgtaatgttttgggattcacaaatttcaattttttatgtagacttctaaaatcatccagactttacgtacattttacaacattttgaaattattcatacatttctttttcaaaatcatgtgctgacttaaaaaaaattcgggaaggagtgaacttaaattataaaaattttaagagtttttatttgatacaccgccggttgaaaaaaaagtttacacca

SEQ ID NO: 847 - DNA, 251 bp, Abutilon theophrasti
caggttcccaaagatgtaagtttttgattaagctcttgctgcgagactggtggtatggattaatttctgtagtttcgatgcatctattctggaaaattaaatttttgaatgatgtgcgaaggtttctgataatggagctgcatcaaagcaggattctggagcttttggcggttatcagtccactggtatgtgaagagctagttgtaactaatcacttgattatttgaaatgaaagtgtgacacactttggt

SEQ ID NO: 848 - DNA, 3181 bp, Abutilon theophrasti
aaccacttttccttctctgtttttgttctttttttggatgaggagcattgctgggtaggtgggaatagaggagggcaggtttttgtggtctctataaaatatatatgttaaaagcattgaaggtgttctgtctcttgtctggttaaatttgatatcagagtcgcggattttcatttcgccgaatgtgcgatcccgtcgtgctcgtgaggttagccatttggctaatatccctttgacgtcggatttgggtaggtatcttggggtacctcttattcatggtcgtgtgacgaagcaaacttattggagtttagttgaacgggttcaagctaagttggctaactggaaaaccaataccttgtcattggctgggcgaatagtgttggtgaaatcggcagcggtggcggttcctttgtacactatgcaggctgccaaactgccatcatccactcgtgaagctattgataagagttgtcgatactttatttggggttccactcaggaccatcggagggtcacttagtcaactgggatgatgtgtgcaaaccgaaggacaatggtggtctggggttacattgtatgcgtgaatggaatttgattcttcttgccaagttgggatggcgtttttttaactcagagtgagagcttatgggtttgggttcttcatgccaagtatctaacgagtgaacctgatttcctcagtgcacggaaggggaccaattgctctcttttgtggagaagtttgcttgcgggaagagagttgcttcaacaaggattagcaagacgagttggtaatggtgagtccactttattttggttagataaatggttacttgatagaccactaattgaggatttatcgagtaatattccagaggaccatcttaatttgagagtaagtgattatttgaatagttttggctggaaaattgatgagttgggctcgatgctttcggatgttaatcttgagagggtgcgtgcttatccttgcttggactcgtcgaatgttgaggatgttatgcactggagttgcaccaatgatggtgaatttactgtcaagtcagcttatgagctattgatgggtaactctgctgcgacgattcctgttgcaaaagctatctggaagctgtctacccttccaaaagttcaagcgtttgtatggcttgtgtggcaggggaaaattatgtgcaagttcagctacttataacgcatttaacagctgatggtacatgctttgtgtgtgctgcgggccaagaggatgtttctgaggtatggtctcattttatttccccgtctcagtctcaagctttcgctagttgcgatatggaggattggtggcatttgaatttggttgtgtggagaaattgtaaccatggtgattggccatggcgttgtgtctttccgtttatatgttggagattgtggaaatggcgcaatgaaacatgtttcaatttaatgtctcgaccgattcagtctaagttgcaggttatttgcaatgttgttaaagaattcttggctgagagcgtgatgaaagatgttccgtctcgagtcgaggttctattacattgggatagacctgaggatggatggtttaaagttaatacggatggctcgtggtgtcaatcgagtgatgtggctggtgcagggggtgtgattcgtgattcggccggtaattgggtgagaggctttcggttcggatgcggttcatgtggcatcgatatggctgagttatggggcttgtttagtggcatacaacttgcgtggagtatggggttaaggaaaattgaggtcaagtccaattcgcaaacattggtcaatatgataaaggctggagttggggttcgtcatcctctttatcctctggtttcttctattggtgcatatgttgagaaggattgggattgcagggtgtcctatatcccaagagagcagaatggggtggctgatcgtctagccaaaatgagccttgattttgagccaggcctttgtgttcttgatgactcgccatctgaagttaaccagctgcttttagctgatttgttaggggtgtctttcccacgtttgatgtcaatttaattctagtgtattagggcggttctcgccctctttcttaccaaaaaaaaaaatgcatgtatacttgttatcttaggagtcagttgtgattaatttccccagattttcgaatcctggaatacttgttttctccttgactagatctatttgctttttaaaagtaatttattcgtttaatgtataagcactatggaaagtttttttaatatgtatcaattgtctttctgttgcacatattttttttgcagggatgctacaaaatcctcaataccgtcaacaactgcaagacatgctgtaagctttgctctgacttctgcatttggttgtatttatgagcttgtctttctcttgatttagagttacaagcattgccaccaaaacttttttatgtacagctatactattctatgtaatatttattgatgcatgcttcctggtcttgatttttgcctaaatgcctataatgtgcttaaagagtaacaataagggatgaaaaccatcaaaagttcacacgcaaaattagcataatacactagtgaaaattgactttttgaataccttgtaatacacattcatggacgtctttctgaatttctttttttctgtggtcacatttcatattttatgcatttattggatgacaagtctttagttttacacttatctaatttttcttgattttcattaactttcaaatgatcaggaaaacataatctttgggaattcattgatgctaaaaaattttatcgattcatacataatcttctaaaagtcatagtctgtgtacattagttcctaccattctgcttgagtttcttgcaattgatgccagtatttattctttttctcttattaatgtcttgaatttttttcttctttctttttccagaaataatatgggtggaagttctgaatgggacaataggatgatggactccttgaaaaactttgatctcaacagtcctgaggtgaaacaacaattcggtaagtctaaacctattgttgaaggtcaagctctcttgtgctcgaatatgttttatttaccaaatagagttatttttaatctcttccttcctttctcctttgcagaccaaatcgggcttacacctga

SEQ ID NO: 849 - DNA, 1108 bp, Abutilon theophrasti
ttttcattaactttcaaatgatcatgaaaacataatctttggcaattcattgatgctaaaaaaatttatcgattcatacataaagagaatcataatatactcttactctgctgataaaagtcataatctgtgtacattagttcctaccattctgcttgagtttcttgcaattgatgccggtatttattctttttctcttattaatgtcttgaatttttttcttctttttccagaaataatatgggtggaaattctgcatgggacaataggatgatggactccttgaaaaactttgatctcaacagtcctgaggtgaaacaacaattcggtaagtctgaacctattgttgaaggtcaagttctcttgtgctcgaatatgttttatttaccaaatagggtttttttaatctcttcctttctcatttgtagaccaaatcgggcttacacctgaagaagtaatatccaaaataatggccaaccctgaagttgctatggcattccaaaaccctagagttcaagcagctatcatggatgtatgtttttttttatattgttaattgtctctcttgatgtgtcatgcatcagtattgatgttctccatttgccgcttttgcagtgttcacaaaatccgctgagcattgcaaaataccaaaatgacaaggaggtaatctaggcctttttatgcttaatatttaaagtttttttatttattggctatttgatgatgacttggagtgtattgcctcttatctgtctttttaagcaaaaaattctcttctttcctaaatggccgcttattttcgctaaaaaattaggttgtttttcgctcctaatacacttttttgacatacatgtgtagacctacatttttaaccacatgcagagtgtgaatgtctatgatttgactggttcaatgagctctgcaactgcaagatacttgtgaagattccatctacggcatatcaaattgtttaatctttactgcaattttctggctcttgattatagctgatttggattttaaagttgatttattgatgcaacttattgttgatataattttttgatgagatttgtttttgcaattcaggttatggatgtattcaaca

SEQ ID NO: 850 - DNA, 486 bp, Abutilon theophrasti
gttattcaaattattcaccctttagcctttactgtattctagaggtttctttacctacctgtaggctgtagctgtacttaaattgcttactttcacaactggttttataaataaagttagtgcctctctcttctttctctctagggttttcaaccgatatggccgacacattgagatagaggtaaatgcctaacgtaattaaatgaatcaagcccgaattcaatgctcggagtatttattatataagatcaacttgaataacttgtcggaaactatcttatcatagcaccgaataacagaacaaaatcttcatcccttggcttcataatcgactgaattttattcaatagcagaaagaacaaaaaaaaacaacaaaacacagtcatagttttgacaaaatatcatcgatagccaaaacaatcttatcatagcactgcaaaacccaagactcgtcttcatctcttgccgcataatccaactgcaata

SEQ ID NO: 851 - DNA, 927 bp, Alopecurus myosuroides
cgggaactggtaccctgcctccaatgccgcctccgtcgtcctatatcgggtcacctgttttctggattggaattggtgtagcattatctgcggcattttccatggtcacttcgagggtaaagaaatatgcaatggaacaagtattcaagtccatgatgccgcaaacaccacaaaacacatttggcgcgaactcgccattcccattttccatgccaccgcaggcaggccccacatcaccaagctatccatactcaggaccaaagaaaagtactccaaaaggtgcaactgttgatgtttcagctactgatgtggcagcaactggagctttggaatcgtccgatgtggctgaaacatcaaaaccgtccaagaaatttgccttcgttgatgtttctccggaagaattgcagcagaaggagcttcaatcttcactggagacagtagatgtaaagagtgatagcacaaaaagtgaaattaaggaggataccgagcaacaagtttctacaaatggagctgcttttatgccgactgaagattcctctactgggccaactgaatccagtaagtcaggacctatgctatctatggatacaattgagaaaatgatggaagatccagctgtgcagaagatggtttacccctacttgcctgaggagatgaggaacccagattcattcaagtggatgcttcagaatccgatgtatcgccagcaactggaggagatgctaaacaacatgggtgcatctcctgatcaatgggataaccgcatggttgatcacttgaagaacttcgaccttagcagtcctgaagtcaggcagcagtttgcgcaagttggcatgactccagaggaagtagtatcgaaaataatggcgaacccagaagttgctattgcgttccagaacccaaaaattcaaacggccataatggact

SEQ ID NO: 852 - DNA, 682 bp, Amaranthus albus
catggttgaagaaatttgctatgcaacaaactttcaagactatgatgagccagatgggatctcaaaacaatcaatttagcaatgcaggctatggatctggctcacctttcccatacacacctccatctacatcaggatctaatccatttggttacccttaccaaccaccttctacttctggaatgagtacctcatctacgtcaactaccacttctgcatcaagccaggctacttatccatctcctgctgcttctaaaacttttgcagtagtagatgtttctccgactgaaacagaatcatcaggacctgaagttgttaaagaggaaacggaaaataagactgaaacaaaaagatctgcattcgttgatgtttctcctgaagaaacttttcaaaatacagcatttgaaaactataatgactcatcttcaccgacaccatctgagattgctaaatttgctgaggttgtacaaaacggagctgcttcaacagaaagtacttccgagcaggatcaatctacacggaaaaagggttcgttgttatcagtggacaccttggagaaaatgatggaagatccgtctgtccagaagatggtttttccacatcttcctgaggagatgagagatcccgctacctttaaatggatgctacaaaatccagtataccgtaagcagttgcaagaaat

SEQ ID NO: 853 - DNA, 501 bp, Amaranthus albus
ataaatagtcctgaagttaagcagcagtttgatcaaatcggccttacacctgaagaagtcatctcaaaaattatggctaaccctgatattgcgatggcgttccagaaccccagagttcagcaagccataatggatgtttcgcagaaccccatgaatatcgtcaagtatcaaaatgataaggaggtcatggacgtgtttaacaaaatacaacaactttttcccgggacatccggccctttctgatccggtctgcaattcaagtagttctcgtattggaaaatgttgtccgcttagccgctaaaccatatattatttcaccaaagtccgtgaaagcatcgacaaatatccaaggcggtgttgatttagggctgaagagattagaccctggcctctgcaaagtttaggtaaaatctgcgagttagtatttttatgatattattttagttttgcactattagattgtcataaatgttatcttttgcttaaagttgaatatcccag

SEQ ID NO: 854 - DNA, 597 bp, Amaranthus chlorostachys
ccaaaaccataggaagggaagccctcttttcttcttcctgtaatatccaataaatcccctgaaattcagaacctttttccaaaaacatggaaaatttagccctagtttcttcaaaaccagtaatgggtttaagcaatttccctgattgtagaattatttctaccaaacaatgctttggtcttcctcttctacccagaagaacaaaagggtctgtctttgtttcaaaacccagatcaaaaactgttgtttttgccttgttttcctctaattccaacaaaaaagttgttcaaagtactcctgaaacagctgataaacagaccacttctgttggggttaatccacttccttatgctgctcctcccccttctcaatttgggtcacctttgttttggattggggttggtgttgcatgttctgcccttttctcctttgcttcttcatggttgaagaaatttgctatgcaacaaactttcaagactatgatgagccagatgggatctcaaagtcaatttagcaatgcaggctatgcacctggctcacctttcccatacacacctccttctacttcaggctctaatccatttggttatccttacc

SEQ ID NO: 855 - DNA, 1445 bp, Amaranthus graecizans
aaaccagtaatgggtttaagcaatttccctggttgtagaattatttctaccaaacaatgctttggtcttcctcttctatccaaaagaacaaaagggtctgtctttgtttcaaaacccagatcaaaaactgttctttttgccttgttttcctctaattccaacaaaaaagttgttcaaagtactcctgaaacagctgataaacagaccacttctgttggggttaatccacttccttatgctgctcctcccccttctcaatttgggtcacctttgttttggattggggttggtgttgcatgttctgcccttttctcttttgcttcttcatggttgaagaaatttgctatgcaacaaactttcaagactatgatgagccagatgggatctcaaaacaatcaatttagcaatgcaggctatggatctggctcacctttcccatacacacctccatctacatcaggatctaatccatttggttacccttaccaaccaccttctacttctggaatgagtacctcatctacgtcaactaccacttctgcatcaagccaggctacttatccatctcctgctgcttctaaaacttttgcagtagtagatgtttctccgactgaaacagaatcatcaggacctgaagttgttaaagaggaaacggaaaataagactgaaacaaaaagatctgcattcgttgatgtttctcctgaagaaacttttcaaaatacagcatttgaaaactataatgactcatcttcaccgacaccatccgagattgctaaatttgctgaggttgtacaaaacggagctgcttcaacagaaagtacttccgagcaggatcaatctacacggaaaaagggttcgttgttatcagtggacaccttggagaaaatgatggaagatccgtctgtccagaagatggtttttccacatcttcctgaggagatgagagatcccgctacctttaaatggatgctacaaaatccagtataccgtaagcagttgcaagaaatgttagacaatatggggggaactccagatttcgacaatcgtatgttggaaaacctaaagaattttgatataaatagtcctgaagttaagcagcagtttgatcaaatcggccttacacctgaagaagtcatctcaaaaattatggctaaccctgatattgcgatggcgttccagaaccccagagttcagcaagccataatggatgtttcgcagaaccccatgaatatcgtcaagtatcaaaatgataaggaggtcatggacgtgtttaacaaaatacaacaactttttcccgggacatccggccctttctgatccggtctgcaattcaagtagttctcgtattggaaaatgttgtccgcttagctgctaaaccatatattatttcaccaaagtccgtgaaagcatcgacaaatatccaaggcggtgttgatttagggctg

SEQ ID NO: 856 - DNA, 1685 bp, Amaranthus hybridus
ccaaaaccataggaagagaagccctcttttcttcttcctacaatatccaataaatcccctgaaattcagaacctttttccaaaaacatggaaaatttagccctagtttcttcaaaaccagtaatgggtttaagcaatttccctgattgtagaattatttctaccaaacaatgctttggtcttcctcttctacccaaaagaacaaaagggtctgtctttgtttcaaaacccagatcaaaaactgttgtttttgccttgttttcctctaattccaacaaaaaagttgttcaaagtactcctgaaacagctgataaacagaccacttctgttggggttaatccacttccttatgctgctcctcccccttctcaatttgggtcacctttgttttggattggggttggtgttgcatgttctgcccttttctcctttgcttcttcatggttgaagaaatttgctatgcaacaaactttcaagactatgatgagccagatgggatctcaaagtcaatttagcaatgcaggctatgcacctggctcacctttcccatacacacctccttctacttcaggctctaatccatttggttatccttaccaaccaccttctacttctggaatgagtacctcatccatgtcaactactacatctgcgtcaagccaggctacttatccatcttctgctgcttctaaaacttctgcagtagtagatgtttctccgactaaaacagaagcatcagaacctgaagttgttaaagaggaaacggaaaataagactgaaacaaaaagatctgcattcgttgatgtttctcctgaagaaacttttcaaaatacagcatttgaaaactataatgactcatcttcaccgacaccatccgagaatgttaaatttgctgaggttgtacaaaacggtgctgcttcaacagaaagtacttccgagcaggatcaatctacacgaaaaaagggttcgttgttatcagtggacaccttggagaaaatgatggaagatccgtctgtccagaagatggtttttccacatcttcctgaggagatgagagatcccgctacctttaaatggatgctacaaaatccagtataccgtcagcagttgcaggaaatgttagacaatatgggaggaactccagatttcgacaatcgtatgttggaaaaccttaagaattttgatataaatagtcctgaagttaagcagcagtttgatcaaatcggccttacgcctgaagaagtcatctcaaaaattatggctaaccctgatattgcgatggcgttccagaacccgagagttcagcaagccataatggatgtttcacagaaccccatgaatatcgtcaagtatcaaaatgataaggaggtcatggacgtgttcaacaaaatacaacaactttttcccgggacatccggtcctttctgatcccatctgcaattcaagtagttctcgtatcgaaaaatgttgtccgcttagccgctaaaccatatattatttcaccaaagtccgtgaaagcatcgacaaatatcaaaggcggtgttgatctagggctgaagagattatatcctggctctgcaaagtttaggtaaaatctgcgagttagtattttaatgatattatttttagttttacactattagattgtcatacatgttaatttttgcttaaagttgaatatcccag

SEQ ID NO: 857 - DNA, 1689 bp, Amaranthus lividus
ctaagccaaaaccataggaagagaagccctcttttcttcttcctacaatatccaataaatcccctgaaattcagaacctttttccaaaaacatggaaaatttagccctagtttcttcaaaaccagtaatgggtttaagcaatttccctgattgtagaattatttctaccaaacaatgctttggtcttcctcttctacccaaaagaacaaaagggtctgtctttgtttcaaaacccagatcaaaaactgttgtttttgccttgttttcctctaattccaacaaaaaagttgttcaaagtactcctgaaacagctgataaacagaccacttctgttggggttaatccacttccttatgctgctcctcccccttctcaatttgggtcacctttgttttggattggggttggtgttgcatgttctgcccttttctcctttgcttcttcatggttgaagaaatttgctatgcaacaaactttcaagactatgatgagccagatgggatctcaaagtcaatttagcaatgcaggctatgcacctggctcacctttcccatacacacctccttctacttcaggctctaatccatttggttatccttaccaaccaccttctacttctggaatgagtacctcatccatgtcaactactacatctgcgtcaagccaggctacttatccatcttctgctgcttctaaaacttctgcagtagtagatgtttctccgactaaaacagaagcatcagaacctgaagttgttaaagaggaaacggaaaataagactgaaacaaaaatctgcattcgttgatgtttctcctgaagaaacttttcaaaatacagcatttgaaaactataatgactcatcttcaccgacaccatccgagaatgttaaatttgctgaggttgtacaaaacggtgctgcttcaacagaaagtacttccgagcaggatcaatctacacggaaaaagggttcgttgttatcagtggacaccttggagaaaatgatggaagatccgtctgtccagaagatggtttttccacatcttcctgaggagatgagagatcccgctacctttaaatggatgctacaaaatccagtataccgtcagcagttgcaggaaatgttagacaatatgggaggaactccagatttcgacaatcgtatgttggaaaacctgaagaattttgatataaatagtcctgaagttaagcagcagtttgatcaaatcggccttacgcctgaagaagtcatctcaaaaattatggctaaccctgatattgcgatggcgttccagaacccgagagttcagcaagctataatggatgtttcacagaaccccatgaatatcgtcaagtatcaaaatgataaggaggtcatggacgtgttcaacaaaatacaacaactttttcccgggacatctggccctttctgatcccgtctgcaattcaagtagttctcatatcgaaaaatgtccgcttagccgctaaaccatatattatttcaccaaagtccgtgaaagcatcgacaaatatcaaaggcggtgttgatctagggctgaagagattagatcctggctctgcaaagtttaggtaaaatctgcgagttagtattttaatgatattatttttagttttgcactattagattgtcatacatgttaatttttgcttaaagttgaatatcccagcaat

SEQ ID NO: 858 - DNA, 2000 bp, Amaranthus palmeri
catcccctctatgtgagtaatctctctcgtctctagtaggccaaaaccataggaagggaagccctcttttcttcttcctacaatatccaattaaatcccctgaaaattcagaacccttttccaaaaagatggaaaatttagccctagtttcttcaaaaccagtaatgggtttaagcaatttccctgattgtagaattatttccaccaaacaatgctttggtcttcctcttctacccaaaagaacaaaagggtctgtctttgtttcaaaacccagatcaaaaactgttgtttttgccttgttttcctctaattccaacaaaaaagttgttcaaagtactcctgaaattgctgataaacagaccacttctgttggggttaatccacttccttattctgctcctcccccttctcaatttgggtcacctttgttttggattggggttggtgttgcatgttctgcccttttctcctttgcttcttcatggttgaagaaatttgctatgcaacaaactttcaagactatgatgagccagatgggatcacaaaatcaatttagcaatgcaggctatgcgcctggctcacctttcccgtacacacctccttctacttcaggctctaatccatttggttatccttaccaaccaccttctacttctggaatgagtacctcatatacgtcaactactacatctgcatcaagccaggccacttatccatctcctgctgcttctaaaacttctgcagtagtagatgtttctccgactaaaacagaatcttcagaacctgaagctgttaaagaggaaacggaaaataagactgaaacaaaacgatctgcattcgttgatgtttctcctgaagaaacttttcaaaatacagcatttgaaaactataatgactcatcttcaccgacaccatccgagaatgttaaatttgctgaggttgtacaaaacggtgctgcttcaacagaaagtacttccgagcaggatcaatctacacggaaaaagggttcgttgttatcagtggagactttggagaaaatgatggaagatccgtctgtccagaagatggtttttccacatcttcctgaggagatgagagatcccgttacctttaaatggatgctacaaaatccagtataccgtcagcagttgcaagaaatgttagacaatatggcaggaactccagatttcgacaatcgtatgttggaaaacctaaagaattttgatataaatagtcctgaagttaagcagcagtttgatcaaatcggccttacgcctgaagaagtcatctcaaaaattatggctaaccctgatattgcaatggcgttccagaaccctcgagttcaacaagccataatggatgtttcgcagaaccccatgaatatcgtcaagtatcaaaatgataaggaggtcatggacgtgttcaacaaaatacaacaactttttcccggaacatccggccctttctgatcccgtctacaattcaagtagttctcgcatcgaaaaatgttgtccgcttagccgctaaaccatatattatttcaccaaagtccgtgaaggcatcgacaaatatcaaaggcggtgttgatctagggctgaacagattagatcctggctctgcaaagtttaggtaaaatctgcgagttagtatttttatgatattatttttagttttgcactattagattgtcatacatgttatcttttgcttaaagttgaatatcccagcaattttttatgttttttttttcatatatttttttatatcaatatgaataaggattttgtttgtgatttcgaagcaaaggcatcggaaactcgtacattacttttctatgttcttagcttttcttgctcgtttgaagttgtgcggagaggtatgaagtgtatgttcacgatttcgatggaaattctacaatgaaagactcggtttctttagaaattgtcataatcatttgtgtatatttaacgttaccaaatgtaagcaggggagatctgaat

SEQ ID NO: 859 - DNA, 1852 bp, Amaranthus palmeri
acaacaatgtgtttgagaattataagaaatgaaaactttgagcaagagttaattactcttttgacaatgcacaagtaaaagagaataagagaagagaatttagaaaagtgtgctcaactcatcaccaaagatacctatttatactacaagaatataacctatgggtcatggcacaataatcatttttaatgatcatattgatgatcatccaattcaatgtcataattcagacattcatgagaattattcagcataatactcccttgtaactccagaaatcaagagccataagtgaaaggatccaaagcaataactcaagaaaacgaaaaaaaagaccaacagtcatatcagcagcaaccgccgagtcggctgtcctaccctcatcaaggaaagccgactcgacttttccttctggacaaaaccatcattccagaaactaaacccgagtcggctttagtcccaaaccaaggaaagccgagtcagctttttgtgctgacttggttttccttagtttctgttttgtcctatcctttgaactccttttggacctagtatattaatacatattgtcccactactttaatagtacttagtgattataaacttaggattattagacactagctaaatgttcaacatatgagtggcaacgttgtctaaagagtgcaactactagcagaagaagacaacacaagcagaaactaaatctaaccaaaaaagaaaataaaaggagaaaaaaaagaaaataaaattaaataaataaacaaagtaaaaccacgataattatacaaaggaacaaaacaaagcatgtaagaagcaactagaccctagggcagaggccagagagggaactaaaggaactactagtagtctaaaacatgaatctgacgtctccaactactcttatccctaatcaagtccgtagagagacacaactcatttaagtcgtacttaatttgctctatccacgttaaaaatggatcaatccacatgtatttgatatcactatgagacactatcttcctgataatttgcgtttattttcatgattattgatgctgaaaaatttgtcaaatttatcataggttgggcttcaatgtgattggtcaggcctaaattaattcacgatcgattcgagttatcgggttggttcaaaatttgagaggtttgagactaatagagaattttactaggctttaaaaaaacaaaaacctaatttattatctctattgtcatacatgcgccatttcacacaccatcccctctatgtgagtaatctctctcgtctctagtaggccaaaaccataggaagggaagccctcttttcttcttcctacaatatccaataaatcccctgaagaattcagaacccttttccaaaaagatggaaaatttagccctagtttcttcaaaaccagtaatgggtttaagcaatttccctgattgtagaattatttccaccaaacaatgctttggtcttcctcttctacccaaaagaacaaaagggtctgtctttgtttcaaaacccagatcaaaaactgttgtttttgccttgttttcctctaattccaacaaaaaagttgttcaaagtactcctgaaattgctgataaacagaccacttctgttggggttaatccacttccttatgctgctcctcccccttctcaattgtaaagtttcaagcttttatcttttatcttattctaatttggtgcaaagtttattactttttgtttttatggttgaaattagctgatttttttcttgatatgtattaatgttggattacagtgggtcacctttgttttggattggggttggtgttgcatgttctgcccttttctcctttgc

SEQ ID NO: 860 - DNA, 3444 bp, Amaranthus palmeri
agtttttttgatatgtattaatgttggattacagtgggtcacctttgttttggattggggttggtgttgcatgttctgcccttttctcctttgcttcttcatggttgaaggtaagttttgttgtgagttatgctattttttggtacaatgtttctcatattgaatggattttgcaagaatgaggaagttgtgtattgcatttgtttggagggacttgggatatcttattacatttttatgactttcatctgattttttgattatcaattgaaatattgaagttttgagattatatgtttgggtttaatcttggggtgtggacatctcattacatttttatgactatcatttattctatcaactatgtattgcaagttgttaagattttaggacatctcatattgagtgtcttttgtatgaatgatgaagatatgtaatgcttatggtgggttaaagtggtgcattgaagcgcaaaaagtcattagagactaggtgctaagcggtgggaaggcttgggtttttgttggaatgcactcttttttgttaaaaagctttataatcacttttgatacatatattatatggcatgacattcatattaccatagtaataagcttgaaatcattcattatcatttgggtaaacactctttagcatataactacatataactattgttatgagaatatcaagattgcccgaagttatttcttcttctttaccagctttttaatggaagagtctattttttgaatgtcatagagttttaacttttcttccaaacaaacaagctttagttaatcacctagcctaacggggaggcgtattgggcgcacaaggcggtaaacacacaaaggtgtaccaaggtctacacctcttgtattgtgctttgcgtcacctagccaagtcattttcaggcaagtcagtgcttgaagcgcacaaggcgcaaagtgaggcacacttttgaaactaatgctaaagtaaattttgtggaagtgcgttctagtggagtgtttatcatatgtttatttttgaagatatatgtagagtttatgactagcttaagccttaaaagacatcatgtggagagggcgatgactttatcatcaacaattgttggctctttatggaggaagtaggattcaatggattgttcgaattccaatagtcatagtttctataagtgcacgatatagtaagtagtgatgggcattgcttaagtaaatgatattggacaaggtgaacgtgtcaaaataagatctttgcattttgcattatggtaaattgcttgaacatgaaataagggattgtgacaatttgatttatgatttttggctagtagcatcaacttttatattttgtgaaaggaattgtggagatgcttgataaaattaattgttgattatttattagagaaaaaatggaccaacaagtcaaaaatcaatggtaaaactgtcaagagaaaccttttcattttgggcttaaataacaacttttagctcgttgaaattcatttaccaataaggctttcaccaatcaatgatccaaaagtcaaaagccaaaaaaattagtaagctaggcgtaaagccaataatcaaatatggattatagctttatggtggtagggtttttttccccacaatttttctttgaaggttagggttgttgtcgaagaagcatagatcaagatatgtcgaatccataattagaatgagttgaggtttgagatattttcgagtaatttgtaagacgcactaatgcattgttgctgggtgccgtggtacaagaaaacccttttcaattctgctatgaatttcaacttttcaagatgtttaattacaattaaacttacaaaagttaaagtgggtatggtcacttgctcttgagtgcataatttgaaatgcgagacttacatggtaatggtttgggcggatgacgtaataacaaggtgatgtaaaaaaatattttaagaaattgaaaaagaagtaaacttgcgaggaactgaggttggttaatgtgatgcttatagggcttcatggtaagggatcataaagaagaataagcttctaaagtctttatgttaaatgatatgatgcctttgagaatgtagacaatgtgagaaatggtcttcaatgattcaatcaatgaaatttgagctttgagagatggaagtggaattgaatgaatagaaggattgatatattgatttatgttatgttgaaatgagagtaaaatagggaaagaaaagggagggaagtggaaaggtgacaatttcttcatttggatactaaaaggagaggacttgaggaggaaaatggaggggaatactcctttacattttgtacataatattctttgtagcttctacccttattatgtaaaaatattcatagtagacctaacccaattagctagtaacggaattttgatttttatccaagtggtgagctttaacgtttttggaaaatgaccattatagcaagtgtacaccttcctaaggagaccttcaagaagttcaaaattttgtgcctctcatcaccttgggaggtttatttcattcaaggagtttatgcctttaggaaaggttttctttaaggggccctgttaagatattattggagttttctctcgacaatgcaaaggcttagcccaaaggactgaaaatcttgttcatcgcaatttttagatttcatgatcttgaagattctcaagtttgttctagtctcaaatgtcatgggacaattttcttttctcctattgtcacccttggtgatttaaggaacaaggaaacatgagaatgggtattaatatatacaaatgaaaagagaaaatggatctgaaagtaaaatataacgtactttcaatctgcttaggcaatatgatttatattgacttatgattttgggtgttgaaaatctagactttgtttccaatttggaagaacctgggattattatttggcacaaaacttgaaattaggttgtgatcttaaggattgtggacaaatggaggtacttccaatgtatatggagcccgtgatctttacttttgaacataatcgttaacggttttgtgttcaatttttaaaagattataggatgtttaatgttgttcaagtgacaacctggacgcttaagatgttgtaatcaagatatctttttcattactaatctttgtacttgttactttcaatatacttcttttcagttttcaccactttaattggtttttacatgatcaatacacacacacacatgaggggcaagataaggtgaaaacaactaaagtgtgaaaattgaaaatcagatcgagttatatatgttgtgacaaacggtgtacatactgtttaaagggtgtacaaatttttgtgagaggaaaagttcgagttatttacagtaattatatatatatatatatatatatatatatatatatatatatatc

SEQ ID NO: 861 - DNA, 2445 bp, Amaranthus palmeri
ttcaattatgaaatcatgaatatagaatttgagaatgacaaggtttgggagatcattctcaaatcctcattttaaaaccatttttataacaattgtggatttgactcaaatccaaatttgaaattctaatatttgccaaacactagtcttgagtcaaatctatattttcaaatgaaatcctcattcccaaacatagcataaaggattttcgaatattttgtgaaaactagtggagatatcggtttctcattttgttcaaaacacgatatgtgaagtataaaaattaagaaacttatgtgaggggtgagaaaaatctgttgaaaggttccaatttttattgatcacttaaccattatataagaaaatattatacctcgtctacatttatttttgagttttacggtttatctaggaaattcccatttattacctgttccatttataaacaagctgcaatcttttgggattgcggctttggcattgttgttcacttatgaactggccgcaggatgttgcatatcttgacttcttgtaaaatgactttttaacttttatgagtgcgatgctttgagaagcgggaaagaaaatcttagataagggtcgtgtgctaagctcgttagcttttactatattttaattctcatcaacacatctgttagaagtgtccgtcattcattgtagaaaagattggttgacgcaaagaaggttcttctgctagtccatgatgtaataacgacatggtttcctctttagctacaaatactattatattcatatttcaatatttcattgttgaatgactttaggcttagatttttcgtgacatagcataaagccgtaacacttcatcagttcatcttctgcatgtagtgaatgatgtaaagatgcggtaacagtcaaaatcgcgataacagaacactgacgcggtaacaaaagtgatacggttacatagcgcctaaatatcggtcgaaaccttaagatatccattgatgcgggccaaaacgcggtttttttaacctttacaacgcgggaaatattagttcgtttattttgaaaacctttactatgcggctgatgcagctgatgcgatgcgatgcggccttgtttttactcgatggcatggacacttgaatatttcctttttgggccaaaacttgtttacttttcatggacatcggatgattatgatcaacaatgattgatgaatgaaattgtgtgatctttggagaaggtattaggacccttgatcggtttatctattgggctaaccttgggtgttctttttttttttggcagatcaaatcggccttacgcctgaagaagtcatctcaaaaattatggctaaccctgatattgcaatggcgttccagaaccctcgagttcaacaagccataatggatgtatgttcttaatctactcgcagtcttatcattctccgtcctttcaactcatataacccgtgttgctattgcaggtttcgcagaaccccatgaatatcgtcaagtatcaaaatgataaggaggtaaaagaatattttttatttgtaatctaaaattttttttgatgtcttgccatccatacttccatagctttatgttttttcttaatttaattaattatatgttttttctttctttatttattttttatatataatctaaaatttaaatagttatacgttctttctttctttctttattttttaaacgatttttttaaaatttttaatgaatgtcgcttggccaacaatattaactccttccaaaacgcattctttttctgtttagtgtcggaactctttagttgctccgttttactttcttttgaactctctttacttgtttcactagcgaacaatattcagttgctctcaggaaggcgatttagagcaacccttccatgtcacccagttttgttcgatttccttttaaattccacggtaggaaaacttatgatatttctcatactttcggttcaggtcatggacgtgttcaacaaaatacaacaactctttcccggaacatccggccctttctgatttcgtctgcaattcaagtagttctcgtatcgaaaaatgttgtccgcttagccgctaaaccatatattatttcaccaaagtccgtgaaggcatcgacaaatatcaaaggcggtgttgatctagggctgaacagattagatcctggctctgcaaagtttaggtaaaatctgcgagttagtatttttatgatattatttttagttttgcactattagattgtcatacatgttatcttttgcttaaagttgaatatcccagcaatttttatgttttttttcatatatttttttatatcaatatgaataaggattttgtttgtgatttcgaagcaaaggcatcggaaactcgtacattactttctatgttcttagcttttcttgctcgtttgaagttgtgcggagaggtat

SEQ ID NO: 862 - DNA, 2831 bp, Amaranthus palmeri
tatatatattatacctataccttttaagcataagcatgtatatacaattatacaccttttaacaaatgtctaattatttacaaatttaccatctgaacatgcacaccttttaagcttatatgtacacacatgtttttagttttacaactttaattggttttcacatatatatatatattctttcacacgtgtatatattctctgttagctataattacatcaatgaatattttcccattttacttgcgttattctttttatgattgtatcctgattgtttcatgatcaatatgtactttgtggacttgtcttgtttaattgttttcactgcttggattgccgtatgttacattctcataaatccggtcattttttctgtcagaaatttgctatgcaacaaactttcaagactatgatgagccagatgggatcacaaaatcaatttagcaatgcaggctatgcgcctggctcacctttcccgtacacacctccttctacttcaggctctaatccatttggttatccttaccaaccaccttctacttctggaatgagtacctcatatacgtcaactactacatctgcatcaagccaggccacttatccatctcctgctgcttctaaaacttctgcagtagtagatgtttctccgactaaaacagaatcttcagaacctgaagctgttaaagaggaaacggaaaataagactgaaacaaaacgatctggtataattgctttccccctttgaggttcttgacttccttgtgtatataataatcagaacttgaaagcttaacacttctgtaacgttgaacgagcgtgcttgaagctgcagaaacaattatcttaaaattttacctggttggttttgtgggtacattaggaattaggtttctgtacatttgagtgaaataattgcctcctaatgttttgggtaatggctgttggctggagatgactattggttggtttgaccagctggaagtattggcttataagggagctgtttaatgtagctgttatggcgagggtctacgtatattagagtagaggtgggttgtaaagcctaaaactaactgaaaactactcaaaccaacaaaaagctactcatagtagctttagataatcaactttggttttggcttaaaagccatctttttagctggcttaaaatcatttacccaacacattttttggctatttgacttgccaaaagccaaccaaaaaggcgattgaaaactatttaccaaatatccctcttaacataagttgcagatcatatgtatgaactaatgtctactaatattatatgatgacaattgtttgatttttcattgggtgatattcaattttattgcagcattcgttgatgtttctcctgaagaaacttttcaaaatacagcatttgaaaactataatgactcatcttcaccgacaccatccgagaatgttaaatttgctgaggtaatgtgcagcggcattagttttgtcatgcttatttaaatttgaatatgtaaagtctcaagttcactttatataggttgtacaaaacggtgctgcttcaacagaaagtacttccgagcaggatcaatctacacgtgagtgaaacatatacattgcttagtttggtccatattcttaaattccttatattttagttgtatttgacttcaaaaagtttgaatcaatgataaaagtttcctgtagtgcgactacaatgctctttatatgagagaaatgaggaaaatgacatgtaatttatttatttgtttaattatattcttgtgtatggaatattaattcgaaaagtgatcaacatcttgggatacacataaaagatcatatgaaatatcttcttttaatatattgaaatgatgttatatgccttttcagggaaaaagggttcgttgttatcagtggagactttggagaaaatgatggaagatccgtctgtccagaagatggtttttccgtaatacttctttcctttgttaccttttcataaatctttatgacatgctttgtgacctttgtgttgtatctgctgtcggactttctcccatatacccacccatttcttcaaatattaggtgatattgtggtacaagaggtgcaaataaaaaacgatagtgaccttaagaaattcttcaaaataacactcacctaaaaacaaaatcccatttgggaaataatgtttattttatggcaatgattttggacatgcgtagaagttgcacgtcttctaatcattcccacttatgctaactgaaaaattatgttatatgccggtgaacccagatggtgagttactaatttcacatcttgaaaataaattggagctaaagaaccatgttataatggttaaattgtagtcggaaggctgtgattttttctctttcccccctctttcgagtgatatagccttgaatatgctgccagacccgacttttgccttaaatatagaagcacggagttgacttggttgtcttgtggtgtggtcatgatcacaagtttatagcttgttgattgttatcgacatgtggtactatttcgagaaaaatgatgatcttttctattttgtttcttgttgcagacatcttcctgaggagatgagagatcccgttacctttaaatgtaagcttgctgattcacttcctttcttctatttactcatttagtggttgtttttttttttctcttattcatttaaaataagcttagtcactttactgaatttgtcgagaatgtaacaacaagaaactctctgtttgctttaatgtgtgtttttacttgaggtttagaagagaatttataatggggtcgcaataatt

SEQ ID NO: 863 - DNA, 2253 bp, Amaranthus palmeri
tttgtcgagaatgtaacaacaagaaactctctgtttgctttaatgtgtgtttttacttgaggtttagaagagaatttataatggggtcgcaataaagtgtggaaaagatgtgtgtgttatgatgattgaaatatagatgagttcctattttgattaacacacttagtatgagtgttataagatctttggtctcctttaagatttgagaacatgcgaacctgtcagaagcgaatccgtaaaaaattatcacccgtcccaatataaaaaaaatgcaaaaaaattcttaaaaaaaaaaagcaaaaaaagtattattagcagttagacaagaagttaggagaaaaaaattgagtcatgtgaaaacaatggttggcaataattatttgggataacattaaaaatttacaaaaaattctcatttaagacgttgtcattgttaattgagctaaatagtccaacttaattaattaaagcagccacttagtcacttacatacaaaatcaccaaattttaattgtttaatgtttgataattatttaacattacataattgaaaatggaattcctttggatttctcgatttttaataacaaccattccacttgcaatttctaagttttaaattaacagcaattgttttgcttttgttcgatctttcaataaagtgttgtatattgttatgcaatcttttcgttatcaaaaagaaaatgttctgcaattgttttggggattatgctacaattttactgaagatgctaagcttatttaatggcagggatgctacaaaatccagtataccgtcagcagttgcaagaaatgttgtgagttccattctcggctagtgtacttttgttctattttatgccacccttcaaattcttcatctctttttacattataattattataattttaagtttatcaacagagtgaccgtcgatttggatttcacatttgtctatgtcatggctgatggcatgttctataattattatagttctttggtttagacttatggaagatgacttgtttagtcatgtgcttttcttatttatgtgaaagtgccgatagggtaaattggaaacctacctctttgtttttacagggttaaggttgtacacttccatcccccaaacactgcatatgtggttgtcacttaatgacacttgggtagtgggatattgtcgtctattgtgcttaaatttgacatgtaaagtctcgaaatgtagtagcaaatgatgttacacatcaaattaagtacaaaatttagtatagacagtaaacatgaagctcttctaaacatcttctaatgtatccatttgatatgttttgagctccttcgaggggcatcccaaaagctctatgatactcgtcggttttgcattttgaatataatttgagtaattctataaataaagtaggtgtggagagacaaaatatcagaatgctgtgagtgttgatttgagttttgtagctttgggagattttcaagccgctcaaagaaagtatctttaatttactgtatttccattttgatctaagtcaacaatgggattttgaacccaccttctcgaaagtgacgctctgatgcgtatatattaaataagaagatagattctcccgatcaccataatgagatgaaaaactgcctcgattcagcgttgcttgtgccatcacaatgtcatcaaaaagttacttgatcgattcctgacatttttgatctgcacgtgggtgttttgtgactgctgtcagtttgggagccgataccgatcattttttatctaatcttgtaaatggccatgagagttcgttacattcatctttcatcttttttataaaatatgatcgggatatctatcaaaggtttcacttttccatcacatgacgttctttttttttcatcacgacaatgatttataggggtagtgacatgttcttgcatagtctccgacaatgcgcactcccatactaaagcactgatacctttttttgtcattattcgttactctatatgcccttaacctttgaccttttgtgagattttattttgattcaattgatgttaagtgtaacttattgtgtttttctcagagacaatatggcaggaactccagatttcgacaatcgtatgttggaaaacctaaagaattttgatataaatagtcctgaagttaagcagcagtttggtaagttccgtgattacttttgaattctatgttagattgttttacaaaacctttctttgtccatttctct

SEQ ID NO: 864 - DNA, 1787 bp, Amaranthus rudis
  unsure (1)..(1787): unsure at all n locations
gagtgatatctctctcgtctgtactaagccaaaccataggaagggaagccctctttcttcttcctacaatatccaataaatcccctgaaattcagaacccttttccaaaaagatggaaaatttagccctagtttcttcaaaaccagtaatgggtttaagcaatttccctgattgtagaattattcccaccaaacaatgctttggtcttcctcttctacccaaaagaataaaagggtcatgttttgtttcaaaacccagatcaaaaactgttgtttttgccttgttttcctctaattccaacaaaaaagttgttcaaagtactcctgcaacagctgataaacagaccacttctgttggggttaatccacttccttatgctgctcctcccccttctcaatttgggtcacctttgttttggattggggttggtgttgcatgttctgcccttttctcctttgcttcttcatggttgaagaaatttgctatgcaacaaactttcaagactatgatgagccagatgggatctcaaaataatcaatttagcaacgcaggctatggacctggctcacctttcccatacacacctccatctacatcaggctctaatccatttggttatccttaccaaccaccttctacttctggaatgagtacctcatctacgtcaactatcacttctgcatcaagccaggctacttatccatctcctgctgcttctaaaacttctgcagtagtagatgtttctccgactaaaacagaatcatctgaacctgaagttgttaaagaggaaacggaaaataagactgaaacaaaaagatctgcgttcgttgatgtttctcctgaagaaacttttcaaaatacagcatttgaaaactataatgactcatcttcaccaacaccatccgaaaatgttaaatttgctgaggttgtacaaaacggtgctgcttcaacagaaagtacttccgagcaggatcaatctacacggaaaaagggttcattgttgtcagtggacaccttggagaaaatgatggaagatccgtcagtccagaagatggtttttccacatcttcctgaggagatgagagatcccgttacctttaaatggatgctacaaaatccagtataccgtcagcagttgcaagaaatgttagacaatatggggggaactccagatttcgacaatcgtatgttggaaaacctaaagaattttgatataaatagtcctgaagttaagcagcagtttgatcaaatcggacttacgcctgaagaagtcatctcaaaaattatggctaaccctgatattgcgatggcgttccagaaccctcgagttcagcaagccataatggatgtttcgcagaaccccatgaatatcgtcaagtatcaaaatgataaggaggtcatggacgtgtttaacaaaatacaacaactttttcccgggacatccggccctttctgatcccgtctgcaattcaagtagttctcgtattgaaaaatgtcgtcgcttagccgctaaaccatatattatttcaccaaagtccgtgaacgcatcgacaaatatccaaggcggtgttgatctagggctgaagagattagatcctggcctctgcaaagtttaggtaaaatctgcgagttagtatttttatgatattatttttagttttgcaacattagattgtcataaatgttatcttttgtttaaagttgaatatcccagcaatgtttatggtatttttttttattcanatanaagagttnttttgttgtttaaaaaagaaaaaaaanaaaaa

SEQ ID NO: 865 - DNA, 299 bp, Amaranthus rudis
attctccgtcttttgaactcatttaacccgtgttgctgttgcaggtttcgcagaaccccatgaatatcgtcaagtatcaaaatgataaggaggtaaaagaatattttttttgtaatctaaaatttctttgatgtcttgccatcgatatttccatagttctatgttttttcttaatttaattaattatatgttttttcttttatttattttttatttgtaatctaaaatataattagttatacgttctttctttcgtgtcatccaattttgttcaatttctttttaaattccacggtagg

SEQ ID NO: 866 - DNA, 812 bp, Amaranthus rudis
cccacccggaccctgccttgtccgggatactgggagtgtcatttacctttacctttattttggacatgcgtagaagttgcacgtctatgttaactgaaaaattatgttatatgccggtgaacctagatggtgagttacaaatttcatatcttgaaaacaagctaaggaaccatgttataatggttaaattgtagtcagaaggctgtgattttttctctcccccctcttttgagtgttatagccttgaatatgctgccagacctgactttttatatagaagcaaggagttggcttggttgtcttatggtgtggacatgatcacaagttcatagcttgttattttatcgacatgtggtactagttagagaaaaatgatgaagatcttttctattttgtttcttgttgcagacatcttcctgaggagatgagagatcccgttacctttaaatgtaagcttgctgattcacttcctttcttctatttactcatttattggatgttttttttctcgttcatttaatataagctttgtcgttttactgaattggtttaagaatctagcagcaaaaaacctcctgtttgctttaatatgtgttttacttgttgtttagaggagaatttataatgcggtcgcaataaagtgtgcaaaagatgtgtatgtaatgatcattgaaatatatatgagttcctattttgattcacacattagtatgagtgttatgaaatctctggtctccttttagatttgagaacatgtgttcctttcagaggtgaatcaataaaaatattatcaaatgtgccaatataatatt

SEQ ID NO: 867 - DNA, 882 bp, Amaranthus rudis
tctttatttattttttatttgtaatctaaaattttattagttatatgttctttctttctttctttattttttaaaaagatctttttaaataataaacgaatgtcgcttagccaacaatattcactccttcctccaaaacgcattctttttctgttttgtgtcggaactcttagtttctctgttttactttctgctgaactcgctttacttgtttcactagccaacaatattcggtcgctctcaagaagacgatttagagcaatccttccgtgtcatccagttttgttcgatttctttttaaattccacggtaggaaaacttatgatatttaccatactttcggttcaggtcatggacgtgtttaacaaaatacaacaactttttcccgggacatccggccctttctgatcccgtctgcaattcaagtagttctcgtattgaaaaatgtcgtcgtttagccactaaaccatatattatttcaccaaagtccgtgaaagcatcgacaaatacccaaggcggtgttgatctagggctgaagagattagatcctggcctctgcaaagtttaggtaaaatctgcgagttagtatttttatgatattatttttggttttgcactattagattgtcataaatgttatcttttgtttaaagttgaatatccctgcaatgtttatggtattttttttttatcaaatatgaattaagggattttgtttgtgatttcgaagcaaaggcatcggaaactcgtacgttactttctatgttcttagcttttcttgctcgtttgaagtcgcgcggagatgtatgaagtgtatgttcatgatttcgatggaaattctacaatgaaagactcgatttctagagaaaattgtaataatca

SEQ ID NO: 868 - DNA, 3870 bp, Amaranthus rudis
ttccagttaagggaactttggagatgcttgataaaaataattattggttgtttatatgagaaaaagtggactaacaagccaaaaatcaatggtaaaagtgtcaagagcaaccttttcgtgttgggcttaaaagacaatttttagctcgtttaaaattcatttcccataaggtttttagctcaccaaacaataagccaaaagtcaaaagccaaaaagaccataagctatgcataaaggcaatagtcatatatggattatatcttaatggtattagttttttttcttcacaatttttactttgaaggttaggattgtcgtcgaagaagcatagattaagatatgtggaatccgtaattacaatgaggtgaggtttgggattttaatgagcaatttgtaagacgcactaattcattgtagttgggtgccgtgatacaagaaaacccttttctattctgctatgaattcaactttttcaagatgtgtaattataattgaacttacaaaagttaaagtgggtatcgtcactcgctcttgagtgcatgatttgaaatgtgagacttacatggttagggtagatgatgtaatatcaaggtgatgtaaaaaaatattttaagaaattgaaagagaaattaacttgcgaggaattgaggttgggtaatatgatgcttataggacttcatggtaagggatcatagagaagaataagcttctgaagtctttataatgatatgatgctttttgagaatgtagacaatgtgaggaatggtcttcaacgatttaatcaatggaatttgagctttgagagatggaattggaattgaatgaatagaaggactgatatattgatttatgttatgttgaaatgagaggaaacatagggaaagaaatgggagggaagtggaaagatgacaatttcttcatttggatactaaaaggagagggcttgaggaggaaaatggaggggaatactcctctttacattttgtacataatgttctttgtagcttgtacccttattattcaaaaatattcgtagtagacctaacccaattagtaaccaaatttcgattactatctaaatggtgagcttcaacgtttttggcaaatgaccattatagcaagtgtacatcttcctaaggagacctttcaagcaattttgattttgtgcctcacttcgccttgggagggtttatttcattcaaggagtatatgcctttaggaaaggtattttttttgaggggccttattaggatattaatggagtttcctctcgacaatgcaaagtcttagtctaaagaactgaaaatattgttcatcgcaatttttagatttcattaccttgaatattttcaagtttgttccagtctcaaatgtcatgggacaattttcttttctctaattgtcacccttggtgatttaaggaataaggaaacataagaatgggttttaattaatatagtaaaaaaaaaaaagagaacacaaatcttttgtaaaacataacgtacttttccccctttctgctcggtcaatgatttattttgacttatgatttagggtgacgaaaacctatctatttccaacttggatgaagttgggaatgttttttggcacaatacttggaattaggttccgatcttaaggaatgtggacaaatggaggtacttcgaccttaacgtttgaactttatcgttaacggttttgtgttcaatttttttaacattaatttagattataggacgtttaatgttgttcaagtgacttcctggacgcttaagatgttgtgatcaagatatctttttttgtactaatctctgtacttgttactttttacataaaaacgtgttactttttgacaaaagttctactttttagacaatttttttcccaaaacataaatttcagaaaaagaaaacggacgaacgtatcaaaaaatgttacttcccaaacaaaatattttatttcccatcaaatacaggaacgaaaaaagttttgctttttacataaaaaagtgttatttttaagagattatgattcacatggttcttatattttggcttggttttcacttgaaaaaaaagtgttatttttaagagattatgattcacatggttcttatattttatattggcttggtgaaaaaagataaagtggtgaaaattgaaaatcagtctgagatatacatgttgcgataaaaaagtgtacgtattgtcttaaagtgtacatatttttatgaaggaaagttcgtgttatttgtagatatgtacatcttttaagcatgtatgtacatcttttttagcaagtgtctaatcatttacaaattttatcatttgaatatatacaccttttaagcttatatgtacacatgttttagttttcactactttaattggttttcacatgtatatttatatcttttagatcatgttgcaacaggggtgtagaataatcattcactgttagctacaaatatatcaatgtatattttcccatgttacttgcaccattcttttcaggatcgtatcctgattgtttattgattaatatgtactttgtggacttgtcttgtttcattgttttcattgcttggattactgtgtgttacattctcataaatccgtgcatttttttctgtcagaaatttgctatgcaacaaactttcaagactatgatgagccagatgggatctcaaaataatcaatttagcaacgcaggctatggacctggctcacctttcccatacacacctccatctacattaggatctaatccatttggttatccttaccaaccaccttctacatctggaatgagtacctcatctacgtcaactatcacttctgcatcaagccaggctacttatccatctcctgctgcttctaaaacttctgcagtagtagatgtttctccgactaaaacagaatcatctgaacctgaagttgttaaagaggaaacggaaaataagactgaaacaaaaagatctggtataattgctttccccctatgaggttcttgacttccttgtgtataaaataatcagaacttgaaagcttaacacttcaataacattgaacgagtgtgcttgaagctgcggaaacaattattttaaaattttacctggctggtttggtgggtacattaggaattaagtttctgtacatttgagtgcaataattgcctccaaacgttttgggtaatggctgttggctggagttgactgttggttggtttgaccagctggaagtatttgcttaaaagggagttgtttaatctagctgttttggcgagggtcgtcgtatattagaggtgaagtgggttataaagccaaaaactaaccgaaaaactagtcaaaccaataaaaaactactcatagtagctttaaataagcaactttggttttggcttaaaagccatctttttagttggcttaaatatgtatgaattgatgtctactaatattatatgatgacaattgtttcatttttcattgggtgatattcaattttaatgcagcgttcgttgatgtttctcctgaagaaacttttcaaaatacagcatttgaaaactataatgactcatcttcaccaacaccatccgaaaatgttaaatttgctgaggtaatttgcaggagcattagctttgtcatgcttatgtaaattgaatatgtaaagtctcaagttcactttatttaggttgtacaaaacggtgctgcttcaacagaaagtacttccgagcaggatcaatctacacgtgagtgaatatacattgctaagtttggtccatattataaaattccttatattttagttgtatttgacttcaaaaagtatgaatcaatggtaaaagtttcctgtagtgcgactacaatgctct

SEQ ID NO: 869 - DNA, 491 bp, Amaranthus rudis
ggatcaatctacacgtgagtgaaacgtatacattgctaagtttggtccatattattaaattcctgatattttagttgtatttgacttcaaaaagtatgaatcaatgataaaagtttcctgtagtgcgatacaatgctctttatatgagagaaatgaggaaaatgacatataatttattgatttatttatttatattcttgtgtatggaatactaattcaaaaagtgatcaacatcttgcgatacacataaaagatcgtatggaatttcttcttgtaatataatgaaatgatgattgtgatttaatatgccttctcagggaaaaagggttcattgttatcggtggacaccttggagaaaatgatggaagatccgtcagtccagaagatggtttttccgtaatacttctttccattgtgatcttttcatgtattattatgacatgctttgtgacctttggtcatatctgctgtcagactttttctcatgcacc

SEQ ID NO: 870 - DNA, 906 bp, Amaranthus spinosus
gagtaatctctctcgtctctagtaggccaaaaccataggaagggaagccctcttttcttcttcctacaatatccaataaatcccctgaaaaattcagaacccttttccaaaaacatggaaaatttagccctagtttcttcaaaaccagtaatgggtttaagcaatttccctgattgtagaattatttccaccaaacaatgctttggtcttcctcttctacccaaaagaacaaaagggtctgtctttgtttcaaaacccagatcaaaaactgttgtttttgccttgttttcctcaaattccaacaaaaaagttgttcaaagtactcctgaaacagctgataaacagaccacttctgttggggttaatccacttccttatgctgctcctcccccttctcaatttgggtcacctttgttttggattggggttggtgttgcatgttctgcccttttctcctttgcttcttcatggttgaagaaatttgctatgcaacaaactttcaagactatgatgagccagatgggatcacaaaatcaatttagcaatgcaggctatgcgcctggctcacctttcccgtacacacctccttctacttcaggctctaatccatttggttatccttaccaaccaccttctacttctggaatgagtacctcatatacgtcaactactacatctgcatcaagccaggccacttatccctctcctgctgcctctaaaatttctgcagtagtagatgtttctccgactaaaacagaatcttcagaacctgaagctgttaaagaggaaacggaaaataagactgaaacaaaacgatctgcattcgttgatgtttcccctgaagaaacttttcaaaatacagcatttgaaaactataatgactcatcttcaccgacaccatccgag

SEQ ID NO: 871 - DNA, 775 bp, Amaranthus spinosus
gtccagaagatggtttttccacatcttcctgaggagatgagagatcccgttacctttaaatggatgctacaaaatccagtataccgtcagcagttgcaagaaatgttagacaatatggcaggaactccagatttcgacaatcgtatgttggaaaacctaaagaattttgatataaatagtcctgaagttaagcagcagtttgatcaaatcggccttacgcctgaagaagtcatctcaaaaattatggctaaccctgatattgcaatggcgttccagaaccctcgagttcagcaagccataatggatgtttcgcagaaccccatgaatatcgtcaagtatcaaaatgataaggaggtcatggacgtgttcaacaaaatacaacaactctttcccggaacatccggccctttctgatttcgtctgcaattcaagtagttctcgtatcgaaaaatgttgtccgcttagccgctaaaccatatattatttcaccaaagtccgtgaaggcatcgacaaatatcaaaggcggtgttgatctagggctgaagagactacgtcctggcctctgcaagtttaggtaaaatctgcgagttagtatttttgtgatattatttttagttttgcactattagattgtcatacatgttatcttttgcttaaagttgaatatcccagcaatttttatgttttttttcatatatttttttatatcaatatgaataaggattttgtttgtgatttcgaagcaaaggcatcggaaacaaaatccttattcata

SEQ ID NO: 872 - DNA, 1498 bp, Amaranthus thunbergii
ccaaaaccataggaagagaagccctcttttcttcttcctacaatatccaataaatcccctgaaattcagaacctttttccaaaaacatggaaaatttagccctagtttcttcaaaaccagtaatgggtttaagcaatttccctgattgtagaattatttctaccaaacaatgctttggtcttcctcttctacccaaaagaacaaaagggtctgtctttgtttcaaaacccagatcaaaaactgttgtttttgccttgttttcctctaattccaacaaaaaagttgttcaaagtactcctgaaacagctgataaacagaccacttctgttggggttaatccacttccttatgctgctcctcccccttctcaatttgggtcacctttgttttggattggggttggtgttgcatgttctgcccttttctcctttgcttcttcatggttgaagaaatttgctatgcaacaaactttcaagactatgatgagccagatgggatctcaaagtcaatttagcaatgcaggctatgcacctggctcacctttcccatacacacctccttctacttcaggctctaatccatttggttatccttaccaaccaccttctacttctggaatgagtacctcatccatgtcaactactacatctgcgtcaagccaggctacttatccatcttctgctgcttctaaaacttctgcagtagtagatgtttctccgactaaaacagaagcatcagaacctgaagttgttaaagaggaaacgggaaataagactgaaacaaaaagatctgcattcgttgatgtttctcctgaagaaacttttcaaaatacagcatttgaaaactataatgactcatcttcaccgacaccatccgagaatgttaaatttgctgaggttgtacaaaacggtgctgcttcaacagaaagtacttccgagcaggatcaatctacacggaaaaagggttcgttgttatcagtggacaccttggagaaaatgatggaagatccgtctgtccagaagatggtttttccacatcttcctgaggagatgagagatcccgctacctttaaatggatgctacaaaatccagtataccgtcagcagttgcaggaaatgttagacaatatgggaggaactccagatttcgacaatcgtatgttggaaaacctaaagaattttgatataaatagtcctgaagttaagcagcagtttgatcaaatcggccttacgcctgaagaagtcatctcaaaaattatggctaaccctgatattgcgatggcgttccagaacccgagagttcagcaagccataatggatgtttcacagaaccccatgaatatcgtcaagtatcaaaatgataaggaggtcatggacgtgttcaacaaaatacaactaacttttcccgggacatccggtcctttctgatcccatctgcaattcaagtagttctcgtatacgaaaaatgttgtccgcttagccgactaaaccatatatta

SEQ ID NO: 873 - DNA, 1677 bp, Amaranthus viridis
ccaaaaccataggaagagaagccctcttttcttcttcctacaatatccaataaatcccctgaaattcagaacctttttccaaaaacatggaaaatttagccctagtttcttcaaaaccagtaatgggtttaagcaatttccctgattgtagaattatttctaccaaacaatgctttggtcttcctcttctacccaaaagaacaaaagggtctgtctttgtttcaaaacccagatcaaaaactgttgtttttgccttgttttcctctaattccaacaaaaaagttgttcaaagtactcctgaaacagctgataaacagaccacttctgttggggttaatccacttccttatgctgctcctcccccttctcaatttgggtcacctttgttttggattggggttggtgttgcatgttctgcccttttctcctttgcttcttcatggttgaagaaatttgctatgcaacaaactttcaagactatgatgagccagatgggatctcaaagtcaatttagcaatgcaggctatgcacctggctcacctttcccatacacacctccttctacttcaggctctaatccatttggttatccttaccaaccaccttctacttctggaatgagtacctcatccatgtcaactactacatctgcgtcaagccaggctacttatccatcttctgctgcttctaaaacttctgcagtagtagatgtttctccgactaaaacagaagcatcagaacctgaagttgttaaagaggaaacgggaaataagactgaaacaaaaagatctgcattcgttgatgtttctcctgaagaaacttttcaaaatacagcatttgaaaactataatgactcatcttcaccgacaccatccgagaatgttaaatttgctgaggttgtacaaaacggtgctgcttcaacagaaagtacttccgagcaggatcaatctacacggaaaaagggttcgttgttatcagtggacaccttggagaaaatgatggaagatccgtctgtccagaagatggtttttccacatcttcctgaggagatgagagatcccgctacctttaaatggatgctacaaaatccagtataccgtcagcagttgcaggaaatgttagacaatatgggaggaactccagatttcgacaatcgtatgttggaaaacctaaagaattttgatataaatagtcctgaagttaagcagcagtttgatcaaatcggccttacgcctgaagaagtcatctcaaaaattatggctaaccctgatattgcgatggcgttccagaacccgagagttcagcaagccataatggatgtttcacagaaccccatgaatatcgtcaagtatcaaaatgataaggaggtcatggacgtgttcaacaaaatacaacaactttttcccgggacatccggtcctttctgatcccatctgcaattcaagtagttctcgtatcgaaaaatgttgtccgcttagccgctaaaccatatattatttcaccaaagtccgtgaaagcatcgacaaatatcaaaggcggtgttgatctagggctgaagagattatatcctggctctgcaaagtttaggtaaaatctgcgagttagtattttaatgatattattttagttttgcactattagattgtcatacatgttaattttgcttaaagttgaata

SEQ ID NO: 874 - DNA, 968 bp, Ambrosia artemisiifolia
aatgcctaactgtttttataagcagcttattaagcaatcctaaaaacctccttatatttgtatcacttagctttattaaacaatgtaaactgattcttgaagacctaagttcttataagttgtaattttgttctttccagctatcttccggaagagatgaggaacccgacctctttcaaatgttagtatctcatactataatttctatgatacaaatatttttatcctttgttttaaagaccaagacgtaaaagatcatcttgctaatatgctgcatttttatttcagggatgcttcaaaacccagaataccgtcaacaactgcaagatatgttgtaggtttcccattcgacctcaacatttatcgttctagcattaatatgtgttttttaaatgtagtatttatcggattttcctattttaatcaggaataacatggggggaagccctgaatgggataaccgtatgatggattcgttgaaaaattttgatcttaacagtcctgaggtcaaggagcaatttggtaatttttcacaattatttggttatgtgttttcacttttcaccaacgttacttatctatcaagaatgaaatcaaaccaaactgacccatatcgttgtggacaaaccagggtaatgggtcaaaactggtaattttttgttcggctcaaaattagtcaggttgggctgccttgaaaaactttttttatattttattgaatttgtgaataatgtgttaaaatatgtttacaaaagatattttattaagataataactatctttttcgatttacaaagtgattttggaggtattatactatgattacacctcggataactttaataccactttttattaaacatagctcaattcgactcatttataggtactgaatcaaatttgtcacatatagatatggtcggacttttggagtggagactggtggtctcactgttccctaggatagg

SEQ ID NO: 875 - DNA, 1580 bp, Ambrosia artemisiifolia
agtatatatagataatatttgttagatgaggtttaattgtatacatttttgttatttttgttgaaggtgaattcgggcttactttagaagaacttacatctaaaatcaaagagaacttggataatgttaaggcaattccatttccaaaccgtagagttcaaacagctttcatggatgtatggtctcaaatgcacatgcactcaatggctattttttgatttctactgaagaataacattaatgttttgtttgcagttttttgaaaaccctatgaacatattcaagtacctaaatgacaaggaggtaatgcccagaaaactctatttatttttataataaaattagctattgttctactcatccaaacataaaattttatttatgttattttcaggtcatggatcatgtcaacaaattacttataactctttttagggttgacccgcaaatgggcacacaaaataaccaatctggtaatgttggtttttcacaaggctcagctgccacatcagcacctgcttcgccatgttcagtgactgtagatgtatctcctactaagacagagatagcacctgcagccacagagtctaaagatgcagttgaattactcaacgacccaaagaaatccggtatttaaatcgtaataacggttgcaacatttgtagagtttaaagattaagagccaaaaaggcggaaagttcgtcttgctaatatgctgcatttttacaacagggatgcttcaaaacaataaacaagtgctggatatgcagtaagtttttcattcgagtacaacattttccatttttacttataataatatccatctgatttttcttattttactcagtaataacatggggggaagccttgagttggacagtcgtttgatagactcgttgaaatattttgatcttaacattcctgatatcaaggagcaattaggtatattttgatcatacccaatggttcgtgtccttgtattcatttacatgtgttgcatgtgtagcaacttgattgttccacatatcgattgactaatcgagacaagcatacgtataattcagttctaagttacaaactttacataatgaccccttaacctatttacaaatacataatgactctaataaatacataattgactcataacttagtttaggctagtgatcaggactatatccaacaatagttgtattgttacaataataatccaatctgttttagctatatataaagcaattttggaggtatataaatacacttcaaatgactttcaacttgtttttgataaaatatggcccaaatcgactcgttaatggatcacacatgtctcatatagatacgggtcgttggatcgttgtagacaaatcatggtttattgtatgtagaggctgtgagattggcaaggtgatgggtcaaaatgggtaatactattgttcgggtcaaattagtcgggttgggatgtcttgaaacatttttttatatattttattgagttatatgaataatatattaaatatgtttacaaaaagataatttattacacctcagatgactttcaatccgtttttgatcaaaca

SEQ ID NO: 876 - DNA, 1578 bp, Ambrosia trifida
gttattgatgtcgcctatatacaaacaaaccaaaacccttctaaacctataacccatccccaattttgtgcagaatctttgcttctttaccatcttcaacagctcccaatacaatggatactctatccctttatgcttcttctcctaaaccaattataggctctacaaccaattctttaatctccatcaaaccctccttctgttccttcaaactccccaaatcaagaacttcgatttctgctctctctcgccatcaagattcaaccccacaaagagttatcaaatcagaagatgggtttgctagaatttcaaagtcaagtaatcagcatacttcatcagttggttcagccccacagattgcagtgccaccaccatcttctcaagtagggtctcctttgttttgggtgggagttggtgttgcattctctgctgctttttcatgggtggcttcatatttaaagaataaagctatgcaacaagcctttaagaccatgatgggcacacaaaataaccagtttgctaatgctggtttttcaccgggatcaccttttccatttccgccacctgcagcaccaggctcgtcacctggatcccctttttcttttccaccatatccagcaccaggctcggctgctacgtcagcaccaagttcatttgccgcatcagcacctgcttcccaacgcacagtgactgtagatgtgcctcctactaaaacagaagcacctgcacctgcacctgcacctgcacctgcaaattctgaagatgacttcgaatcacccaaagagccaaagaaatctgctttcattgatgtgtctcctgaggaaacattgaaaacaagttttgaaaagcttgaagaatctaccgacactgaatccccaaaagattctcaatttgcatatcaagcttctcaaaatgggtctgcctttaaaccaacggatagctcgtttgagggggcttcgtctacaggcgcaaaaggacctactatgtccgttgaggctttggagaagatgatggaggatccaactgtacaaaagatggtctatccctatcttccagaagagatgaggaaccctacgtcttttaaatggatgcttcaaaacccgcaataccgtcaacaattgcaggatatgctgaataacatgggcggaagctctgaatgggatagccgtatgatggactcattgaaaaattttgatattagcagtcccgaggtcaagcagcaatttgatcaaatcggacttaccccggaagaagtcatatctaaaatcatggcgaatcctgatgtcgccatggcatttcaaaaccctagagttcaagcagccatcatggattgttctcagaaccctatgagtatcatcaagtaccaaaacgacaaggaggttatggatgtgttcaataagatatcagaactctttccgggggtgacgggtgcaccctgatcatgtttaagtttattttcttcctactagttagggcgtttttcgtgtttttgcaacctaaggaacttaaagctgctgaagaaaatcatcatagccatagttgatcacatttgtttggcctcaggagaatggaattttg

SEQ ID NO: 877 - DNA, 562 bp, Ambrosia trifida
acctaaaaggctaaaagcaaaaaccctcttgttgagttgttgagattgaagttgatgaggttattgatgtcgcctatatacaaacaaaccaaaacccttctaaacctataacccatccccaattttgtgcagaatctttgcttctttaccatcttcaacagctcccaatacaatggatactctatccctttatgcttcttctcctaaaccaattataggctctacaacccattctttaatctccatcaaaccctccttctgttccttcaaactccccaaatcaagaacttcgatttctgctctctctcgccatcaagattcaaccccacaaagagttatcaaatcagaaggtgatttctttcatacccttttcctgttttgcaataaagttttaatctttatgtgttttagtttctttatgttataataatcttgatgtggttttttatgtgtaatgaagattggtttgctagaatttcaaataatattgtgattctttgcatacccttttcttattttgcaataaagtattgaactttatatgttttagtttctttaagtt

SEQ ID NO: 878 - DNA, 396 bp, Ambrosia trifida
aagatatcagaactctttccgggggtgacgggtgcaccctgatcatgtttaattttattttcttcctactagttagggcgtttttcgtgtttttgcaacctaaggagcttaaagctgctgaagaaaatcatcatagccatagttgatgacatttgtttggcctcaggagactggaattttgtttaactttatcagggtttacagaatttggtgtagtataaaaatttatttgacccattatacttggtgttttggtgtttaagatatgtgttaaaaacaatttgtttattaagaggaaagtagtcttttcctttcatttagcagtttggtgttggtttttttaaacatgtgtgtttcctattttggttgcgttaaagggcgtaaaaggagttattt

SEQ ID NO: 879 - DNA, 1135 bp, Ambrosia trifida
gtaaaatatgctttagttattatcttattttatataaatattgatctttcttgtatgaaatgaaggcttctcaaaatgggtctgcttttaaaccaatggatagttcgttcgagggggcttcgtccacaggtggctcaaaatctttatattttttttccctattattaagcatataatgtgaatttatgtataatttttgtatcgttatgtgatgttttaagtaagaagctaatttagttgtgtgtaataatgggaaaggcgcaaaaggacctactatgtccgttgaggctttggagaagatgatggaggatccaactgtacaaaagatggtctatccgtaagtttatagttgttatgccaaatacccaaacaaatgattatcttattaaccactctctttccccgctttggtttcgtttatcagatagttaatagttattagcagaactatgttagccggacaatataaactgattatataatatctaagttcttataagttgtatgtttgttctttccagctatcttccggaagagatgaggaaccctacgtcttttaaatgtcggtatattttactataagttctatgatttcctacaaatattttaaataagacttgaaaaccatcgttttgctaatatcattcgtttttaaaacagggatgcttcaaaacccgcaataccgtcaacaattgcaggatatgctgtaagtttgtcattcaagttcagcatatccgttctgatattagtttgcatttttattctaatattcatctgatcttttttttttaattcaggaataacatgggcggaagctctgaatgggatagccgtatgatggactcattgaaaaatttcgatattagcagtcccgaggtcaagcagcaatttggtaatttctcacaaaaaattggatgttggttttcgccatctatagttgatacatatataataaattgatacgtatttaaatatattatactacttactatccatgcactcttacggtctgcgtacgtatatataatattagtttaaatattgttaatttatattttatatttttgttctattttgttgaagatcaaatcggacttaccccggaagaagtaatatctaaaatcatggcgaatcc

SEQ ID NO: 880 - DNA, 486 bp, Ambrosia trifida
ttgataccggaatggaatatatgttgcatatcagtgatgcagtgccaagattttaataatggtgttttaagttttttgttatatgttcaaaatttcagaataaagctatgcaacaagcctttaagaccatgatgggcacacaaagtaaccagtttgctaatgctggtttttcaccgggatcaccttttccatttccgccacctgcagcaccaggatcctcacctggatccccttttccttttccaccatatccagcaccaggctcggctgctacgtcagcaccaagttcatttgccgcatcagcacctgcttcccaacgaacagtgactgtagatgtgcctcctactaaaactcaagctccacctacacctgcaaattctaaagatgacttcgaatcaccctaatagccaagaaatctggtaggtagtgatcattgaaatacttacatgtttcttatttttttgtatgggttgtcaggcgtctaat

SEQ ID NO: 881 - DNA, 284 bp, Ambrosia trifida
gtttatatgttttagtttctttaagttataaacttataataatcttgatgtattttttatgtgtaatgaagatggatttgctagaatttcaaagtcaagtaatcagcacacttcatcagttggtgcagccccacagattgcagtgccaccaccatcttctcaagtgtaattatgtggcttttattgttggtttttatgttttgtggttgttgattttttgttgaaatgtggagttgacttgttgactttggttgtgattgtagagggtctcctttgttttgggt

SEQ ID NO: 882 - DNA, 358 bp, Ambrosia trifida
ttttttttataaaaataatgaaattgcaactttttttattttttttataaataaagaaataaatgtgatggttatgataacaatagcaatattattgcgataataaattaataaagtttcccaaacattaggattaacgtgtctccaggtttcaataatccatattttatacttctactaaaatttttaacttgttttttcagctttcattgatgtgtctcctgaggaaacattgaaaacaagttttgaaaagcttgaagaatctaccgacactgaatctccaaaagattctcaatttgcatatcaagtaagattattttttttatatatatttttatggtaaaatatgctttagtta

SEQ ID NO: 883 - DNA, 633 bp, Chenopodium album
caattctgggatttcttatcatctgaatcctaaaaaagatggaaaatttagccctagtttcatcaaaccctgtaatgggattaagctattccccaaattatagaaccctttcaacaaaacagtgcttttgggctccctcttttacccccaaaaccaagtgggtttctcttagtttcaaaacccagatcaaaaacaatcttatttgctttctccaccccaaattccaggagaaaatcttctaagaatgagaagaaagataatggggctgaattatttgcaagtacttctgcaacttctcaagagacaactacttctgttggtgttaatccacaaacttatcctccaccttcctcttctcagtttgggtcacctttgttttggattggagttggtgttggcatctctgccattttctcctttgtttcttcatggacgcagaaaaaagcaatgcaagtagctgtcaagactatgatgaatcagatgggctcaaaagacaatcaatttagtaatgcggctttttctactggctcacctttcccattcccacctccacctacagcaggctctagtacttctggtttttcttaccaacgaccatctacaatagatctgaatgcctcttctgcacccagc

SEQ ID NO: 884 - DNA, 217 bp, Commelina diffusa
aacagtttgaacaaataggactaactccagaagaagttatatcaaagataatggcaaatcctgatgttgctatggcatttcaaaatcctaaagtgcaagctgccatattggattgctcgcagaatccacttagcattgcaaaatatcagaacgacaaggaggttatggatgtattcaccaagatatctgaactcttcccaggggtaacaggttaccc

SEQ ID NO: 885 - DNA, 1433 bp, Conyza canadensis
caagattccaaaatccagaacaaaatctctagtttcagtctctgctttgggctcaaattcatcaaatagcaaattaaatgaagtagagaggccagggaaagattgctttgctagaatttcatcttcaagcactcaacatacaacatcggttggtgccaccccaccaattacagcacccccaccttctcaagtaggttctcctctattttgggtgggagttggtgttgcattctcggctgttttttcatggacggcttcatacttaaagaaatatgctatgcaacaagcctttaagaccatgatgggacagatggacacacaaaataaccaattcgctaatgccggcttttcaccgggatcaccctttccgtttccaacacctgcagcatcgggctcatcaggtgggtcaccttttcctttcccaacatctgctgcaccaggctcatcaggtggatcaccctttcctttttcaacacccccacaaacaagctcagcttccacaacaggacctgcttctggacgaacagtgactttggatgtaaatcctaccaaaacagatcctgcacctgcacctgcacccgcacccacccctacaagttccaaagatgactttgagttaccagaggagccaaaaaagtctgctttcgttgacgtgtctcctgatgaaacattgaaaaccagttttgaaaagattgaagaatctactgataccaattccccaaaagaatcccaatttacggatcaagcttcccaaaatggagcttctttcaagccgatggataatccatttgagggggcttcatcttccacaggcacaaaaggccccgtcatgtcagtggaggcattggagaaaatgatggaggacccaactgtacagaagatggtctatccctatcttccggaagagatgaggaatcccacctcttttaaatggatgctccaaaacccacaataccgtcaacaattgcaagatatgttgaatagcatggggggaagccctgaatgggacaaccgtatgatggattcgttgaagaattttgatattagcagtccagaggtcaagcaacagtttgatcaaatcggacttacccctgaagaagttatatctaaaattatggccaatcctgatgttgccatggcctttcagaatccgagagttcaagctgccatcatggattgttctcaaaaccccatgagcatcatgaagtaccaaaacgacaaggaggttatggatgtgttcaataagatatcggaactctttccgggggtaacaggtgcaccctgatcatgtttatgtttcaggttctttcttcaaaaatgagtttacttttcttcctttcgcaacggaatgagtttagagctgcagaagtaaatcatctgtcgcagcccgttagacatagttcagtcacatgagtttggcccctgggtgcaac

SEQ ID NO: 886 - DNA, 20534 bp, Conyza canadensis
  unsure (1)..(20534): unsure at all n locations
tttatttcaaaaaccgtacatcgaaaaagtataaaaattatatgggtgttnnnnnnnnnnnnnnnnnnnnnnnnnnnnnnnnnnnnnnnnnnnnnnnngacgaatttttaaatccaagcgcggagcccgtacggctaaggcatttggctatcacactctttgacctatcacccacattatcttatcgccgcaacgcgcggatacttgctctcgtaacatataaatataatttagtgagagtgagaaataacatgtaaaaacaaaacgtacacaacttattaatttaatacaataaactgggaaaggtaaaacattcgaagaaagaaagtgatatttgtaccaccactattaattagtgtaccacactcatgtattactgacttatatggttagctgtaaaacatatatattgtggtacattcatcaaaagcgatggtactaatatcaatactctttgaagaaaagacttatttaaaagagaatgtataaaatagaaaatgtaattcaaaatgaaaaataataaagtgtcaagcagaaagtgtatttaaggggcgtaaactataagtttataaatacttgatgatgaccgaattttagtccaagtatcgaattgtcacctgaccgatacatgatacgattccgaaaaatcggcatcgatcgattttcaaaacaccgctcacaagtatggtaccatttgcaatggtggtttgcgattttaagatgtcaatgaggttcatgtgaattgaattgaattgatttgatgggttgaaatttttgaccttaattcaagccatttttcaggtctcatatattagctcacccctatttggattgtctctaatgggccctaatcgatgtgattaatacatgaatttttattttttttttcacaagtgaacatttttgtgttaatttttatatcgataagttatctttgttatttttttaagagttttgttaataagggctgtcattattagttaatttgatggattaaaatttgtactttgtcctacgaaaattcagggggcggttattgatatataaagtactactttttatgtatgtaataagctgttaatgacattagggctgttattataattttttttttaatataaaaaacaagaagataatataaaagaacctacaaagtaaaatttgtgtcctctctagtattgatgagcttattattggcgatagaaaccaaacatttcttcacctttgtcaactatctcttcccctgtttctttcacactccaaaaaccctaaaaatatttctgtaattatattttctgtatctataataatcataataacaaaatctcagaaattccttcaagttaatggacaaattaacccttagttcttctgcatctcataaaccaattttgggttttactcaaaacccaagaattgattccataataaacccaaacaaaccctttttttgttctttcaagattccaaaatccagaacaaaatctctagtttcagtctctgctttgggctcaaattcatcaaatagcaaattaaatggtaattcttgaatttccctttttgttaatttggtgtttatttgcatgcaagtgataaagtttgcttctttaggatgttttaagtcttatttgctattttttagccatcatttcaagaattgttattaatttgggatttttattttttcaaatgtgtcaagaattgtgctttttcaactttaattgatggtttatatgaagtgttgttattagtttgaatatatacaatgtttacatcgtaattgaaaatgaggagcttttttcgagtcgagttaaatctaagaagcttggatgaaaaagaagtaaactttgatggtttttttttttttaaagaaggaattgtgttagtggatttaagaattgcgtatatccggcttaccgttttatggatatggaggtcttaatgggctagattaggattgatcaatgtagctgcttgtgctactatgctaatatttggaccgtgtcaagaatcttctgatttttacttcaaagttgatagggatttcctgtttgaaggaagggttgctaactaaatgtagcattttattgagtacatttcgaatgacgtatgttacatagttagatggttaaagttgtgcctcatccgtactacctaactgtatacggagtatagttaacttatgtcattttcacttgaaatgattttacctgtgtatagaagtagagaggccagggaaagattgctttgctagaatttcatcttcaagcactcaacatacaacatcggttggtgccaccccaccaattacagcacccccaccttctcaagtgtaactatgcatcatcctctcttgttcttttcattctattttataggattcaagcttgacttatcgactttgattgtgtttgcagaggttctcctctattttgggtgggagttggtgttgcattctcggctgttttttcatgggtgagttttctgatacattgctttcactttcttcaagaatagatttggttctaattattagaggtgtcaattatgacccgactacctatgaacgggttgattcaggttatgtatcatatgtaagggttaaacaggtaaactaaaagaagttctctgaaaaggaaaggtgaaactcgccaaagtgcattttttaattcataaaacctatggagtcattatgttcacaaatttagattttggtgaaagtaatttaattatcaaatcatatttgaggtaagtttaaaccatttggaacaaaaatattttccggggtcaatgacctgttttgacccgaaccagacgccatttgttttgacttgttaatcaacctgccccctctgagacaataacttattagagttgcttcttctgcttctatgctaattttttctttttaattgacagacggcttcatacttaaaggtaaaatttatcaaacagagctttgtaatgatttgtgagcaaactactaatgctttaggcattggaaggtattttcttatatttgcaagtgttgcatgatggtgaatagtggtcacagttgagtaaactaaaatgttgtaggaatgactcctgtcattttcaagtaatttcaggttcacttatggattttccttttgtatttttgtttaattgatgaccatgaaattttgaagtaattatatgctcaagttttgtgtgtatagttgcatgtgttatgcataaaagtggaaaaaaggcgggttcgatcgtcttcagcaatgggtcaaaatatttaaatggtcatttaaaaaaggtgtcaaactaaaatcagttacatatatcgaaacctatgtaagcaaacatcaaacctaataatggtgagatacaaattgaattgtaacttatacatatgacacctatatgaacatgtgtgaaacccaatgaccaagaagtatatgtaatctcaagctttagttcgaatttgcatttagcaaaatttatacacaccctgaaaatttgtaatggtgaaaatttaacaacgctgccgatggtgtgatttttagtcgctggaaccttaaacagaaaaggatctgtcgtgcagctagaaagttaactatatttttaagtgagggaaagaggtacggaattgatgtgtcactttcgtttagggagctgggggtgaacttgacccgccgccttgcttctaccggctcccaggatgaccaattctaagaaatttttcgtttttttcatcaaagcccactggacctccttctgaaatattgcctagggtccaagttagtgcacgatgttatgatacatgtgcaaatcagcctagttttgtgtttttgggttcagtttgccggctctatatatcaaaatatgcatatagttttagaaccaggccctttgccctagttatctattgtggcttgactaatgcatttactggaaatgataatggtcaccggtatttttgggtttataaagtattctcacttgacctgatgaaggcgtgaagtattttaataggaaggggtattataataacttgtatatatgtgaaaatgggttgacttgtgctttaggatatttacccatgggtcaaaaagttcaaaaacatgacaaagacgagagtgggaacaaatagtggatcatcattgaaatgctagtttatatatatatatatctttcatctctctagttatttgtcattatgtaaagttcacgagcagttacctaccacctattttactgcctagagttatgaatattatccaagctccttacaaatgcatggtggtgggctacatattagtaccatttacttaattgaatcggcaattatgttcgctggcaactttgccataggtttttattgatgtaaaatggccgtccttgagaatttgagttggatacaggattgtaaaaaactatactgcattatatgcttctaatctgcttacaaggaaaactattcataaaggaaactttaggtgtgataagatggttatttgaacccttaaaaatttgattggaagtgatctttgttttttactgaatcctgaaataagccatggtgcaaggcaaatggggcagaaagtatccttttgacgaaccaaaaaatgaaataagcaaatttccaagtattaacaaagagatgggagtgatttactgaattatgtaactgtctatttttagtgacattaagacaagacttaatctataacagtttctttagctaaacatgatgtttgtgatgcttagtttcagtgtgtcactcatatatgctagagaatgtagtgttcctcattcttaaagttttaaaaacaattatacaataaaataatgactagtagatctcagtttataattttttttgtggtacgaacacaaatgaagattggagattaggcaataattgtaaatgtttttttctgcagcttgttttacatctgtgtatagattctgccgagttatcttatatgagaatttacttgtgttgttttgagtgcagtttgtaagtatctcttatgtttttcttaatgtttgtaatttcagaaatatgctatgcaacaagcctttaagaccatgatgggacagatggacacacaaaataaccaattcgctaatgccggcttttcaccgggatcaccctttccgtttccaacacctgcagcatcgggctcatcaggtgggtcaccttttcctttcccaacatctgctgcaccaggctcatcaggtggatcaccctttcctttttcaacacccccacaaacaagctcagcttccacaacaggacctgcttctggacgaacagtgactttggatgtaaatcctaccaaaacagatcctgcacctgcacctgcacccgcacccacccctacaagttccaaagatgactttgagttaccagaggagccaaaaaagtctggtatgtagcgacttgatgacaaagttgcaccttttttaagtttttttgaagttatatgttttgtaatatctggttattatgtattctcataccctttaatagttcatatccatatattactaatataagaagatacatctacaaaatcagaattagataacaagatgattaaacttgagataatcaagtaaagatacatctacaaatctcgttattttgaagcaaaatcaattttctgtttaacaccaaatgattaatttgactccaggtctcaattatttagatgttttgttcaatttaattttcgccaaaatggctaatctattttttgcagctttcgttgacgtgtctcctgatgaaacattgaaaaccagttttgaaaagattgaagaatctactgataccaattccccaaaagaatcccaatttacggatcaagtaagaatttgacagtgaactatgctacaggtttatatctgaatatgttttaaggattgactttatcttttatgtataacacgaaggcttcccaaaatggagcttctttcaagccgatggataatccatttgagggggcttcatcttccacaggtaatgtaaagctttgctgccttggtatatattctttaaatataatgaagcaaaatgcttttctagcttctaattaagaggctaatattgtaatatacgaataggcacaaaaggccccgtcatgtcagtggaggcattggagaaaatgatggaggacccaactgtacagaagatggtctatccgtaagttatcttctctactcttttattgaagcatctagttgtgtaatataacgtgctgtagtgcttggatgtgcttgttaggtagttaggtgggtattcacaaattcaattatgaaatgacatggaatgatggaataatcataattgattttaactctaataaaacatgctgtagaatgtattgttcagatgtgctaataattactttttatgaattatgattttcatggatgttttcatgggtagtttgaaagtgattatatggtttttaatcatcaaagttggataattgattgtattaaaaaaacttactgcacatggtaatagataaattgacagaatttgattacttaaggaagtaatagttcctggtatataactgattacactcttacatttgatcatggttgtaaaactcggccaagttggccgatattcggcgattactcttaccttggaggtcggctgaggcgagttaggcaaaatccgagtagatcagtcaacgggttaaaatttgtgaaagttgctatatctcttaattattagacaaagtactactatgagaacttatttgtagagattttaactattttttaaaaaaatttcagaatgttttttattttgatacatataattttcagttatactatttttatatagaaaataccaatctgagtacccctcaagtcactgtgtactcttacccttatccgttatggtgccactagtaacaatcaaatctaaatctaaatcttagatatagtacagatctagattagtcaaacaatataaccagtctatatattcctaatttcttataagatttacttttgtttttgctagctatcttccggaagagatgaggaatcccacctcttttaaatgtgagtatctttcagtattcaattaaggtttgaaagacgttgccttagtaatttactccttacataaaacagggatgctccaaaacccacaataccgtcaacaattgcaagatatgttgtaagtttctatttgactgtttttccatcttaacatagtaacattagtttgtgatgttatatataattatacgtttatgccttaatattcaggaatagcatggggggaagccctgaatgggacaaccgtatgatggattcgttgaagaattttgatattagcagtccagaggtcaagcaacagtttggtaatttcttatcaaaatagattgttgatgacagctctctctaaccatatttaaatattgataatctgatacgaacccatcccataataggctcgcatcaagccataagctaggtgtagaactcactcccaaatgctagctcaaaggaggaggggacacctaggattataagccaccaaccaatccctggccaatgtgggatcgtaacaataccccaccctttgaagagtcaacgtcctcgttggtcatggttggcacccttcttttgggtccaagctaccactccataggctaccactctgagtgttggaacttcgaaaggtagggctggctctgataccaaatgatatgaacccatctcataataggcttgcatcaagcctattagctagatatagaactcatgctcaaaagctagcgcaaagaaggggacacctaggcttataaaccaccaaccannnncatacttggccgatgtgggatcgtaacataatcaaactaaactggctcgcacgttatagaaaccaacatttgttatatgtcaaggtggcaagatgaccaggctgggtaactggtcaaaatgggtttggccatccgcaaacagtattccttttccatcttattgaattttgtaagttttcagtgagttaaatatgatatgaaacttgtataattacaattgtaggtcgaacgttttttaatagtgtggtattttaatggaaagggataaacttggatgactttcaacccgttttcctagtgtggcccaaatcaacggataaattggtaaataattcaagtttgccatatctgttgacatggatggggctggggttggataaagttaagaatatcttgtcaagttattcgcaagccacgtcgagatcaaattaaacaacctcctgatatttttgtgcaagcgacatatacagatacatgttctgcttcaatttatattactcatgtgtacagagttggatattagtctaatatgttttttacttattgtacctttcttgttcctgttgtagatcaaatcggacttacccctgaagaagttatatctaaaattatggccaatcctgatgttgccatggcctttcagaatccgagagttcaagctgccatcatggatgtatgtctacatcttgatacacttttatttagatctctttatcacacattaaaaagcacacatgcactctggctgcttattaatttctatggtaacattaatgtttttgcagtgttctcaaaaccccatgagcatcatgaagtaccaaaacgacaaggaggtaagaccacagattctatgaaatgtctcttctagtctacgttgtgcagttatgcttgttgcatactagaaaagacagattttactaaaataatacacactaaagtaaaccaggttatacatagacttcatctatatctatacttctatactccttattaaagattattgggtggtgttgaaaagtttataaatttgggacatgcgaatttacttatttgcccttacacatataattattgtataccactatctccatcttagacatttatctcttttacacataccaaaagcttagacttttgagacactaatcacgacatgaaatgcccctatcaatggtatctgccgcaacacgcgggtaccatgctcgtattagaattttgcgagtaattgtctgatattagaatcagagttagatgaacaggtattcaggtgcagtgaaacaggttctagaaggtagtgtttggatttgctagtatgtatggaagttctaataataggttacgtagacgtttaattattcggtaaatagtgatgagctaaagaattactctaatatacaaaaggaacaataagaacatttcgtgtgaaagatggcttgatgatattaaagtaacatattttttccccaaaagatattatggtaacattattatattaggttataataagtttaattactgatagatttttcacttctctgttataggtgatacatagtggttatccaaaatcaactatattggtcaatgaccattttgtgattaaaagaaacaatatgtaattgaccaagcatatgtattccgtgaatagatgagtccgtcactcagtcttgcgaattgagagtaaaagactgttgagtgttgagtcgtgttaaaaatataaataggtagtttggtttaactttagacaattagctttctgtgatatcatgaaaagatatacaaagctgattgtttaggtaattatcggtataattcaaaacagaatttatcccatcattatagactgatttgtcaaatgacctatttgacaaatgtaatacggagtatattgtttattccttttgaccactttttgcaagtttagtacaaaatgatcatcaactttgtgacaatccatcgtgttatgcactttatgttgtgaaaatccaacatcggctaaaaagtagctacagtgagttaatgaccactaaaagctcaacataccagatctgcatttttttttgtgccaaaccaagtcctggaaacaccaatgaactttaacctaccaaggaattccaatcaagccacaaaatgccctacaggtaacgctactgctgctagccgtttggaattctgtggtaggtttaatgatgttgactgtgtcacagtgagatttagttcgtactgaaaaatatagatttgaattttgggattatgggaaaataaaatgaattctgtataagggtaaaatgttgtgctgctgactctaaatttatgctcactttgtggaagaacctaaaagaaggcggccaaaattgtaatgcacatcagtcaagaagttgaaaatgaaaaatctacatattctgtacttataagttcttgctcatttgcgtcttgtcatgagcatgtcttttgaataatggtctacactctgtttctttccttgtttcaggttatggatgtgttcaataagatatcggaactctttccgggggtaacaggtgcaccctgatcatgtttatgtttcaggttctttcttcaaaaatgagtttacttttcttcctttcgcaacggaatgagtttagagctgcagaagtaaatcatctgtcgcagcccgttagacatagttcagtcacatgagtttggcccctgggtgcaactgttaggaaacaaccattgtccagccttattaaattttgtgtattatttataagcgatcgttgtttagtacttaacagttaacactaaattttttgtgttcaaacatattagatgacactggatattcgaaaattagtggtctggtttgaaacaaaacctaaatagtttcctatatttgtagcttcctatacatttttacgagaccaaatatttaatatgacactgatcatatcattcatttattctgggtatatataaagataatcagctatagatttaagatgctattggctcataaagttgtaaatattgttagtttatataatgtcactgtcatgaaataatatggttgctacgcatatacctgaaaacatattatagtaatttttgaaacctgaatatacaataaatttagattatcattttgtaagtttttacacacttaatcctttaaaatattcttagtacgtttaatgcattcaccacgtattttggttctgatacaagaagttacaaaacatagtataaagttgaatgcatttaaaacatagtatatctcttgagtcttaaataacatggcattacgtgttatatacagactaacaaattaacaagcaaatcttaaaaagttcgtttatatcataaacatatgaaaaatcacaatcttaatctaggataaagagtgttcggtggtgctattgtaaaaagactcgtgagttcaaaaatcaataaaacataaaattaggtgcaaatttgaatggaatgactaaagttttattacgtagttaactaatatttctttaaccctgaaaaggtcagtattgttatatttggtatgttgggtgtttagctggtctacttttgatttattaaagcttaaaaaatgctactaagataatttctttctagcttatcaacttgaatcttagggtccatataattagctcaaatgtaaaagtttataaaccgatagaaatgtgcttatcgttaatggggtttgttgtccattggtaagatctttgtaccttgaaattttatatgaggtttcgagtctcactattcatatatgtggggtggggtgcatggaagtattttgggatattttcggaagttctgagttatattttaggcggttttcgaaatatatatgacggtataaataatatagtttgttgtttgaaaaaaaacttggttatccattatctgaaattttaataagcaaagtatccaataagttgaaaattgaaatctttaatcctcgagatacttaaaatcaaatttcgatcactagattacggttgctttttcaccttttttgtttttctcaaatgaccaaatcaaagtcaacaagaatcaacaatctgggtgggcttggaaagggtcgtgggtcaatcattcaacttcacacgctaatctttttcctgtttttggacttatttcacccttgttttcaattttaattcaatttctctaataacacattttttctttcttttgaaacattagaaataccaaataagctaagaaaagtcacacatcagcttcacctaataacttgatgttaacttggtttagctcgagtgtctaccttcaatggtccaaatttgtgctcctgtcgattccacgaagttgccaagacggcgttataatatgctacgatttcttcactatcaagcaaacgtatttttttttttgtcttgaacgacacaagttagttgttagtagttagttttatcaaggtgaataattaaacatcaataatgtttagatttaaacccgagacctccagattggcaacatattactctcaaattctaatgttttgcttcctttttcttttacttaataaagacagaatattttagcgaaagattatgtaatgacgttatctaatgattgagatttgagatgtactattgggaactagcttagcttttattgatgttaagtgaagataaaaccttacctaatgtgttgtatatcaaaatgacatcataacaaacccaactcaactcaattattcaatgtgcgaaaaatcaatccgaacctgttttattgcttgttaggctagacaatatgtatataaatatattttatagttgccatattaaatgatacttttaaaggaaaaaaaaaaatcatacgaccattagaccatatcgtcattattttcctatactttcatatcttaatctataaagaaatgagcagactcaaaacaaaatttttttaatcattctaggattgtttatactagtttttagcatttgcatgaaaacaagatgattattatatctggatttgatacgatacgtattatatttgatttcatgacagacccgtttgaattatttaatagttaaacagattgacatgttaatatgttatcgagctaattcgaatcaaataaattaatttcagggcaaataatggcatcgtgcatcattaaataaaattttatcaagcattataccgttttgagactttaaaaccatatacccaattgaaaataataataaaaaaatgtggtacaaattaaaatgcaaatatcatgttattatataaacttgatcatttgtttagtattagacgatctatgacttttcaaacgaatagttatattcagaaatatataattaatacttttctaaactactatcaaattgatcatcaaagtaaccataggcaatatagaatgcattaaaccttaaagttctactatttcatgttaaactcatgataataatcttcaaagacaaaactattatattatttgttaagcatgatcttaataatccaatcttgttagaatccattattagcaatgaagcctaaaccaacatataaaattaagagacgtaagatcgatctttaggaatgtccaaatcatgtgaaaattaaataaaagtatttcactaacatcttaaaatcatatggcggggtcgatgactatccaatgtgataccagaactagagtattaccgattaattttttttttattttttctgaattaatgtagtaccaaacaaactttcttccatacttagaaacggtcatttactcgttctcactctttcttgctttctttgtttgcccccttccacactcccgaccaaaccgcgtttacatatacacaaacacatatacttacaaaaacacacatatgaaacactaacaccaaattcacatagagccatgaaaccacctttttcatggctacttctaaatttctctactctctaactctcttcattttgcttatcaatattccaacttcaatctccacacttccaactgtatctatatcatatatcaatccaaaccaaactctaatttgtgcaataaccaagtcaccaacaactcaacaaccatccaacctcaattgcaccggatatccgtcccctttcaacgtaggaacaataccacgttattcctacgttggaatcgtgggcggaaatcgtttcctatgtgcattaacttcaacttctgtttcttcattgtcaattttagtttgttggcggttttttgaagatggaagtacggttttcaaaagaatttaccgtggcccgtctcttaaagacattgattctagcgattcccatgtttgtggaattgttagcacaactaatgaattgttttgttggcaatgggatcaatttaatgataatttaggacttaatcaaacccgtttttattctagtgttgctgttggagagaattatgtttgtggactatttgaaatcgggaatattagttgcaaacaaggcaacattaataagagtaacagtattagtaatagtaatagtaatattattacagatgtcccacgtggaaactacagtgtggtttccacggggtataatcgtgtttgtgcaataaattcgagtcgtggtttggattgttggggtgaggcaatgattgggaggaagccgaatggtgagtttaaagcgatttcaattggggaaaatcggttttgtgcggtaagaaataatggaacagtaatttgttggggtgaaaatgattttagtttaccagagaatctaagagaggtttcttttgaaggattgaaggcgaaacgaggtgttttttgtggtctttcaaccgcgaattattcattatattgttgggggaatgagtctttgaataataattcgaatgcaattgtttttggtaatgtggtgcctggtttgtgtacaaatctaaccacatgtgattgtggtccaattccgaattatgcaacgttttgtagtcaagggttgattatttgtaggatttgtgagcctgatcgaggtttaatacccgaattagtacccccgcccgacgggtcaaaaaatggtggtttggatggtaaaatggttgcttttgtcgtagtgggatcagtcgggtcgttattgtttattctcgttcttgtgtttttggtttttcgatattgtagatcgagtgaaggtagtcgggttcatgattccgggccaatggaagaaattcgagtggattcacaagttcaaaatccgaataatcgtgtcttagtgaagaaattgagtcatttgattagtatgggaaatgggggtcatttggaagagttttctttacaaaggattattgatgcaaccgataatttctccgaggaacaccgaattggggtgggaagttttgggtcggtgtatcgtggttcgttaaccgatggtcgaaaagtggctattaaacgagctgagttaacaagttcctcgtcgtatacgggtggttttaagaaacaccaagaagacacgaacaatgcgtttgtgaacgagctcgagtttctatcgcgggttaatcacaaaaacttggttcagttgctcggtttttgtgaagaaaacaatgaacttgttcttgtgtacgagtttatggaaaatggtagccttcatgaacatttacacaaaacatttggttcacatataatgtcgtggcccgcccggatcaaagtggcactagacgcggctagagggatcgagtaccttcacgtctacgcccaaccacctatcatacatcgtgacatcaagtcgtcgaacattttgcttgatgaggagtggaatggaaaagtatcagattttgggctatcgttattgggcccgccggataatgtgtcacacctctcattacgtgccgcgggcacggttggttatatggatcctgagtactttaaatttgagcagttaacagccaaaagtgatgtttatagttttggcattgttttacttgaacttttatctggtcaccgcgccattcaaaagaacgaggcaggagaaagaaggaatgtcgtcgattcagtagtaccatacattgtgcgcgatgagatacaccgaattttggatcataaagtccctcccccgacaccatatgaaatagaagccgtgaaatatgttggatacgtagccgtcgattgtgtgacattggaaggcagagaccggccgacgatgagtgaactcgtcgcctgcttggagagagcattgtccgcttgcttgacaatcccttgtttatctcctggtagctcgaatgactcatccaatgacattagtcacgtttctttgtaaagattaggacttaggagtttaaatctttgttacatgtacatttggtattcataaattgttgataaatttgttgtacatgttcatattttttattagttcatattaatgataaaattattttgatgggttatatttagccctttgccttttatttgatgcattgttcttacactgagatcctaaaactgccactactatttgatgagtgtgaactgtgatgtcttatttgaagaaagaagaaaaacagatactcttatgaaacttgaagtcaaatgtggcgttataaagcacgatctacacaaaaagagaaataacacaaatattgccccacaggagcccaaatataaccaagttgtattccatttctattatatgtttaagtttcatagcttgtgataatatatggtatggtatgttatctttaatttaatatattgtatatattcttgatatagtatttggttctacattaatcacatatacaatacgattgcgttaaggaccatctacaaaacttgtctattgtatgatacaggaccacgcggagaaatgtgacaacactagacatggcttgagagcttaagtaacttcattctattcgagaccaataatcatacaccatgacatcgaataacacattcgtcgaagttaaatggacacctatacgagttatctggctttcgtctatcactattcactagtacggtgtaggccccaccaggcgacgagttacacctcttgttacgcgttggggccttgtgggcaccggtacaaatttcagcagtcacgataacaactcttcatatatggggttaagacatctatgaatttacgatcatcttagtaaataaacaaagaatttcaaataaggcttaattgtgttgatttataatttgaagggtaaaattgtaaactttttaaaaccattttgagatagttgcaaagatgtatgatattgtggttaacagcaccgatgttaaccctttcattgaatgcataaaataatgtttaaactgctgttagtccttataattttgaaaagtttaaaaactacacaaagaagattgatttatgatttaaagtcaaatttggggtttggtggataataataaatatatcaaaacgcacgtttattaaatcaaaatgtccaaaatagttgtatatcacatatgatccaaagaacaatttataagctccgtaaaatcaagtaatttcttaatatgaatatagtttacatcgaaaatcatataatatctatattaagtatcgtggaaccttaaacttcacccaaaaggtaaaagtctccgttaagtggtctaacctcgcattgatatattttcttaaagtaatatacgttggtcatttgatgtagcacaatgacttcaaatataaatgtacatggtcctcttttctagaagtttctacataaatagtttatgtcgaaatgcatgcaaaattgataatcattctggtgtagattcaatcaagtcggtgcaatatgcatcaaagtcaaaaatgttaacaatggttctttaaaaatcgagcatagaagtcaagaaaaagtagaaagtcaaacaatatgacatcagcaatggaattgtgacacttaaccttctattttagcgcgatttattttaaataacaacacgagttgattgactttttcacatcacataacctcaatattaaagtttgtttaaccactcaaacattacttgtcttatttagagaagacaaatgatacctagttctaaaataagcatttaaggaagggaaatgatcgatctttttaaataaatgtcttaaaaatcatcttaaccataaaacaatgacaatcggtaaaatcaaagaataaaattaagaatcgctaaaggtgaagtctcaagctataagatgattgacttgtattagcccatgtatacaatagactaaccaaatcaaaattcttaggaacagggccgttctaaaggatactaaaatgtatactaaccgagaccaaaatcattttaactagaacttcttatgatccatttccatagtctgatagttgttatgacaatcccatttagtaaatacattttatgttgaaaagtttttcgattgaaaataacacatcttattgcagttatcaacacatcttattgcagttatcaagcaaaaatagcatatatactacccagaaatccagaagtacggtgtagtttaatcatcacttagcatttaaaaatgttggagctcaaaacaaagcattaaagaaactttaaggctgctcacaaaatatctaaaccgatgctgtccaaattttgatgcaccattttacaatcccagatagcaataacccatgtctagaaggatgacagaaagaaattcaccacataacattaaatattatcctaatatagtaaggctttccaaagaaagcaatctggtagaatctattggcgcgcctcaattttcttcttttgccaaagcctatcgagtgcactgtcggcatcaccctacacaaaggttcgcacaaactaaaatcagtaccgatctcaacaagtgaagtagatactaaccagcaaaggtgacaaagctaaccaatttaataaaaagtgtcagacatgaactgtgttaaacaggttagcagtcatctacaatttactcctacgactaaagttgtaatattattgtattttgaaatgtattcaaggccaaaagttttttacacaaagtaaatagacaacacagataacattaaaaagtcgacaaacaaaaaatacatataacacaaaccgtttcaaaccaaaccccttgaacaacctaaacaacccaacatcttgttacgcataccaagtaacatatctgatcaactctacactctattaattatcaaaaataaaatcgatgccgatctctaatctcattgtatgtaaagataataacaaatgaagtagatactaactggcagaagagtgaaaactaaccaatttactaaaaagtgtcgacttaacagtcatctataatttactctttacgagttagcttcttaatcaatttaaaatttaaaaaatgaacttaaatggtaaacgtgtcgcattttgaaacatattaaggcatagcccctttaaagggagtaaataaacgacacagataacattaaaaagtcaacaaacaaaaaacacatataacacaaaccgtttcaaacaaaaccccttgggcaacctaaaaaacccaacatcttgttacctatactaagtagcatatctgatcaactctacaccatccaaaacaagagaaatgactactattggacgagttttgttaagaaaaaagacgataatactaacctgagctctcacaaaaccacatagagcaaaagtagagaactgcccagtgtatcgcccagattcatccaaatgaccaacattaatttgaaccgaagcatgatctttggaggtgatcaaccggttagtggcagagctgcagaaaaagacagcaatactttatcaacacaactactttttacacgggggcgttcggcctagctttttaacttttgcaaatgcttgtaaaagaaaagcaacttattgcttaaaggggagtattacataaacttataaaacttgtatggataagcttatcttgtatttatgaagctttttaagaaaatcccttcaatattgcaatataagataataaagcatcataaaaattgcttatcaatagtagcgtatataagcttaaaagttcacccaaacacctaaattagcttattcaatataaaataagctataaagctataagcaactttaaaaaaaataacacaaacagcccaaatgtaaactacagatgattaacaacataccactttctggggatatacaagtccatattttgtccttcctcattctgcatgtttgcggatttttcgaataacaaatactgtaaaacaaataaaaaacaaataaaaaagttatataatggcaaatatgcaaatatatgatcagccaaaacatagtatcaatcaagtattttataaacttaaatggattaaaaaaaaaaacaaaaccatcacatatacatagatttaaatatggtttatttatttgtgtaaaaaaaagggggtgtttaaagaacagaaaacaaaccaagaaaatgttttagaatggatgagaatggtcgtgcgttctgcaatgaggaggcgtgtggaatgcaatagagagagatacaccgtaaaccctaaaaagtaaaacctttccctttgggcttaggatgttgtattgcttgacatatgggcctatatgattttttttaattgggccttcgctatatctataacatcttataaaacattttaccttcttttaaaatctcaaaagataatttgaactacttaaattactctccttttttattaactaatttaaacatatctacctaatatat

SEQ ID NO: 887 - DNA, 4784 bp, Cyperus esculentus
agctccaagtagtgctacctgtttgagtgctggtcttacatatattttttgggggctttctgtacatattgtccattgagaatggaattggggaataaaacacaatcgtggtagtccaatttggcaattttatgtggaccttaacctagtgtttcttttgatcctgggtacaaagctgacttgtcatgaaatttaatcactgtttagggtaaaattcagctaaattgtatcataattatggtaattggacaagggaaacatcttgcgtccatagagtggaaaatccatagacacattctgtgagtgatagtcacacactctgtcaatgatggtgtcacacccgggatccactttggtcccacttgtcagtggtattgtgacagcctatggacgtccactctatggacggtaggtcgagcccattggacaaaggaggaaaaggtagcaccaaatctgattatacataagaatagcttatgacagggatttggtcctagaatgacataaagttattgctttcactctgatgctgattaggtactgagtaatgtaagccttaaattctattgcagagaatcttaactctctctttttttttccaggtgacaaagaagaaagacttgagcgagttctactttagcctcaacaaaaacatagctctaggaggtgaaactgcgggctcatcaaaatcagacaaacagaaggccacacaggttaattcgcaagacgctgtaagtagacccgtcataaaggacaaccaacagaaagagtccactactttgttggatgaaaaaagctctagtaagtcggagacaaatacagaaggagaaaaagttcatccagttgatgaacaaaaagctcctatagtggaaggagaggcctcagcaaaggagaagcctaaggcagtccaaggggaagatccgaagttgaatcctgagagattcaagagaagcggagatgacatagcttctcttagggaaaagttcttggcacgtaagagagctaaagagcagttataagttgtatgtttcttgtggagtttgaatggatgagtttggaatagtggttttgtgtgattagttgtaaaaacatgatgattatgtattgaacagagtatggatgagacatttagaaagtttataaatacttgtgtccttggtgtgaattattgttttatttattgaaccatatggtggactgaacagtggctgatgcaatgaagcaacaaagttaccactagcagtgttgaaataaataagttgagagagaagaatacatgtaggaccaggagagagtggtcttatagctctgaataagctcacccttgagcggcccaataaatagaaatagaaaaggcaaaggaaacagaaagagtaaaagaatgggccttattgggcctaaagtatagaatgagaatgagaataggagcattgtttgtttgttttgtttgtttgtttcgtacgctctccagcgataacatcatcgtcatcgtctcattgttccttcctttccctgctctccccaaccccgaccccaaccccaaccccaaccggatccactcggactcagtgcttctacctagggttttaagatggagaagctccttctcacgtcctcctccgtcgccctcaaccccatctctccgcgctcaggccctccccacttccacttcttcccaaggaagttctccgtctccgccctcaattcccactctcaaccgcctacgcctacccttttctctattcataataatggtatctatctataccactttctctcttcttcttcccctcttcctcttctggtgataccataccatctacccacatctgcatcttcttatcagcttttctactttcaacaaccttttcccttttctatattaattatctacacatttattctttatcctttagctccatccacaattgattctttcttttaacttttcaatagtgcttcggagttttaaatttcaaggatttgcatctgtatcttcttctgctagtaataagagcaatctaactggaactgttgctactcctccagtacctccatcctcttcttacatgtaactgcatctctactcaatttactttactttcaaactaacatttccaatatctctacattatatacggggatggatagccatattgtactactacctccactgctgttccaaacaaaaatacagataattgtgatggccatggtgattattttaaaaaagtatggactagattttaaacttggaaacacaaagatatgtgttaatttatattggttcttgtttacctgcttcattttttttccagaggaacccctcttttctgggttggaattggagtggcattatcagcacttttctcactggtgagataatcatgtaatttaagttctatttatttatttatttatttttctgatctacttctgatgttttcttcctttaatgttaggttgtgtcaaagttaaaggtgagctcatatcctaatattctgaggtattcaagctgtggtataaaaaaaaatgtggtatttgctttttaataggtaggtaccttaatgacagtcatatagacgtcaggtttccatatatgattacatacatgctggtgtgacggttggctggttgctgtactgcagttgctggtgcagtgctttgattcaagtgtcgaatgtcctcatatgagcaatgaagtctgaattcaacccattcttcataggaacactagttaatacatgttcaccacttaatactgttctgcaatatacaatgaataatctggagataatgtgtgaaataatggaatagcgctaaggcaaaacagatagctatgtagcaataagcataatgctgatcagcaccttctctgagaaccatgcctgatattcaatgtttccttttttcttgcttgctcatctaatatatattgtttccgtgccaaaaatctttgttgtagcaatatgcaatgcaacaagcacttaaaacaatgatgaaccaggcagggtctccacaagggagtagtccattcacaaatcccgcatttccaggtgggacccccttcccgtttcctccaatgccaccacaaggcacaccaagcccattcaactttccacctccagcagcagtccaggaaagaacagctgttaccgttgatgtttctgaaacaaaagcagaagcacctccaagcttcaaaagttcagatgggaagacagaagaaaccaaccagaagaaatatggtaggcattgttagttttgctatgtagttgtgataattaaatttgtagggaaaattggatggcaagcagtgtatcacatattttcagcatctttaggttgcatggcttccatctaacatatatcttatactggattatatctttgagttaattcttgatacctttttctgaaaaatgtagcttttgttgatgtttctcccgaggagaaagaagttgtaaacccgcctgaaccagagatggctgcaaatcggacattggaaccagagattgtagtaaatatttctaaaactatgcctcttcttgttgaatattaatatcaaacttctgaacatatttttgatggcatgtgcatgatttattatgaaggattcaacaaatggagctgcttttagaactagcagcagtggttctagccaacaatctgaatcacaatatcagtcacagccacgacctagtaagtaaatagcttttgttcttgattttatttttgtttgctattttttattgagaggtacacacgactcaaacatcaacttgttaaaaagaaaaaaaaaaaaccagaataatatcctagtttaataaaataaaggttatgtgattgttccattgcaattcgataccatccgaaaactagattttggatgtctacctggacatttcctagcggtctctgaaattcatctatgttcatttgtgtaatgagctccaatacttgtaataggtgatttcttcacagtggatacattggaaaagatgatggaagatcctacagtccaacaaatggtttacccgtaagtattttttattctcactttctatttgacatgcatgacactatttttttccttcttccttgtgcctccttatcaatgatgaactgatggtggcacaaattttgcaggtacttaccagaggaactgaggaatccggaaacctttaaatgtttgttcttgaatcctagaatcaattttgtgatatttatattaagtttgctaaaatgattgtaaggatttatccaataatgatcattttttttcttcagggatgctaaaaaatcctcaataccgccagcagttgcaagacatgctgtaaatttttaacattctgcttttcacattctaattttaatcctttggcaacagattatacttaccaatgaagttgttttttaatatttatgaaaaacagaaataacatgggagggaactcagagtgggacaggcaaatgatggaatccctgaagaactttgatatgaacagccctcaaatcaaggaacaatttggtcagtcaataattctgctctgaagtatatccttagtacacaaattaatattagatactaattatttattatgatttgcagaccaattgggggtggagccagaagaggtcatgaagaaaataatggcaaatcctgatgtggcaatggcattccagaaccctagagttcaagctgctatcatggatgtaattcttatcatttaccattttagattttttttttcttttgttattatttttcaattgcttaatttttc

SEQ ID NO: 888 - DNA, 864 bp, Echinochloa colona
aaagaggcggatgtcgctgaaacaccgaaaccttcaaagaaatttgcattcgtcgatgtttctcccgaagagttgcagcaaaagaaccttcaatcttcactggagactgtagatgtgaaacatgatagtacagacagtgaaagtaaggaggatactgagcaaaaagttcccacaaatgcagcagcttttaagccaaatgaagatgctgcgcgtgggccaactgaatctggtaactcaggaccttatctatctgttgagacaatcgagaaaatgatggaagatccagctgtgcagaagatggtgtatccctacttgcctgaagagatgaggaacccagattcgttcaagtggatgctgcagaatccaatgtaccgccaacaactacaggatatgctgaataacatgggggtgcatctcctgatcaatgggataaccgcatggtcgatcacctgaagaactttgacctgagcagtccagaagtgcggcagcagtttgcacaagttggcatgactccggaggaagtagtatcgaaaataatggcaaacccagaagtcgccgtcgcattccagaatccaaagatccagacagccatcatggattgctcccagaaccctcttaacattgtaaaataccaaaatgacaaagaggtcatggatgttttcatgaagatatcgcaaatcttccctcaaattaatggctagcggatcctcacggtggtattgcagttttgattttgaccggcccatcatctcctgcctaagcggctgtggcggcacatctgtcgagagagagggacatctgtttggtggcgatgctccagatataccctcctctccctgtgtcaatcttttgcctatgaccccc

SEQ ID NO: 889 - DNA, 1341 bp, Echinochloa crus-galli
gcttgggttactcccatttctattcgtcgagtagcaccttaatgattttaaatataattgtttattacatcagttttcgagggattgagagcaaaaggctttgcaagtgtgtcttcttcgactggcaatgagaatgtgtctactggaactggtaccctgcctcccgtgcctcccccgtcatcctacattggttcgcctgttttctggattggagttggcgtggcattgtctgtggcgtttacaacggtatcttccatgctaaagagatatgccatgcaacaagcatttaagtcaatgatgacccagtcaccatcaaactcttttggctccaactcgcctttcccatttgccatgccgccacaggcaggtcccacttcaccaagcagttatccatactcagcaccaaggaaagatacctacccacaggccgcaactgttgatgtctcggctactgaggttgaagctgctgtaacatcaaaagaggcggatgtcgctgaaacgccgaaaccttcaaagaaatttgcattcgtcgatgtttctcccgaagagttgcagcaaaagaaccttcaatcttcactggagactgtagatgtgaaacatgatagtacagacagtgaaagtaaggaggatactgagcaaaaagttcccacaaatgcagcagcttttaagccaaatgaagatgctgctgcgtgggccaactgaatctggtaactcaggaccttatctatctgttgagacaatcgagaaaatgatggaagatccagctgtgcagaagatggtgtatccctacttgcctgaagagatgaggaacccagattcgttcaagtggatgctgcagaatccaatgtaccgccaacaactacaggatatgctgaataacatggggggtcatctcctgatcaatgggataaccgcatggtcgatcacctgaagaactttgacctgagcagtccagaagtgcggcagcagtttgccaagttggcatgactccggaggaagtagtatcgaaaataatggcaaacccagaagtcgccgtcgcattccagaatccaaagatccagacagccatcatggattgctcccagaaccctcttaacattgtaaaataccaaaatgacaaagaggtcatggatgttttcatgaagatatcgcaaatcttccctcaaattaatggctagcggatcctcacggtggtattgcagttttgattttgaccggcccatcatctcctgcctaagcggctgtggcggcacatctgtcgagagagagggacatctgtttggtggcgatgctccagatataccctcctctccctgtgtcaatcttttgcctatgaccccc

SEQ ID NO: 890 - DNA, 1611 bp, Euphorbia heterophylla
ggcgttgctctcttcatcatcttcttctccgaaattggttctgggctatcctctaacttctacccctctgttatcaagaaccaaactacttcatttcccccttcgaaattccagggttattccgcgcaactctagcctatctatctcctgttttgcccattctcgctctaccaacgctactcctcgagtttcccaaaacaggaaaatgggtgctgaacttatggcgagcatttcttcatctagcggtcagcaaacgtcctcagttggggttaatccggttccagtgcctccctcttcttcacaatttggatcacctctattctgggtaggagttggtgttgctttgtctgcagttttttcatggctggccacatatttaaagaaatatgcgatgcagcaggctttcaagactatgatgaacactatgaatacacaaaataatagcaaccctgcatttccatcgggttctcccttcccatttccaacaccaccagcatcatcaggttttgctagttcatccccattttcatccacatcagcatctgggccggctacctttcctccatatacaacatcgtcacaatcaaccacgtccccttctacagcggctgctaaacctccaatcacagtagatgttcctgcttctaaagtagaaacgtctccagtcactgattccaaagataaagtggaaactccgaaggaacccaagaagtatgcttttgttgacgtttcaccagaggaaaccttcccaaagagtcctttcaccgatgaagtcatttccgaaacaagttcgcctaaaaatactcagtttgcccaagaagtttctcaaaacggaactgcctctgctcagacttcaagtgcttctgagggttctcaatcttctcgaagtggaggtccaggtttatcagtcgaagctttggagaaaatgatggaagatccaacagtgcagaagatggtttatccatatttacctgaggagatgaggaaccctactacgttcaaatggatgctacaaaatcctcaataccgacagcaattggaagacatgttaaatagtatgagtgggagcggtgaatgggacaaccgaatgatggactccttgaaaaattttgatctcagcagtcctgaagtcaaacagcaatttgatcaaataggccttacacctgaagaggtaatctcaaaaatcatggcaaatcctgatgtagccatggcctttcagaatccaagagttcagcaagcgatcatggattgttctcagaaccctcttagcattgccaagtatcagaatgacaaggaggttatggatgtcttcaacaaaatatcagaactcttccctggagtgacaggttcaccttaatctcagtatttaagctatatgaactgcacgcaagggcaactagtgtccagtgagaaatccgatttgtggagggcaaaaaataggcgataaactcctattaaactctcacatctgatgtgagaagtgttaaaagttttggatatgtttagactttttttgtttgtgcaaataggccatagtttctgtttcaattcgaatagggttttattatgtattaatgtaaaaacaagctaaaataagaaagaaacagtctt

SEQ ID NO: 891 - DNA, 4070 bp, Euphorbia heterophylla
catgtacccttctgtttgttccccttttccaatttgcaagttctttcttttttttttattagtgctctccctctctgatatcctggtatctgcctctctctctttgctgtattctatctgaactattagcattttattgtttttgcattgtttatctgaatggcaatgactgatgatccaaatacttgcgtttggtgctgatgatctgctaagtatgctttgccttgaatgacaaccattttagtaaaatggttctctgcggctgtagatttgtgtaaactaggagaatgtgtaaggcatgctttctggaagtgtctcaacttctgcaatgaaggtttaaattgtgatgatgttagatcaaaattcaactttcatttgactgctattactttttagtcctttttaattgactgctattgttttttttattggtgttatgtccgtggcaacctgagttaagtcaaaccatctatatatgacttctatgatcaaaattttggcatctgattttgtaactttgctaatatttaaaaatttcagtggagaggctttgcagtcaagaatttgtatttatatttgcaaacaatttcttgaatatgctcctttttcatatgaaggtccattagacatttagacttgttattgttggagataattctatcattggtgataaagatgaaaaactcttaagtacttatagagctgacaattttttatggttataaaattgtattttccttgaccccaaatttcaaaatttaaaactctatatattcaacaatcaactataacttggattcaaaattaaaactttatatattcagcaattaactataacttggatgcgttcagatttttcgtcctgtgtattacgtagctaaactagttgaatttgtatatattgataacttactatgattatgattattattttatcatcattatttggtattattgttactttctcatcattttttttttatattttttaattttcacagatcaaataggccttacacctgaagaggtaatctcaaaaatcatggcaaatcctgatgtagccatggcctttcagaatccaagagttcagcaagcgatcatggatgtatgtcctgactgatttataaattaagtgcgactcttatttcttaaatcttaaacacaaatatgttaatgtattgtttgttttacagtgttctcagaaccctcttagcattgccaagtatcagaatgacaaggaggtatgcccatactctacttatggtccataatagaccaagcccgagtatgaatcatgtttgatatttttagcccttttctgtatcgcccctttagattctttatttatgttatttgcgcagtttaatattctgttaagttttgcctacaccttaaacggtgtttcctttgcctctcttttgaattattttggtttgcaatgaacttttacgtctgctaggagaaaatgataagttatgtttggctttcaggttatggatgtcttcaacaaaatatcagaactcttccctggagtgacaggttcaccttaatctcagtatttaagctatatgaactgcacgcaagggcaactagtgtccagtgagaaatccgatttgtggagggcaaaaaataggcgataaactcctattaaactctcacatctgatgtgagaagtgttaaaagttttggatatgtttagactttttttgtttgtgcaaataggccatagtttctgtttcaattcgaatagggttttattatgtattaatgtaaaaacaagctaaaataagaaagaaacagtcttgatttactttgccctttaccaattctaccttagccattgttattttcacttattgaactaaacacaacaccaaggcgtataattgtttgtctagactatactatctctaatgatgctgattcttgtatagacatcaagcatggccggtctttgctcaggaatcggctgcatacatttatgtgcaattctgatgcattcaaccatctcatggttatattcttcttctttcattagctcatcgatcacatcctcttcatcgtcatagcttctacaactcgtgtttaaaatatcagccttcttcccagtaaccaactcgagaagaatgatcccaaagttgaaaacatcttctttaacaaaacattgctcccaaaattccatatccatcacgaaacccctctcgtttggatttacaagtgataccattccaaaattcgacaactttggctcaaaattcagatcaagtaaaacagacttggagcttacacttagatgagcaacacgaaaatcgcagcactgatgtagccatgccaagcctctggccaaaccgactgcaattttgatccgtattggccaagtcaaaccattcttattctctccgtccatcgaatgcaaccaatcagaaaggtttccattcgaagcataattataaacaagaagccttttcctcgattctttgcagaaaccaatgagtgggttgatgttgtcatgcctcagtattcctagtatctttaactcagttttgaactgctcttctgaattttgagaattggaaaatttcttgactgcaagagaccagccattcgcaagggttgccttataaacggtcccagttcctccaaagccaataacattttctgcaataaagttttcagttgcttgacacaaatcctcgaatgtcattctcgtaacgaagttttccgagttagtaacctgtcgacatatttttacgcatattattaataacacattggaatataaaattcaatatcatgtatagaaatggtgtcagaaatcaatggaaatctacctctttctcgataaggaagtccaatgtagacaaggtagcaaactggtcgaactctgcatatttcttgcccttgttcttcagcatgtgctgtaccattgcaccgattgtcatcatctgcttcctgttcttgatatacacccaaggcacacagtaggacacatatagcaccatagttgaaacagcgaataccgcatagcctatcaaaaacccacctttgaacgagtaatcgaatctccaacgtcgggatgttattggatcctcgtttttttcaggttcaatcggtggtttatgactaggagaccaaaattttggctctgggcctgataataaattattatctgcactaaactggttgatcctgtggagggaagcaagttctggtggaattcggccggtcagacgattgtggtccaacttaagaaagtttagataagagcaattaccaagggttgacgggatttcaccggagaaattgttggaggaaagatccaaggctgtaataaaaggtaacattttgtcaatatcaaacggaataggtccccgaagctgattatttgaaaggtccaaccctgttaagcttgtgcacatttgaatcccctcgggaaattcgcccttaagccccatgtctgagagtctgagattgaggacattattttcattagggtgccagcaatcaactccctcgaatcgacagatgaagccctctgtgtaatttgtgaagacccatgacgtcaaataaccgaaagggtcttgtagtgaagctttgattgattttaagcaagctatatctgtttcggtgctgatggttgctgtaatagcagccatcaagcataccgcataaagggcattggctgatcttggtttcattggcttatgaatatttgatgattccagtttcaaacgtttgaaaatgtagatagaataatatttcactcaagaggtgattttgctactggaattaaaagaagataatatttgactgagtttcaagtgagagtgactctatagtaataaaacaacaagatttgactaaagttgattcttggttgcttccttgaagttgcatgcagcttgacttgataacctcaaggcaatactcaataagtgttttaaaaagactctttaacttattttattccagtctaaacttggcattactaacggtttgatagtttggagttgaaaataaaagtattttggatttcaagacatgattcaaataaaatgatttgagtccta

SEQ ID NO: 892 - DNA, 367 bp, Euphorbia heterophylla
ttaacttaatatttcagaaaaaaaaaaaaaatgagagctcgatttcccggtttgtgatttttcacataaagtacctgtggttttgagcatactagtgcttagtctgacaatctgaaggctagataaatggatctaagttcttttgctcttcttttcttttttatacagaaatagtatgagtgggagcggtgaatgggacaaccgaatgatggactccttgaaaaattttgatctcagcagtcctgaagtcaaacagcaatttggtgagtcgtggatttttattttacactgagaaagcaggtttgagaatttagtgacattctttattgtcatttggggaaaccaattacatgtacccttctgtttg

SEQ ID NO: 893 - DNA, 10282 bp, Euphorbia heterophylla
acataaattatagaaaattctttcaaaaatagttttgataattgtacttttagttataaatagcttgattgatattatttgttttaacgctgtttatgatcaatttcactttaaaacttttcatttcagggatccatttataaattttataaatcatttataaaagcgacgttcattcttgtttctttttttacgtatacatgtaaatatttttcaaaaatgacaaattccacaaaagaaatttcggtttgatgggccttagacaaaatggacatggaggagtaaagccgacccatagtgtacagattcgggttaacagaagtacaactcgggttgagcaacagtcatagccccccgattccccaactccattgttaatccctcgtcctcctcccaccctcttcttcctcttttgaatctgtaaacacctcttccacctctctacaacttcttttctcttccgcttctttttgctttttccttttcaacttctcaatttctgtgaagatatggaaaacctaaacatggcgttgctctcttcatcatcttcttctccgaaattggttctgggctatcctctaacttctacccctctgttatcaagaaccaaactacttcatttcccccttcgaaattccagggttattccgcgcaactctagcctatctatctcctgttttgcccattctcgctctaccaacgctactcctcgagtttcccaaaacagtatgttatttgccactctcaatttagttgcgattctcttacttacttactgtacttgtcccaatttgtgattttgatagggaaaatgggtgctgaacttatggcgagcatttcttcatctagcggtcagcaaacgtcgtcagttggggttaatccggttccagtgcctccctcttcttcacaattgtgagaatcatgatttacatgcttagcttgataggaatttgtatggagttagtcgatttgataagctggataactctattttaatttcctgtttatagtggatcacctctattctgggtaggagttggtgttgctttgtctgcagttttttcatgggtgagagtaatatccatttgttgctgattgactcacttttatggtgtttattcagtctttttcttaatgtttttctatatgattgcagctggccacatatttaaaggtgagtgtcaaacttatgcaaggtacacatggctgtggtttctgtttattttcattatctctgggatttactggtagaaggtatatacatttttaagaaaagatgttattgatacgagcgacgtagttactctgagttgatattgaatttacactcaaacttgtctattggtttacttttgaaatactgttgatttagttgtctattttgcacctatacttgcaactcaactctaggcaaaagttcgaactagctggattcggttatattgattcttttgttttagttgggttttgtttctgttgatggtgttttttactgtgtcacttgtggcgagttgaatgaaaccattttcacctcttgtccttaacttttctcagcagctctgaccttcatttgtttccaggcgtagctacttcttgtctaagtcaatatgtaattctatatatatatcaaccaggcatcaatttgtggatgcatcttattttgataatgtcttatctttgtagtcttgtagccacttgtgcaaagcatagttccctgttgaaggacgattgcttctattagttttcgattttctttacatacttctaggaattgaatgtttattgggtaaatattattgtacagattaggatcaattatattaagacgtgtgaggtcttgctaggttcaaaactcctttcatattaggtgcacagtaaatcgtaatcagaatctcatactttgattcgattcgattcaaccccaaattgattcgaatctgaggggttaagctaaactcatcctgaatcttacgataccgattcagcagcaaatctaccgaaccttacgattctaccgattcggtcgattcatgatctttgctaaattaaagcatggtagaaccttagaagcatatcattttgaagatgatgaaattaaagattcaaattggtagcgaaagtcaattgccccatgaattagtctctaatttagaaaaagtggaaattaagtctctttgaatactaagtctaattgaaaaaatccttacctaatataataattcatgttcaacatcacctctacattatttaacatgaaaatcgaagctaaattaagaatatattgctatagactaaaacttttactagaattgtatatgcattaggtttgaatcataagtacatatctagttacattttccttttaacattaaattacatgtctgactaaaattaaataatatcttttaaaaacattttaaatgttatgtttttattattttatgaacatgaaccgaatcttatgattcgattcatgattttcgattcacaaaatatggatctctattctcgattcgaatcccgatttgacaactatgcttaggtgttgtgcaatttcttttttcttaccttgggtaaagctacatgtgcattttaagacataagcctgaatccgggcttgtgactgtcacttaaattactgaaagccaattgaaatgagatattagtaattgagttataaaatcgaacttgattgaagcaagaggaaaagccaatattttttagtctcatatgattttgtttttatctttccaataatatgccaacctttccatctactcggattactgcatgagttttataagatctctgtaagtgtgatctttatatgttatctggaatagtagttgaaggagtaaggtgcaaagtgttcgaatgttgactaggcacaagatgcaaaagaagtgctcgcctgggaaaagacataatctgaaaaataataatttttatattggaaataaaaaataacaagattccacaattttaatagattagcaaaataatactatgattataactaaaacaagcaccaaattcacaaaatcaaaatcattagcctaaaatatggtagctaatcatcaccaaaattatgaataatttgccccaaaattataagttttaattgaaatcaaattgactaacaatctgtttccattaatttattagatagactaatctctcattgttttcaaaattatttttgacccaaatgcaaataagaccaaatataaatgcaatttaaggagtatatgaagagaaaatgttttcaatttttttaagttcaaaagaaaacagacaaatatatatttatttcacaaagatatattattttctatcattagttacaaaattatttttatgaaagtccaaagtcaaacaggccaaatataaatgcaatggagactcagtatatgaagagctatgtcacatggactgtttatgggcatagttggtaaaggcgcgccttgccatacctcaggcaaggtagcgtacctcgggtgcgcggctttggctcaataatttgttcttctatttttatgagttacagtcattgctattaataggtgccggagtgctcgtctaagcgctcatgcaaagccactcgaccccagagagtctcgccggtgtctcggcgtcgtggcttccaacaggcgctgcttaggcgagcacttccggcgattctagtagcgccataagccgacgccttagtacattagagtgtgaaatctgattaggaagagagagaatcacagagatgaaaaagaaatagtgaaatggagaccaaaactaggtaggggtgggaagccatggaaatggaccactgtgcattcttggggaagaagacgacttatcctcttccttttgtatatttttaatattaataaaagtaggtttgttggaacaagcaccaacatgttcagaattcttttttaattttaattattattaggtagatttactggtgtaagcaccaacatggcccgcgtacctacattatagagttactactttatatttttaaatcttataaattgtaggtttatcagtaaagctccaacctctgtatagttgaaactgattaatggcccgaacaccaacataatatgatagtccctccaaacatttaacttattaattcacattttttttatcaaacttgtaaattaatatctaaatagattttattttgtaaaaaaattaattatcttttcgggaaatacttgaattattatttttattagtcattttaattaatttacatgtaattgtacatctaacatttctcttagatcttttttctggtattgttattgcatttaacttcactttttgagcaaatattttttgtaaatttttggtgcctagtgtaccttaggcatgcccctcgccttggggcacgcctggctcccttgcgattgggatgcgccttgacaactatgtttacgggtgtcccatacgagtatggatcccagcgtctagaatgtatattgtaaaattttttgatacgtaaacattgtcctaaatttggacccggcgacatacatattgcaaagttgaaactgttagagaagagtagaatatcttcaaagaagagaatgaggtgaataagtttcatgaaagtctattttattaatcactacttacaaaaaagaggaatagggaaagtcaagttcaaaaaaacataattgatcaatataatctaggaagagtttttaattaggacgtatgaaaaaaagaatggaatatgagaagtctataataaaacacaatcaattactgttagttaggaaaagtaagtaattaatagtaatcagaataatccattaatttgtattaatcgccattaaatttgatttttaagatattctgaacgggatttttttcttttgaataaagttaattatctaatacatgttaacctttacctcttcatctgcatgcaaaccttcatctcctcatttattgtgttcgacgactccttgtcggattcgattcggatgttgtgtcaaggtcgtatcgacacagtgcaaccactatattgaagagttgttatcatagcttgtcattcttcaatatagtggctgcgaagagtcattacatagcgtgtcattcttcaatatagtggctgcgaatattcattgtcatagcttgtcattcttcaatatagtggctgcgaatattcattatcatagcttctcattcttcaatatagtggctgcactcgtgtcaaaccttgacatagacacatgcatggaatccagattgcatctggcaagaagtcgtctgacacgatagatgaagagatgaagttcaacattcggataaagagatgaaagttgacgttaattcggataattttcttatttcaaaagaaaaaaacccgtttaattatctaaaatatcaactgtgatggacattaatgctaattaatgacttttttttattaatactaatcaattacttttcctaattaacaataattaatcacttcgtctaattaaaaaatagacaatcatatttcaatttagacttaccatattttttcttttttcccacatcctgattaagaactcttcctaattaattaagataaattatgtttctgaaattgaccttttctattcctcttttatatatatgaaattgccatgtcaccgtatctagagtccaaattttggacaatgtccacattttggtcagtgtccatgtatccaaattttttgctcttgctgtactagacacttgaatctgtacctgagtccatgtgacacagctgacaaaggctataaatcagcaagggttggatatcggtagtggtgaggttggaaatctttgtgaaaaggtctaccagaaaacaaaaataaaaaagataaattggaagccaatgaggattgctggaaaccagtgagatgtatcatttaggctgacgttggtaatcacaatattttcaaaaggtaaaaacctaggatataggaagcctagctttactgtgactcgagcaaaaaatgcctttcgttccaccaagaccaagtcacagtaggtgcgcttcattgggcctaggtgcgtgcctatggcccttttgaccactatgttatctgatgcagctaactacaatacgtaactcttgtatttatgaaggaaatcaaaacagatttctatatttattgatgcatcacatctaatagtgtatatctgcaatagcacattcaaaatttgattgacatttttaaggttctccatttttatgaattgactatggaattttatcctaccaaatatgagattctgtcacatttttttgtttttctttttgcctgcaatatatttgatgcatattgcacaacatgcgtcattgaagtctatgtgggcgcaaagataccggtgtcatatttctgatgctttccgctcttaattatatttctactatttccctaaaaagctgaataaaaacttgaaaacaatttgtaacgtaacgttataaactgtttcttacatttgaagattttttataacaatgcttagcttttaagttttaaagttgttggttccatttagaaaacatctgttcgacttagatcaactataaccagaaaattacaattgattttgttaaacagattcagaatgagcagttatgtgttatcgaatgactcattgtaggaatatgaccttgtttttaaggtccttttgaatgtttgtttatgtgtttgatgtgatataatcacactccatataagtatatcgagagacagaaaaattgatggtatatttgccagggtgaatatgtgatttttgttcctatatttaacatgctcaagaaattaaatttttaggagtatattcacatttatttgccattccaattttggattctaatggaataaaaaactttctatactgcgttaaaaaatgcttttcattgattccttctaattaactacaaaaattcggcagtcatggtgccgggatcttggtttggtatattggtttattttatttttaaatttcaatggcccaatttatttattggtctttttttggcgaattcaccccttcatttgtggggatagtggcacactatatcagatttgcttattttgtgataactttgtggtgtttggtcattcaagagtcatgtcattattctatatgtttttattttgggcattcagtcacttaagcacccaatatcatgattttaggatgatgatattgatatgttgtgtggcatcactggcaattgcctcctccaaaatgctggaatcaaatcagcatctttttaattattaagtgaaacattgcaatgaatcaggggcttcctgtaagatgataccttgtgcacatgatttatgtctttagaaaatgatgtgacagttgacatggctttcagaatcaacttcccttttgtattaccttgataactgttcccttgccatgtttgtcccttcaagctctttgctggattatctttgacttattcttcttattttgtatgcatatggttttgtggcctttttcttctcaggtattgtcatatgaaacaatatatctgctgctattcatctgaaaagtttgctatcaatatgatacagtttctttttatcaatgttatattatattctggttttggtatgtctaagttaattgtaaattaacttatattttttttgaaatgcatctcttttttcagaaatatgcgatgcagcaggctttcaagactatgatgaacactatgaatacacaaaataatagcaaccctgcatttccatcgggttctcccttcccatttccaacaccaccagcatcatcaggttttgctagttcatccccattttcatccacatcagcatctgggccggctacctttcctccatatacaacatcgtcacaatcaaccacgtccccttctacagcggctgctaaacctccaatcacagtagatgttcctgcttctaaagtagaaacgtctccagtcactgattccaaagataaagtggaaactccgaaggaacccaagaaatatggtaagaaaatcgctgcttttctaatattggttgtttatcattacatcataaacttcagcagtctgttgaaatattatggtttatacttcaaatgttgattatgtgtaatggagtaaatgaatgaattctgaacggacttaccatctccatttatattctttgtcctatatatctagccaacctttatattgatattacctcccatattttgtattgagcaatttgtctccaatcaactttttttccaattatgaaaagtctttttcgtgctaaattctttccttcaaacccatgtagcttctctttcgattgttgaatttcttagagtattaatcttgatatagctggtttgtaagaatttacattctattttctcttatctttcctatcaccgtatttttctttttaattttcgaagcatgagaacttttactataacattttttccttgtcaaaaaatgcttttatggataatgggttccattatttgttgaatttttcattggagaacaagatattcgtccctccatatttaaagcatgttcctcaaaatcaataaataatgaatgatgctgatgaaatgactattcgtcctcatcccagtgggggttcttttcacccttccctcacggtactacctcgattctttcttttaattaacattctaaactatttgatgatttccatttatcccaagcctgtctcccaataaaaataagggtaaatgaaaaaaatgaaggacaaaagtgcatagaatagaatgacaaatagaaaggaactgaattgaaaaggaaacttaatttaaaattgggggtactaaagtgtgcattgttttctgaaattattatctttctcgatggtttacattgtgttgcaattaaaagtgcaagtattttgatgattaagctttctgttctctgactgactgggaattttttatgaatgtttaagtaaattatattattgtaatacatccaatgcttgcagcttttgttgacgtttcaccagaggaaaccttcccaaagagtcctttcaccgatgaagtcatttccgaaacaagttcgcctaaaaatactcagtttgcccaagaagtagctctcttctcattttgttattcataatttaattttctcttgactatcatagattgatttgtgacgtttgaattcaacttttttcggaaggtttctcaaaacggaactgcctctgctcagacttcaagtgcttctgagggttctcaatcttctcgtaagtaaatttttatttcaatttatcatcataatttttggtttgtggttttatgtgttcgatagagatagagaatataacaatgggcataatagaagggaatagatattggagaattatggaatagaacatattaaaactagagaaaccatcctttttattgtagaatactatacgtgtcctgtggagaagattctaaactgagtatatggatataccatttcccccataatttcattggcattcccttagcctggtaatgcagagaagttgacagcgtcttgagcccctgaatagataaacagtcgacccaattaggttgaatatatggttttatgaattttttggctatagattatgcttattactaatggttcagaatttatagggcattctacttgtattgtattgttagggtagctactattttttctgttcattttactatgccgaacgccgattttttctgttcattttgctatgccgaatgctgagtttgtattatctccactctctcctctcacttcatagttatagttatagtatagacattattagttgttgcctgaaaattttgctcatatatttgcatcaacaggaagtggaggtccaggtttatcagtcgaagctttggagaaaatgatggaagatccaacagtgcagaagatggtttatccgtaatacagctttatcttgaatattttgcatgttatttcaatgtgataatgcattttgctgaaccaacaaggtgtagctaataagttggaggagaacactgtacgaatcccactaaatacacttgttggtaggggtgaggagctgcaactgtgactaagccccgaacaagattatctcattaaagatacttgtaaatatttctaaagaaatgaattttgaatgctctgtacttctttggaggtttcgattcataatgttttgctagacaagtaaaatcatgggatagcgccaataggaatcacatgccttaaaattcctattccatgtaatag

SEQ ID NO: 894 - DNA, 1237 bp, Euphorbia heterophylla
ttcctattccatgtaatagttgcctgaatgaaccaaagactacaaataaaaaaaatccaattttggaattgtttccataaaatttctatttggcttctatttttttcctatatatttgaacctaacaccccttaatagtcccttgctgtgtgctatcaattttgtcaattctattagcttctgttttgttctgcctaaataatgtcattttttcccctcaaatagtatctttttttaaggaaataagagaagttgatttatgtttgtagttctttcctcaaattacgtttgtatatccttgcagatatttacctgaggagatgaggaaccctactacgttcaaatgtaagtaacggtttggaagaacttgtacttggtcttaaaattacaatgactaacacatttgatataaattaccacaattgtactccatgtagccactttgttttctcatgtgggttatgttgtttatcgaaatgtcatcggcaatttatgtgttcaagggttatttgcatggtcaagcttccatctttttttttctcagctgatacttgaagttcattttatcatgtaaatgaatactggaagtaattttaataatagttaactgaattcaagttttgctgtgatggctattatgtaacagggatgctacaaaatcctcaataccgacagcaattggaagacatgttgtaagttcataaccatctttttgtgcttttcattctgtttgaaaattattgctatcaactagtttgttaagtaacttcattaggaattgcttttgttttactgagtcgcatacaatcatttaaatattttaaatgtgcctaggcatgtcttatgcattttctccctgggcagaaatgtacgactatatctcctttagtatttgtactgttgcattttctcccataaatcataataccgtgttccttatctcttgctggcttaacttctgcctgtgtgagtatgtgttgatctgatgactacatgcattgttgaacaatttttctgttcggaagcattcacttattgtattttatattgtaatctagcatccataacttttttatgaacaagtttttgccttaaaaaatgtaggaatgcaaatttagggtgtaatggtatatgcatattttaatctgctttacacttccatgcataaaaatatttgctcattgtaaacatttaacttaatatttcaaaaaaaaaaaatgagagctcgatttcccgg

SEQ ID NO: 895 - DNA, 2077 bp, Festuca arundinacea
  unsure (1)..(2077): unsure at all n locations
tgtacaccctgtatctgcaaacccgacctattacgctatatggtcatgcagaaggagaaatgctttatgtcgcacctagcacccgaggagccaccggcaccgggccagctggaccccagcacacctgtctgtaggtggctaggtctgctgtgttttgccctggtgcttgtggcataaaaagtttcttgtcaaattatatgagtccaagtagttctatatggtgcaatgcaatcacaacaatggcgttcaatatggcaccactaatactctccatccgcggaggttatcttcctgtattcattttctggatgacgcggacaataaagtgattcgcaatatcaaaataagtacttcggttagcagacgaagaattcagtactgaattttaccagttttgtagtcttctatctgtaggtaaacaactggttatgcttaaattagttctgcatagatggaactctacttaaaataatttgtaatttccattagtattttgtcagcgttgcgattatggcttggtgaggtggtcgtactggcactgcctccggtatagtgggcagcaaatggccagtttcagtaatctcaagttgttagtttttgtatattattaaattacgtgtaacgtatatctccttagtatcttataaggatgctgatttcttcacatgtgctagctacttgcctgaggagatgaggaacccagattcgttcaagtgtatgctcctgtaaacttattnnaacacttctgtatcacataattggggtttattttctcttttcatatggtgagatgtttattttccagggatgcttcagaacccgatgtatcgccagcaactggaggaaatgatgtaatacatttattcattacctctgatttatgctttcaaattggaaagtaaacctgtcaacagtattaaaagaataagacagtaatccatgtcgtagtgatgtaaactagtattgaacaatgatgccgtggactggtataagcttgtagggccacaccttatatgtccgagtaatgccactacatgtttatgtaacttatgctagcctagaactcatgctgatgacccacgatgtttttacgtactgtgacatactagtatgcctcttgctttatggagttttgtgtattaacaggagcaacatgggtgcatctcctgatcaatgggataaccgcatggttgatcacttgaagaactttgaccttagcagtcctgaagtaaggcagcagtttggtgagtgaatcaacacttctacgtttacttggatcttatttggaggttggaacatgtgaattctgcaggaaatttcccattatctgtcatcctatgccttttcccttttcaagctatgtgaaaattgtgaataccaattttgtttcgtcttccctacaattcctttatgctatattgaaccctgtatttaccaacggttttcttttaatatcctctttattttattgttccaaattcctagcatagctttgatacatgctcttgttattttggttctttttataccctttcttgttctaagcgcctagcgtagctttgacacatgctcctattttttggtttattattgttattattatattacttggtaggtgatggaaattgttgacaaggtttgaataaaaactacatgcttccctgaagcaatttttagtgcttaccataagcgacattaatttgatttcgaattaaaatgagtagatgtgaatgctaagctctttcatcgtttgtacagcgcaagttggcatgactccagaggaagtagtgtcgaaaataatggcgaacccggaagttgccgttgcatttcagaatccaaaaattcaaacggccatcatggatgtaagtttccatgtttcggactgtttttaatcattgagaaatttagatttatgccactacaaagtttgtttctttgaaaaaatgttgtgggctgtcttaatggcatgtgatacgtggacccacttgtcactctcgtagtcggtgacatttttcaaattgcaaatgttacagtgatatatccagttatccgtagctatttgattattctgacatgg

SEQ ID NO: 896 - DNA, 1591 bp, Ipomoea hederacea
cctgtgttgcccagaaaataccaccaaaatgatcggaattaccagactcagaacctccttttcctacagtctcgtactttcaggaccctagaatcaccaaaaccattttgatgaaacggcttggaagagattgttttgcaagcactagttcaggtagccagcaaacatcttcagttggtgtgagtccacagtttacagcctcgccaccatcatctaatctagggtcacctttgttttggatcggagttggtgttgctctgtcggcactattttcatgggctgctcgaacattaaagaactatgcaatgcaacaagctttcaagacaatgatgggacaggcgaatacacaaaataatcaatttggtaatgctccgttttcacctggatcgcctttccccttcccttttccaccaccaccgccaccaacctcaggtccagctagctcgtttccttcataccctactgcgtctagtgaagctaccccatcgccttcctctatatctcagccggtgactgtggatgtatctgcaacaaaggtggatggacctcctacccctgatgtcaaagatgaaaaagaagttgaggagaaacccaagaaaagtgcttttgtagatgtgtctcctgaagggacattcaagaggagtgattttgaaaattttaaggatataacagtgacagaaccgtccaaccttaacaaagcggctgagaatggaactgcttcagcttcagcttcaggatcgggtccaactcaaagttcatcagcttcaggatcgggaaagccaaatcctccaatgacagtggaagccttggagaaaatgatggaagatccaacggtgcagaaaatggtttatccctatcttccagatgagatgagaaatccagaaacctttaaatggatgctgcaaaatccgcattaccgtcaacaattacaagacatgctgaataacatgggcggaagccctgagtgggacaaccgcatgatggatacattgaagaatttcgatcttagtagtccggaggtcaagcaacagttcgatcaaatagggctttcacctgaggaagtcatttctaagattatggcaaatcctgatattgctatggcattccaaaaccctagaattcaagcagcaattatggatgtttctcagaatccttacaatataggcaaatatcaagctgacaaggaggttatggatgtgtttaacaagatagcggagctctttcccggtgcgaaaccttgattccatcaattacaccgcaatgggcaaatgcgtgggctcctccgtgatctgagtcgatgaagggaattgtttcgcgtagtggctgtgctattgggattgtcatgatccaagctaaagatgaaacgcacaaacagcatcatcttacagtagttagtttctgcagactgttttggtgtacaaattctttagattttttggcaagaaaaagttagtaactccacagcttttcccagaagtgttaagattaccatgtaatcttaagaacttttcattatgctttgtgtttttgtgctatttccacatgaacaattgcatcttgtacatgtttagagctaaatatttcatagtcg

SEQ ID NO: 897 - DNA, 7733 bp, Kochia scoparia
  unsure (1)..(7733): unsure at all n locations
tttttttttttttttgacgagcttatacttaggtttgtgattatcaccacactcaaaggggttatgctcaagtttatatgtattacaagtgatgttactttagtggattgtattagagaatatgtgaatgacagttttaagtttggttagtttgcatcatagtctaaaaggctgaacatggattgtagctttgatgttggagagataacaataactctgtgcaactttgaaataaggattagtatgctgctgtattcaagtagcacgggtaataatatatggggcccatgattcaagtgagttaaaggttgtaatctttgcctcttgcgtgaaagggctagaagcttagatacatattgtatggtcagattctgacaaggttaacctatgtagtttgacttttggaattagttttgtattcggatttcatatgcccaaccaaacaatagatcttttagctttagccctcaatcatagcattgatctttaattcttgggcaatgaggcccatgacctattgtaacttaccaggtcaactctgtcttttaaggcatatagttagaggaaatcctttgtataattccatttgtatacctcgcagaagtgtgttagttagccgtggtgatatgtagatctctcttgcatttgctcttgcattatttatgatgaagtaataaattggattgctaaagtgagatgataaagagttggatcgagaatggagggaaacatagatgaaatagagaagtgagaaggctttattgaaactatcagtaattggagttacaattacttgaatctgaatttagcctacttccttagctttattcttagttgcttagtgcaccatgggaatgtaccttgctctggtacatcccggcactacaaattttatgcctttccccagactcaactaaattgtctagcaataatcgtttctgtcttaacgtagcattcatggccaggtgactcttggttcttctaaggcttttattgtatatagcttttaatatgaagaacactgccttggattcttagaataataaaagtaaggaccatctatgcaatttcatggcctttaggtgctataggtttattcctccctcctttcttcccttataatctccgccttctttgatttttccattacttcgagaagcattgtactcctggtggcttagcgcctaactttcctccctttaaaaaatgctttactcagacggtcagacctctcacatgtgggccaattgggttgtcaacttgtcaccaatttagttgcttttcaagacctaagtatattcacgctattgaggttgaggtttcagggacttttagttgataatttgatatagacatcatttttggaactttgggacactatgtagcaatttgtttcaaaatttcaatgcttagcataggatttatcaatatgatatgtattatccaacattatgtagccttttgctcttatctccttttattgtttgattgatgaatcatgaatgtgtgctgagaatatgaacttgtgtcaatgttattatttcggtgctttctttccactttcgttgcagaaaggctatcttttatgttttgcaatatacattttttagttatcataatgaagcaattttttttttttaattttttttccctgtcagaaatatgcaatgcaacaagcttttaagactatgatgggccagatgggctcccaaaataatcaatttagtaatgcacccttttctcctggttcgcctttcgcgtacccacctccacccacttcaggcacaagcacttcttccggttttacatttcaacaaccatctatgcttggaatgagtggctctgctgcgtcaacagcgtctaaagcaaaccaaactacctcttttcctcctgcttctgaagctactgtggcggttgaagctcctcctaaagatgattctgaaacagaatccgctgaacctcctaacgatgattctgaaattaaaactgaagcaaaaagatcaggtattttaattatctctcagagttggttctgccattttgtgttacaaaattaagaacatcatgcattatgtagcatgaatactcctccctccataacgctttaacttcaacaaatggattaacatggactttaagagggaatatgttaagcattgatttggagagctgttaaggtaaagtaggagagagaatatcacatgggttaagtaaaattagagataaagtatgagagagaaaatcgcatggggtaagtaacttgttctaaaatttaaaggtagggtcattgtagacatttcatgctcaaatttatacctaatatggaaagttaggaaattgttgaagaccttgaagttattttgttacacccatatttagaaatgtgaagtttaagtgttatagagggattacattttaccattgtacttgtgcctgattagtccccttatttggggacaatattggtacttctcttaatatatatgccctatccattgtcatgtaatttttagatttttcatttgtagtactttttttttttttttgaccccgtccatgaatcggtgcttagtttcaatatttttactttatgaatgaatttaaaaaaaaaaaaatttgatgttgattctttcttgtttgttcttgttgtttgaaattgtttggattaggcttcatttatctctgctggctattttgtggtttttggattgtcactataaccttgtgaaatatggatcttcagtgtatactctgatactcatagatacaaaagctgaatcaagaaatttatttgatatttcattgagagaacttttgtatgcagcatttgtggatgtctctcctgaagaaacttttcaaaatactgcattcgagaactatactgactcatcttcgtcagcgccatccgtgaatgctgaatttactgaggtagtgtggagctgccataagcttggtacagtagttgaaatatcacgtctaacttcatttttttgtcaggtagtacaaaatggagctgctccaacggaaagtacttcaaacaaccaggcccaatcacaatttacacgtaagtatcaattgcacgcgacaatttccttggataatgtttgtttcgcacaatcaatttacgattgacctcttgtgaatgaatgtattaactgatggtatctgtggacaatgtgtctgccttgctctttatgtgagagaaatcaaatgactatgccgtagcttggtttcaaattctatgtgcatggtcttatgttgtattaatataaagaatgattatgttagtgagctaatgtctgttctatccatgtaaagtgcttcctaacatgctctaatttgtttcatgtctttttaggaaaagacggttctttgttatctgtagaaacattggagaaaatgatggaagatccaactgtgcagaagatggtttttccgtaagatatctttctcccattgtgattttatagtatttaaaaatgctttgtggtctttattcactcatgcaactgtccaggcacctgagagccaattttattgggtgatatctgatatgtcataaagtagcaagaaacatgtgtctttgtcaaagcttaagctctgtttcatattttaacattcaagaaattgctcaggttttaagtagttgtttagtagagttctcttacaactcatcgtcataatcccattttttcccacacagaattttgttcagacaggcttagaagttgcatttatatcaattatttccacatctttaaactgtttaggtttccaaaaaattaggacagggaaaaaagattaatagagatgacttggtgtggtacatacgtgctgccagatctgacttaggacctcttatgagttatgaatcaccagtggattgcatattgtccttttagctttgttaagttctgaatgtttctgatgtgatttgaaattttctcataatatttaaatttatctaatctgatgtgatttttgtaaaaataagtactagagtgcttaataatgtggtatagttgaattgaacctagcctttatacttttgtagcctgcatatcatcatctggctctcttaattagactatggcatgttataatacagtctagagagtaatataccatgaaagattttgatttatttttgcagacatctacccgaagagatgagaaatccagctaccttcaaatgtaagcctgtggatttacctccatgtctgaatctgtaactctccatctaaagcttttcttcagttggtatatacattatagcagaatggaatttgttggaaatctggttttacttgcagccattgaccattgtctcatgtttgtttctctttgaattaaggttgaaaggaggaaaataatacctagatagtttatggtttactgtactcatcatcttaaaagaatcaaatgcctgacattaagaagcttttattgaaaaaataaaataaaaataaattatgggactaaggcttcaattgattgatttttattttattggttctttgagttataaggtagtacgcaagctggcttttgtgagaaccaaagttcaaatcgtcactagtgtgtctttatgcattttgctattgcctttttaaaattgtttcccctttaagaaatattattaatgaaccgcgaatgcttattgagtttaatgcctagatgacctttgattaatcatagaggtggaggaggaaatctttgtggatgattgcacttttttttcatacagccaaccccacttatgggtcttttgatcgattgattgttatgtttatgatatgtttcgaaggtttatagctttggaaatgggaatctttaaaatttcttattaaatatgattcatgactgaatgacgaatatcaacctctttgactttgggagattggttgatacttgatagctggggatttaagtcccttcattacacacccctttgtcccctctcctctccttcccacttatatatatagtaattaaacttagaattatagtgttctttttaagatatattgtgtttccctctggagtcatgcctattttcctctctggatcatgatcattctggtgtcagtgaaacttttgcgttagaggagctaccttctcattgccacagctgataatgtctttgctcaatttcattgtagggatgctacaaaatccgatgtaccgtcagcagctgcaagaaatgttgtgagtcccaattcattttatgtacatttggtctaataaggtgccatattctgattggttcatatattttaaaagtcgatgatttgattatttgaatttgcagttttgtctttgtttaggaatgttctatatatttggacaatattttcttactggagtctggagttgtagtagtgaaacttgatggcctttgaatgggctaaagtttactgtagcttttgatttataaattgttcaaaagatactccctccgttacgttttagttgaaatatttgaattagggaggatttttaggtgaaatttattaattgtagataagggtgtaagattannnnaaagtaagagagagaaaatgagtgaaaaatgaataaagtaatgaatgggtgtaaggttaggaaaaagtaagtgagagaaaatgaataaagtaatgagtgggtgtaagattaggaaaaagtaagagaaagaaaagtagtgggaaagtaattaaagtaggattttttttactaaaaatggaaaaggagagaattgtttcaagtattgtgtaacatccatttatagtaattttgggagtaaatttaactttatcatgtttcatggtggatggacttgtagtcaactagacacttatagttagtatgaatcatgtctttatcttactatattaccaactgttggatagcttgtcacatttattaacactatgtttggacaacaatcgagggaaaaaaacgggaggggtagaggaggaaggggagcaaagagaaagggataggaaagttaaggtccattttttctccaaatttagagggatagaacttattatatacggagggaaaatggattcttcttccttgccccaaacctttttttccaaacaagggaacttgtccctctccctttctcttccctctgtaagtctctatgttttgagtttcaatataagattttgtttagttggtttagaatataatttttattgagcttttatatcactcagccaagttgagctgaacactagtttggctagaattccatccattaaccacgaaaccccaaaatatatacaacctagaattctatccttaacctgcgaaccacgaaatcccaaattatattcagttgttacattcgtttttatatgttatgaagtatgaaaattacctgatattgaacattagataggaaatttcaacagtgacataaataataaacagctttctctgatataatggaggatagttattttttttctctttaattaactagtcaccagtcacgggcaaactaatcgaacaaacaaatttggtttttatatgttaaggaattgaattactataatattaagctctagtttggtctgttaacaaatgaatcggactttgccgaattcaaactgttcagtgttcacgaactgtatggttagtggctaaccctaaccataacttacagtatcttttgaatatacaagtttctgctgtgaactttagattcaagctaactaattctcacccatgaaggccacttctcaatcagagattacaaattgctgctgcctcaattgtctttagataaatttgtgtttccaatttatctcctataacttctatgttgtttcaattagtaattggatgctgattatcttcttttttccttctagggacaatatggggggaaatgaagaatgggacaaccgaatggtagaaaatttgaagaattttgatttaaatagtccagaagtcaagcaacagtttggtgagtttcatgattgtgtgatgcaatgttgtttaacaaagttttttccattccattttaatgattgtgaaatattttttatctatcaaattcatgcttatggcaattgggttactctgcttgtaaacctaatgatttacctttaaacctcttctgaacccaccttctttggcctcattacacaataatgacatgcgtatctcatgtgataataactagttcaatgctgcagaataatggaaatgattgcagatctgttttaacttttatctatcttcactcttaagtattatagtactaaattgtttgaagacttatgatgtacaaagttttctgaaatcttctttgtttcttaattactaattttggctgtaatttttgtagatcaaattggacttacacctgaagaagttatttcaaaaattatggctaatcctgatattgccatggcattccagaaccccagagttcagcaagccataatggatgtatgctctattgccttttcttattctacactacacaatatcttattttccctctggaattctttaactcctgttactattgcaggtttcacagaaccccatgaacattgtcaattatcaaaacgataaggaggtaggttgaagttatgttcttttataatgtaatacgtatattaactttgggactagcgatgttgttaatttaatactgatgccgtactatctattttattttttaccctacgagtaaggtatttttcgttgggtggggtggggtggggggg

SEQ ID NO: 898 - DNA, 2014 bp, Kochia scoparia
gttataaccagttacttggtattgattataaaaccggtggtgtcggatacccggtactggaaccggtaccaccggatacccactggatatcagttccaaaatttttgtacccagaaccggttaccaccgattcttcatttttggaaccgaaaccggtaccgattcaaccgattccgattccgaaatcgccgatttcggaccggtttcaggtacccggccaggtacgcactgtttttgctcatccctaatagagacggagtattttaaaaaaggaaatacgaagtatgcgattatgagtttgttttttatgacccgtcttctgaactaaagctctgacatccattacttatttctctctcaaaacctactaaactaacctagattagtagaactcattttctctctccttatttctgtcgctcttataatcttattgctctttgccacttcgtccaccactttacttcacttatttgattgattttgtttgcaagactatttgtactttaatctttctattaaagtgttgatttacctatattaaatgcaatcttataaaattattttcaatttgatatatttattacttcgcatgtccgcatgttcaccatttttagagggacatcattgcttccttttaacttatgttttatcttgactttgatagtgagagtttcggctttccctttatgcctttatgtttcagttcaatttccaaacacaacttgggccaaaagcccaaaacgtaagtaacagactcttaccgaatcattattcgggtcatcttcacagcccaaacccgaagacccatttccaaatacgagttcattcattctcattttctcattatcatcttctaaaaatttcagtatctattcaccaaatccatttcatctgatattacacagtattatactgccatttcccagaaatcacttcaactaaatttgggatttccgcaaaaaagatggaaaatttagccctaatttcttcaaaaccagtaatgggtttaagctattcacccgattacaaaacccttgttaccaaaccatgctttggtctcccaattcttcccccaaaaccaactaatttcctcttttcatcaaaacccaaatcaagaactgtcctttttgccttttcaaccccaaattccaggagaaaatctgctcaaaatgctaataatgagatgaaaaataatggggttgagttgtttgcaagcacttcttcaagtgctaatagaaaaagtgctcaagagactacttctgttggtgttaatccccaaccttatgttccacctccttcttctcaattgtaatttatttttacttgttttgttgtgtcattttaagaattgtgtttgtttttaataggttcgattattactgattgatgttttgttttgcagtggttcgccattgttttggattgggattggtgttggcctttctgcagttttttccttcgtgtcttcaaggttgcaggtaagtattctctaatggtgtcttaaacatgctattgttatacaattcgacaatgtgtgttgtgtgtttgtaaatgtcacaacttgattagcatgaaaatcaattgattgttgcaactatgtatagagggtgtcaactgtcaaattttgattaatgtaggtctattaaatgaggattttgttacaagtttatcattgatgttgagcaactgagctacattatgatgccatattcttcaagtagtgatgtagatgagatcacgagaagcgaagagaaacatacttctcagttctctttagatttagacctttaataaaacaaaggacttctactccgggacttttccctttagttttgggatatatatagtgaagttaaagatatatttgaagtataagaccatctttgatagtttgagatactaaatgaagaagtctatcaccttgtttttgtctttttgaaaggtattcaactttagctctgtatcaccatccatatacttaggtttttttttttttttttttttttttttt

SEQ ID NO: 899 - DNA, 270 bp, Lolium arundinaceum
aagcaatttttagtgcttaccatacgcggccttaatttgatttcaaattaaaatgagtaggtgtgaatgctgaactcttttatcgtctgtacagcgcaagttggcatgactccggaggaagtagtgtcgaaaataatggcgaacccagaagttgctgttgcatttcagaatccaaaaattcaaacggccatcatggatgtaagttttattgtttcggactgtgtttaatcattgagaaatttggatttaatgcactacacagtttgtttc

SEQ ID NO: 900 - DNA, 298 bp, Lolium arundinaceum
gtataagcttgttggtccgcaccttatatgttccgagtaatgccactacatgtttatgtaacttatgctagcccagaactcatactagtatgccaattgcttaatggagttttgtgtattaacaggagcaacatgggtgcatctcctgatcaatgggataaccgcatggttgatcacttgaagaactttgaccttagcagtcctgaagtaaggcagcagtttggtgagtgaatcaacacttctacatttactttgatccaatttggaagttggaacatgtgaattctgcaggaaattt

SEQ ID NO: 901 - DNA, 1115 bp, Lolium rigidum
taattctgcatagatggaaactctggcttaaaataatttgtatatacattagtattttgtcagcgttgcgattatggcttgatgaggtagtcgtacttgcactacttcctgtatagtgcgcagcaaatggccagcttcagtaatctcaagttgttaatttttgtatattataaaattacgtgtaacgtatatctctattagtatcttataaggatgctgatttcttcacatgtgccagctacttgcctgaggagatgaggaacccagattcattcaagtgtatgttcctgtaaacttatttgaacacttctgtatcacataattgggtttattttctcttttgatatggtgagatatttattttccagggatgcttcagaacccggtgtaccgccagcaattggaggaaatgatgtaatatatttattcattacccctgatttatgctttcaaattggaaagtaaacctgtccaacagtattaaaagaatagaacaataatccatgtcgtagtgatgtatattggtattgaacaatgctgttgtggacttgtataagcttgtcgggccgcaccttatatgttccgagtaatgccactacatgtttatgtaacttatgctagcccagaactcatactagtatgccaattgcttaatggagttttgtgtattaacaggagcaacatgggtgcatctcctgatcaatgggataaccgcatggttgatcacttgaagaacttcgaccttagcagtcctgaagtaaggcagcagtttggtgagtgaatcaacacttgtacgtttacttggatcttgtttggaagttggaacatgtgaattctgcaggaaatttcccattatctgtcatcctatgcatttttcccttttcaagctatatatgaaaactgtgaatacctatttggtttcgccttccctacaattcctgtatgctatattgaccaacgatgttcttttagtatccttattattttatcgttccaacttcctagcatggctttgatacatgctcctgttattttagttctttttgtgaacttattagtttcttgttgtaaacgtctagcatagctttgacacatgctcccattttttggtttat

SEQ ID NO: 902 - DNA, 323 bp, Lolium rigidum
tacttcccctgaagcaatttttagtgcttaccatacacgaccttaatttgatttcaaattaaaatgagtaggtgtgaatgctgaactcttttatcgtctgtacagcacaagttggcatgactccggaggaagtagtgtcgaaaataatggcgaacccagaagttgctgttgcatttcagaatccaaaaattcaaacggccatcatggatgtaagttttattgtttcggactgtttttaatcattgagaaatttggatttaatgcactacacagtttgtttctttgaaaaaatgttgtgggctgtcttaatggcatgtgatacc

SEQ ID NO: 903 - DNA, 18771 bp, Portulaca oleracea
  unsure (1)..(18771): unsure at all n locations
tatccgctgcttaaaccgctatccgctacataaacctctatccactacctaaaacactaattttgccgaacatggcctaaaaaaatttacaaaaataaactcggtttcacactacaaagacttccccactgcacgtactgcaatatatttgatagggcccgttattaatagttacgaatctaaattttctgattaaaggtgatcaatacactattttttattcatttaataccaaattatattgaattattattattttttcatattatcggtaggcggtggccatagccaccttgacttagcactaaatccacagcacagtcatatatatgtgaagtcaatattataggtgagtcacttgaattaataagtccgatttctgaaatctggaatagttatagtaacttgcatttcagatttttatttaaattgtagaccttgttcattaataaaatgaaactgagtaaaataagatagggtagaaaattgtaaatatttatatatgatgttatataaaaagttgtaagtgtgataggaattcaaaattaccttagggtgtgtttgattgttcaataaccccgggaaaatggtcaatttctcaggttgacttattttccccatgtttggatgtgggttgacttcgggaaatttttcacgatgggtccaccattttctctattttcctagggaaaatttcccttaggggggctaagggaaatttttcccaaggaaatatttcccatggaaaacttcccatgggaaattttccctgagaaaaattttgagaaaaattttccgtggggtcctaccaaacactctcttaagtaatttttggtcaaataagataaaaacgggtaagtttaagtagggtttataaaataagtaaatcaacaccaccgccttatcaccaccaatttcaattgctcagcaccaccaccaccccaatattagaaataacctttaaccactcccaacactaccgaccgacgctcaaaccacccctttagctttttcgagccctctctacaaacccttttagtatctggcatgtcttttccaaatatttgcaaaggaaaaacatggttcgcctttgtagatgtgactgcgtttgccatcatgggcctactttgcaagttcatctggcccaatcaaagtggctatcggcccagtcaagtccatgtttatacgtaaaataaatgaaaacaaaatctaaaaggtgagtgataatataattttaaaaaaggaataatatgagattttagtagtaaccaactttaccgtgattcccgcgaaggtcactaccttaaacacaatgacgccactgtagtcggaggtttaaaagaatcacagacgaaacccaaaaccctcgttcatccaccactttctccggccgccgtctctgccacctccgccgcaaacgccaccgccggaaaagaggttttgctttgtgtcttatcttcttcactcattgttggagggaaatttccaagcttttctctgcttcttttcagggtttaatccatatttttctgggcaatttcttgctttgtattatcatttttgctgtttctgataatctgggtttgtgctacttgctaatcatattatcaaccatatgatttcctgcagacattgcaagaaatgtcttaccaaactgaaacaatcaaaagattgtacaaagtaaggaaaacccttctggaaatgctgaaagatcgcggctatgtagtagctgaggacgagatcaacttgactaagcaacagttcgttgaaaagtacggcgaagatgtcaagagacaagacctcttcatgcacaaaacaaagcaggataacgcctctgatcaggtgctcttttgattttcgatcaacgagagtttgtgatactaatttgtaaaaaattacttggagatacccaatatttggggaaattatttttcggtacaccaacttttcaaaactcattttgaggtagtaattatttggtattttttcggccatcaatttcattaagtgatcgtaatacccttattctttttctttagtgatatttcttaaaaaaatggaagaacaggggtatttcggtcaaagtacctaataatttctaacccaaaaagtaaggtaccccaaaatgagttttgaaaagttagggtacctaaaaaatatttcaccaaaagttnnnnnacctccgagtaattttttgtactaatttgtgttgtaatttgtggatttaccgcgtggttgtagatatttgttttctttgtagctcctacggatgcgtcaaagctcgctgttggcattggcccaatcaagcagtgcttcgagaagatgtcgtcagagggagtttgcagatcgattgtggtgtctcaacatgggttcactccttcggcgaaaaagggcttgcatgacattcctagattcaccatcgagatctttcaggtgaccaacattggccattctgatgtatataactcgatttcaagctttgtttgtcagtagttcggacaatttgccaattcgtcccaaattggcaaattgtcttgacaagcaaagcttgaaatttgtaacaacgtacttattatgtcaggctactgtaacgtaggatgcggaactcttgtgtaatgtgatgcaccatgaattagttccggagcatcgagtgcttacagatgaaaaaaagagtgagttgctgcagaaatatggagttaaagacactcaggttgatatatacttacatttgtagacatgtttgtatggatatttttggtgttgatactattgattttgtgggtgcatgttgttgtgtttagttgccaaggatgctgatgagtgatccagttgcaaggtatttcggactaaagcgtggacaagtagtgaaaatcatcagaccaagtgacactgccagcaaatatatcacatatcgttatgtttcttgattttgtttaacaacaatttttattaagatgtttgtgtagccaaagtttgagttcgaatttctagtccaaatttaatccaaatatttgataatctttgattatctttgatccgacgactggaactttgaagttttgatagattgttgtatactcttatagtcttataatcatctgcagaaaattaaatggtgctatagcaaatgctatctttgccccaaaactataatctattttagatcgttgtatatcttataaaaattatgtaagttaaatttaacttaaatagaaagttatgtaggcataggagcataggtatgtgatttttttgggcttccaaaaaagtaactagtttggacattaattcctcctatagtacataaccaaatatattatggtttatagaaagacaaatttaaaaagaaaaaaaatacattaatcacaagtcataacaacaacaacaacaaacctaagcgtattgcagtccgaggggaggggatttagatatagggggacttccctctatatatgaaaacctaagcgtattgcagtccgaggggaggggatttagatatagggggacttccctctatatatgaaaatttatgaaaaaactgatttcaacggataaaaaaaaaccttttgaaaaatattagtcacaaatagacctagcaaaactgacacgaaacctgaaattcgaaaaagttgaactgacatatggatggatgattcaatcttgacttaagtccgaataaaacccgacccgaaactgatccagacctcaaccgaaaagtgacccgattaagatccacaccaaatgacatgaccccaaatcaaaccagaactactgagctactaccgccatgctaatctggtagagtagagcggaaggctggctccccaccatcttcattttttgaagaatttttttgaaatattctttgaaagaacttcacccaaagaaacacaaataagactcaaccggaatcaacttgaacccaaccagaaccggaattagttcacccgatgccaacacaaatcgcccttcaatcttcacctctactcgaacctgaaccgattcactcatttggtaggactctgtgaattgaagttgatcagatttgagcagagggagtagcccatatcaaagggagcccgacccaataaaacagtgggccttgtctcctctgaaaacaccaaattaccagaaatccagaatcccacaccatcgactatcgaatcatcttcttccactttcactctctctctctctctctccctccgccattgttgctctgcaatttcatctcgagatggagactaatttaaccctagtttctcctaaacctgttctgggtgtaatctccccactcaaccccacaactctttccaccaaacagtgccttggcctccctcttctctctagaaaaccaactgggtttccctcaaattcaagacccagattgagaaccaccctcttcgctttctctagccctctttcccgcagaaagttcacccagaataacagcaatggaaacaaggatagtgataataataaggttgatttgtttgctagcacttctagtagtactcagcatacttctgtgggagtcaatcctcagccttacgctcctcctccttcgcaattgtgagttttctcagcttcaatttcgatttttggtgcgtgttttgatgtgaatttggcagaaaaatgatatctttctgatgtttacaatgtgggttttagtgggtcgcctttgttttggattggtgttggtgttggtttctctgccctctttaccttcgtggcttccagggttaaggtaagtgtttttcttctctaatttgtgcattcttttttgggtcaattgtaattgggaagttgtattatgtgacttactttgaaatggaggggtgtttcctttgtaattttactaggttcttttgtatgtcagttgttttataatggccattttgatccgcatgactaccaactgtgctatatgaattaagaagttttgttttctgggttcttattgtatctatagggcttgctggtttggtactgattcatagaaactgttatgttatgatgaatgcatatggagggctctttttctgtcatttgggtgaatgatgtgtgacgagatggtttaccacatcatcttatgccttgatcaagcatagttcgatcatgtagctcatgattgagggggggcaatgcaatgcaagggaatccatagaagaatttccaattgattttccttttattgctggctttgcattttactttattgtgcttacttttaacttcttgttgtaatagaagaactttacctttgattgaggaatggtttttagcggttgctataatctgggtggttgaaaaacattacacctgatagctggcctgccggggtttcagagtagtaggcagcgaacgatttttaaatcttgggnnnnttggaaccagtctctctaaattgaggggtaaggctactacttttgacccctccatagctcacctggcgggatttcagagtattggtttggtttttgttggcgatttccatgtgctaaaatcacgatattattacttgatttcttgtatgactctcgggtactttggttcatgtttcgtgttaatatattacaagcttagtcgagctgacatggacttccgtttactaaattttgtgctaaacttggcaatgcatttcaacatcattatcatttcgaaactcacattcattccctcttttgccttcccccccttcccagcaatatgctatgcagcaagctttcaagactatgatggggcaaatgggaacccaaaatagtaatcaatttagtaatatgaactttccaccgagctcaccgttcagttatccaccaccatacacaccaggaccgaatcctgtacctagtttcccctatccaccgccacctacaaccgggcctagtatcccatccactagcccttaccgatcaacaactacagcgcaaccggttacctctactgcttcaaccactttttctgctccctcccaagctgcatctgaagctgcagatgtttctgcaaccaaagtagaagctgcagatgtttctgcatccaaagtagaagctgcaggacctgaggttgtaaaaaacgaagctgaaactaagactgaagcaaaaaaatccggtacagttcccttgctcctagtgcttctgaattttgtttcttaaatgtggcagtatcttggacaacagaaggtaaaatagatagtaacaggaattatatttatgttgggattagagttggcaaaatttttccagaacggaaaaaaccgggtttggtcatagatttttcgtccgagttttgacattgaccgaatatttggacaccatatttttgtttatcctatcgtccgtacctgattttgacttggatttagttcccatctgaattgtccgacccgaaaaaatggggttcgggcatcaatttcttgtccaaatttcggcattgaacgaacttgactgacccgtacccaaatttttatcagtgctagttagaatacttataaatattatgttactataatggcatctgattccaattttttcagtttcttagttgtagaattgctttaggatattcaatcttgatgagaattttcatctgtagcttttgtggatgtctctccggaagagactttgctgaagagcccatttgaggacgttaatggatcatccgcaacgccagcaagcccggcatcctctgctgaggtagtgccgacaatggagcctgcagtttgtcatgtttgtttgacattgattgtgtgttggttaaccttatttgctgcaggtggaggtggtacaaaatggagctgcttcatatgaagctagcggtacgaaggaagatgcaacttcaggtttgttgtgacttgtgattgatttgtggtttttggaaaataaaaaacagatgtggaccctctcatctttgcaaatgctctagactctagttatgtttttgttattagagatattaatgatcttattgtagttgtttcagtcttccaaggaaactgcatatgtaacttcttcatggattaaatgtctgtggttttgtttgcaccaccaggaaaacgaagttctatcttatccgtggaagctctggagaaaatgatggatgatccaactgtgcaaaagatggtttatccgtaatatatcttttaccaattctgctttataacatattgtttctacaacttctgtctgatgcatgtttccatttgcaatcataaacatcttgtggattttgaatttgaggatactatctctttgttcctcaacactgctagtttttcattccgttatcttcatgctgtaaatttttaatttttacttttcttgttgcaggcatctacctgaggagatgagaaatccaactacctttaaatgttagtatttctcatcttgacctccttgttcatgatttcttacatttctgcttaaaccatttagggcaatcaaatttttaaaactggcggaatttggaccttatgtttgttcaaaatatgaaggtaaaaagtttttatcaaacaataatgtccgtctaaaactaagactttttactcctgattcccactttttacttacgaagctcggtatcaagtttaaaacactcgctctgtgtttggtgcatgggtagcatgctggttgaagcagcaggtatctatgtcctaatgtttgtttgctccaaattgagcgggataagattgttattgccatgtgaatgctagtgtcatttttgctcttcccttttttgccatttgtctgggtgacttagcaatactttttatgccagggatgatgcaaaatccggtatatcgtcagcagctacaagacatgctgtgagttttcgttttcgttttcgtcttctctagatttgggttttcctgattacttgacatcattctccccaaattctgtgttatcattactgaactccgaatccgatataattgaacatatacctcaaatagtccaagaattgttttttggtttgcatcttttgtgggtctctgaaatcagcttttctggttgcctctgccttttatcttcttaaacgatacttctcatctaagttctatgaccaatagaaattctgagaaacccttgagccatgcaattttatttttcttttctgtggtctcttgtctcctcattccttcactttagtgtctttgtcaagagtaaaccacaacaacaaacttttaggagaaacacggttgagcgcaaccttttcccccacgaacatggaggggctgattcatgtggactcacagaaagcctttaaaaagaacaacattgaaaaccgtgtctttgtcaagaatgatgagtgttattcccttttcagagacaacatggcaggaaatcctgaatgggacagccgcatggtggataccctaaaaaattttgaccttagcagccctgacgtcaaacagcagtttggtgagttggtgcttttctcgcaacattgttcgatattgctgtttgatggattgactcctttctaaagctttcgatatttgtttggcagatcaacttggagttacgccggaagaggttatctcaaaaattatgtcaaatcccgatcttgccaagggattccagaaccccagagttcagcaagccatgatggatgtacgtaccgagcccgtattatagtatattattcgtcgatgtctatttgttcttttctttctccaccgatttctgtctcttaaccctttgttactacgactaatgcagtgctcgcagaacccttggaatattgccaagtatcaaaatgataaggaggtaccatagtctactttcttttcttcaaaaccgggaaaaaaaaaaaaaaactcactcacttccattgtagcaggaaaatgagctttagatatcttcaaaaccggatttttttccccatttcagtaaccctccccctcattttaacctaaaaattggaaattttctgataaaacaaaaatgacgcgagcaaagacatcatcacggggttggtattttcaaacagaccattgtgcgcgtttcttctggcatgtatcgtgatgcaactcttgcttgtttgtgttcacttaggttatggacgtcatcaaccaactgtcacagctctttcccgcgcaggggggcccacctcctttctgatgaatcagccccgactgttgattcagattgatcgcatggctgtcgtaagccatgagatcgtctgaaatcggtttgtttgatgatatcagcagccaagaaaatcgatagtacgatttagtcgttgtgaaagttttggttaacctgcccttttgacgttttatgaatctagatatcttgttgtttttgatgaagattgctatagatttgtttatattatgcattagtttaattcccctattgattaattttttttttgggtacttggattgatacaagcatgtacataagattttaagaagtaatgcatatgtttatgaggtgtgctgcatttttgtttattgtgtaagttgcttgcttgttttgagaaagatttggtcaacagtctttggttgtgtttttgaatcacaaagtgtattggatcacacatttatttatggtttcatcaatgtacatagtgaagggatctggttgtacgaggtgctagctgttggtgccttggtaagtatatgatatgttggatttcggtaggcctaacattttatgagttgaattttagtataccttagtatgatagatttgattgcagtagtccaaacatttcaactattagattattgtacaccaaactatgacaatctgtcaagttggtgtaactcaacttgatggtagtgcactgtagtagaataatttcacaatttggtttaccgtgatataatttttaaaggacttgaaatggggtacaatacaatccattttttttaaaaaaaaaaatcaaagacatcaaataatacaattagtagattgaaaaatatcacaaattttgatagatggtccattaggaaactttgggttattttctttgtagatggatggaaacaaaatgtggttaaataaatggcttgttatggctaaactaatggtcccttagacaatgccatgcacatgcatgcatacatagaggcttcttggatttccactttctaatctccacaattcttttgtgggtcttgaggccatgttataggacacttggtgaaatgaagtttgtttttgagattttggttttcttctggtttgattggttttttttttgttaaaaaagaataagttgtaacatctaagaagcctttcttttggggattttacctaaattatctttatataaaatgttagaaagatctctttattggacttgatcccattcaatcatggagtgccatgaatgcttcgactttaggagcactgctgctcgattaccttaatgataaatatgattcacaaaacattatgaaatatgtaaggattcttgtcgattggacttatatgttgcatcttaaattcttaattaatgagaacattgaatcaattatatttctgcgattttagatgtatatcgtcatcttctaagttcagtatgcgaatgatgagatttttcaaaaaacatagcaaactaataagaaacgagtttcagaacattaattatctgtaagtctatcttatttcttcatgggggtaaaactcaataagaaaaactatcaataaagtaataattacaaagtgttatccaatcattcttatatttagacattttagtccatatcattaaattaaaggggtcgaccctaaacctaattgatttttctaatgacaattttacttagaatcatgtgaataactttttatattctacaaatttagctagtgttgttgcaacttgcaagctatatttcccgtcatggtaattcgtggatattaccctattaaaagggcccatttttatgcattagtgggtaattaaacagttaacgatcctgacccagtgatcccctctaactttattttctgtctttttgtttatgtgaatgggatctcattgttgcgactttaggccccatttctgtttcgtagggcgtgtaagatttaaccaccgcccaattccatatcaaaactacgctttccctcgttatttgtttgtagggcttgatttagacaccctctcctcctatataaaatttatagtagattcatgaatatgtctccttttcaattatcatccctaacaatgagctacatcataaaccaacatttcaaaatatatgtatataattttctttttatattggtgagtcagaccacccactaaggttcctatttcaaagaaagtctaataagtttaccagcctatgagggaatggggaaaaccagatatgcacacacagtgcaacggataccaacagaactaagagctcattggtcaacatttcaatatatattaactgagttgaaagttttgttgtactatgcacccactatcaaagtttggacaaatttacttgaataaatggcctatataaaaaggtgtatgtaaaagaacacatattgtgttgatattcgattcattaatgagattacgcggaaaatattttgataaaaaagttaagtagatgtttgcaggtttaataatgatttttttttataatgaacatgaagattgttaagattcgagcgagatacctcttagttaaccttgctcttatttcatgtgaaaccatatcaatcaaaaattttttatactctaaccctttaacagtcaccccgctagtgaggtttgtttttctcgattcattataagcaacttcttcttgattccaattgacatgcgctaataattaccgatcaatactgatcaacaaaagtaactatgctataaaaatataataagtatttatcactactgaatgctgatcataaatacttacaataaactcaactgaacaagtccgaaatactatacatcatacaagtggagggaaagtaggtaggcttcccatgtccatgcaaaggcttataattagattgaagattacttaagccgttattagtatgtgtacttaacgtagtagttgtggtaggaccattgtccatgtccatgggggcctatgagggcgtgggtattgtcctactacaccctgtcatggcatgggtttgtttgtacttcatcttaaccacaatttaatttagttttctctgattattcaattcgaattatatgaattgacatatatttgtacaatattcataataataatatccttttgtacggtacattaattcgttattcacttcataagccatagcttgtcggttcttcactcgtaataattgaaattgttataatggagataacattatttttcattgtcctttggaaaaaaatttcctttttcatgaacaagatcatatgaaaaatatagttgagagtaaatggactttctaatccaaaggtagatattaaattgtagctatatttgaaaggctgaaaaaaatgaatgacaaatatcaaagttgacacatatccagataaacattttttttcattgtggtggttatcatggttgacaaccgttataagtattttccatatttataataagaatttttttgccacaattttgcaagatagcaccaaattgtactgcattgtaaaccccataattcccacatttacatttttaaatgatctataatggtgcgtttggtagtttctttccttagggccttcttagacaaattttacttagcttgagagtgaaataatgagcttcacactaaaattttttcctgagaaattttgtacactagagaaatttcactgacttttccaaaaaaatttgggaaccaaatgcttttcatagttaaatattacatttacctaagtacaatctttatttgctaatttatttagttaaatatgccgcgataaaaacatagttaaatatatggaattacctttaatttgaaatagtccaccgcctataaaacatgatatgccattaggtagagtgacccatccaaatctacctaactctttaattcctacaactttatagattcaacctaaacaatttttggaatatttaactaagatatgcatttgagggaagaaaaaaaagtactgacgtatgtgagaatgtttactagatattctttcatcagagctatgtatgaaaattatgtacctaacttacataaagattacaagtatatgattatatgtggtggaggaagagtcttccaagattaccattagttattaaaaatactttgtatccttaagcaatgatactatcacttggaatgagataactatctcaagtgactagaacttttaaataaacaagattaatatattctatgatgaatcatctcattataaatttatcgtaagattatatttgaatagataataatatatattgaatttgaggagactttgattataagtcatttattaataaactgtttttcacattcttatgaacaaatcattatgattatctatcgttgtacactacatgattatcattaagctcgtgataaacctaaaagtaagaagtgatagttactttagggagtgaatattacttattacttgatggtaatcgtacaatcttcaagaagtcaccctaaaaaaaactcgtctctctcaacataacctctacagatgataccacattgatgaacagagtgaaaatgttacatcaaaaacggactgatacaaacaaaattgtataatgctatttgactattcgtgactcaattcttcactccttccttccacgtctcaatcaaaatcaacttcactcaatgctccaattatgtattcccaatcatcccactcttacactactgattgaaactcccatttttcccctcatttatttgcatactgtttgtttcttcgacacctgtcaattcggtcaggttcagtatgccccgtattccaggttagttatatttcaaaaatcgggtcagtctcgaatcgggtcagattttgcgaggtttcttgtattatttggccctctgaatataacaccacttacagttgattacctgtaaagaaggcaaaaacccatcatattttcacccaaacaaaccccttttctatgcttttttcctcatgtaatgtagttatctcttctgctttacactctttttgcctactacatttgagaaaactcaggaaagagaaagatgcactgaattttgaagtgaacccatcaaggtaggagatctttttcttcatgggtaatctaaattacagttacccatgaactttatgtttgatttgtggtgtgcttttacctttactagattgattttttgaagatttggtaaaatcatcatgattcatgaattaacttagaaatctgggcagttattttttgggttgctgttttccatgactaggatcttccatccatggagtagtttacaaattaagcactgttgattgctttccatgttcttttatataatttagaacctcccaaagaaaaagcccaccaactgtttgatgagtggcttcaaagaaagatacaagctttttttctgattgccaaacacacttacaatttttagtgacattttaactctctgagattatgaacatctttcttcagtttcactgttgattagtttattgcaaatttgcaatcaggtaatgattctttgagtgttaattttcttctgcttctttgacagagttttctaatggagctgcatcatcatccttaacctttgtttgtttgccccccttatcatctcaatggcaactaccaactaccatcactctgtagtcctatggatgatcttactacaactctgttgtttcccgccaaaacatgcctttgaaacagatgaaaaaagggttcttcttgatctcaaatcccacctcaaagacccaacaaacaagcatctaacctcatgggttgattctaaccctgtttgtgagttttctggggttacttgtgacccagattctgggagagtcactgggattttcttcaacaatgcatcgttatcgggcgagatttcgcctaatttgtgtctgttacaagggcttaaatctcttgttctgacatcaaactcaatctctgggaagattcctgaagagttgagccagtgcagcggtctgaaactcctgaacatcagtatgaacaggatggtgggagaagttcctgatctttccgggttgaggaatttggaggtgcttgatctgtcctccaatttcttcactggggagtttcctgcatgggttggaaacatgacagaattgacctctttgggcctggcaaacaacatgttctcccagggtcgaatcccggatagtttaggcaatctcaagaacctgacttggctgttcttggctaactctaagagggtgggagagatcccggaatcattgtatggattgcaggagttgggtacgttggatttgtcgagaaacgagatcactggtgtgatctccaactcgatttctgagatgaagaagttggtgaagatcgagcttttcgataacaacttcaccggtagaatccctcaggagcttgcaaacctcactcttctgcaggagtttgacatctctgcgaatcatttctacggcgatttgcctcctgagattggcaatctgaagaacttgacagttttccacatctatgagaatggtttcacaggagtacttcccctggggtttggagatctgcactatctcaagagcttctccatttacaggaacaacttctctggtgaattcccaccaagctttgggaagttttcgcctcttgtactcatcgacatttctgaaaacaagctcagcggtccgtttccaaggtacttgtgccaaggccgaagcttggagttcttgcttgctttggacaatcagttttccggggagtttcctgcaggttatgccgattgtaagacacttgtcaggttcagagtcaatcagaaccgattatccgggaaacttcctgatgggatatgggcaatgccgaatgtagatataatagacttcagcaacaatggtttcacaggagagatatctcctgaaatagctaactcggttactatgagccagttgatcctggaaaacaacaggttttccgggtcacttcctcgtgaactcgggcagcttgctaggctagagaggctctacttgagcaacaactcattttccggggggatcccaccggagattggtgcattgaagcagctgtcatcgctgcagctacaagcgaatgttctaggaggtccgatcccatcagagctcggtcagtgcacaaggcttgcagacatgaatctagccgggaacgagctcaccgggaacatccctagttcattttcccagatgagctcgttgaactccctcaacctttccaagaacagactcacgggtcagatcccgcagagtctaggaaagctgaaactgagcgcgatagatgtttccaacaaccaattatccggaactgtcccttctgatctgctgcagattggaaccggggactcctttctaggaaacaaggctctctgcgcggacaaggacatgaaaacatatgcaaactacgggttacaagcatgcaacggtgcagaaatccaaaggagggggctgtcaactgagataattgtgacgtgcattctgttgtctgtcctggtagtcgcattattcgggctgctcctcataaactacagacactacaaagtctcaaactcttccccagatgtcgatctcgaaggcagaggcgaaaaggaccagaaatggagggttgagtcattccatcacctagagtttgacatcgatgaaatttgtgatctcgaagaggaaaacttgataggaagcggaggcacagggaaggtataccggctagacctgaaaaagaatggcgggacagtagccgtgaagcagctctggaagggttcttctgggtttcgagttttgtctgcagaaatgaacattctggggaaaatcaggcacaggaatgtactaaagctctatgcttgtttgctgagaggaggcacagggtttctggtgtttgagtacatgtcaaagggcaacttaatgcaagcaattcagagggagatcaagggaggacacccggaattagactggtataagcggttcaagatcgccttgggagttgccaagggtcttacctatctgcaccatgactgctcgccaccggtcattcatagggacataaaatccaccaacattttgctcgacgaggactatgagcccaagattgcggactttggggttgctaaggccgcggatgagtctcttgagggatcggagcacagctgctttgctggcacccatggctacatcgctcccggtaagctcctgatcacattttctgactgtaagatcttgatcactatgctcatttaactcctgatctgaaaacaccctttggattcaaaccccattagaaatttaaagtaattttgattgaaaccctagtattgttttaatattatgtgttagaatcgcaatgtgtttgtatgattgacccgcgatgattcccatgcagagctggcctacacgcgtaaggtgacagaaaagagcgacgtctacagttttggggtggtactcctggaactcctgaccggtaggagtcctgtggaggagcaatacggagaagggagagacatagtttactgggtcctgacctgcctgaacaatgacaatcagaaagtgaacgatcaggcgaatgttcttgacagcagggtggtctcccctggggtcaaagacgacatgatgaaagtgctgaggatcgcgactgtatgcaccgcaatgctcccgtctctgcgccctactatgagggatgtcgtcaggatgctggtcgacgctgatccatgcgctttcagaaccctgcaggacaaccattctgacaagcccgaaaaggttgtgttctagacttctagtttagttccctggcttctgtgtaatgtgaaaaatgttctgtaatttgtgtgccaacgacagcctcgaagtagagaatctgtcgaaattttcagtagagattttctgttttacatgaagtgcaatagtgtgggtgaaatgtttccaggaagaaaagaaataattgtgaaatatgactgcagtaaaatcagtagctacccagatggggccttgtatatattcagatgttagcttaattttgacaaaaagtcttaaatgataaacaaatttccaaccctcctcatctagtgtctaattgcagatgtttttcctagattgtatcaggaagaatgcaaatttgggactgatttcatgattatgaacagttttagtgtctaattgcagaagctgagataaaccctcctccaattttcggaactagacccagaatataacccaagtttgtgatcaataaaagaatcaacagagattattgtatttcatacagagacaaccagaagtttgatatggtaacacacaataacattacaagcttgttttttgttcctatactaaacaacaatcacaatgcttacattttcgagaacgaaacaacaataacatcacctaagatcataactttgattcgggtcaaactagaatccctccggaagcctgtgattgccaggtgaaaccggtgcacgatcaactggtgatgggaagtaaactggggacttgtaaactggcgatgcagagtaaaccggcttgtggtaggcaccggatttgtaaggcttgtaaactcgagcggaagtgaaaaccaaagttgacaggagaaggaaacagtaacaggcaatcaaacagctcttattagtagccatggttttgaacatggtaagtttatatctc

SEQ ID NO: 904 - DNA, 11978 bp, Portulaca oleracea
tttataaaatttatatatattatattagaattatagaagtcaatcatataacttttttccaatttaatttatataacttttttccagtttaatttataaatatatattttttctataatgacaatacacagcgtatcttgcacaagacatttataattttggatacataaaatccatccccagaccgcaacaaagacacgtatcatattgtatgacaaattccaacttttatactgtcaccttggtacagggcagccatggtagcagcggttgatgctagacaagatcataaagcaattcccaagtacggattcctggtacatatccccatttctaccgacattcttacacgctgcagtgctgcaccgataactacaactgataacaccaccgaaaccatcaatcaatcaaccgccatcaacatctctctcgtatatatccaacactttttgcttcatttcatcccccatttccagatttcctcttcactacccaaccaaaccaacaatggcttcctccatcttcttcttcctcgctctcttcttcttctccatcttcatcctcttcctcagactactctcccacatcttcccacataaatccatccacgatcgaatcaacaatcactccacagcaggtgaagaagtggtcgttttctgcggggctaaagccaacaaattcatcttctcaaacgatgacaacctcttcaagacatggtggccaccctctgtttctctagccttgctttttgcgacgaacaacccagatttggagcgagatcactcgtttctcaggctcgattcgatgcaaaactatgtacccatcatggattccatggcgaaggaacatgttcaaatcaactgggttgggttcgatgaagttaatgttgacccattggcgcaagagttcacatttgctctcgcatgccggattttcatcaactgtgagaacccgaattgggttcgggagctcatggtgccgttttttgccgtcgccggcgggttcacgtcggttccggtgaactttccggcgaccccttttcctgttgcggtcgatgatggtaaggttgttaaagaaaagcttgtggaaatcataaaacagaggaggatcgagattgctgaaaacaggggttttaatggtgattcgaatgacatgctaagtaggttggttgttagtttgggtgaagatggcaagttttttgccgaagaggagattgcgaataagattatgtggtatttgattgctagttttcatactacaagttcgacaatcacatctgtgcttgatcatcttgcggaattaccccatgtttatgacaaggttttacaaggtagaaagtactcaatctgtttagttgtgattagggttatgattttgtttactgagttcggtttgtgttgatgattagaacaaatggaaatcgaggagtcgaaaggagcaggggagatgctgacatggggagatgttcagaagatgaagtatacttggaatgtggtgtgtgaatccatgagattgtcaccttctgctcaaggaggttttaaggaggttcttagggaatttacctttgcagggttcaaaattctcaaaggatggaaggtacattaatgatataaactaccatacttgaaaaaatatcaatgatgagtacttatgatgggtgttatgtggtgatgattaggtattttggacggtgaattcgacgaacaagaacccggaatactttcccgaacctgaagagttcgacccgtctagattcgaaggtcatggaccgccacccttcacgttcgtgccatttggtggagggcctcagatgtgtgccggaaaagagtatgctcggattgaaatacttacatttttgcataacgtggtgacccgttttagattgaagaaggcaaatcctactgaaggcctcaagatttgcctcgaatctcatgggaaaagagtaaagacacgatcttttgcgcaagactaagtttgctttgtacagggcgaccaatgcatgagcatgaattctgccatttttagggaagtttcagtttgtagtagttagatgccacacaaaatgaatgattttggctgtatatattagtaattgagcaccctgatgaatgtaaatatatgcatgtaaatatgtgttgtcctcttcttcctctgtttctggctttgtttggtttttgttatttttttggttactcaaggaaggctttgttggaatttgcgattgtcctaattactgtcattagcctccttgttcttgcgctcatcttgtcgaaattcaagactcggatgaagatcaagtctagataaacgcgtacgcgatcatatgaattagaacaaactctccactttcatattcaaaatttctgcagataaatgcatcattatattcgcagtcaaaggtttgattgatcaatgtgttttgcatatctctctgtttgtacttctccagtgcttcctatactaaaggaagatggtgaatatgaaaaccctgtagaagacacatgaaaaggaaagatcagagtgttcttatgaaaatggcaatgtccaatgtctgtctaccttaaagacaactctgaaatccgtaaaggataacaaatttgtggtttttgtagttgggctgttttatcaaatacaatgtagaagtctgaagccagggtctatttatcatatacaatgtgatacactcatatagtcatatgtttgagacagtagtgtcaccattaaaattggattgttgcaacttgcaagggttgaataatctaatcttcatttgtgtacgaaaaatttataacaaatgatgatttagggtgtgccaaatttatggataaaaaataattagcgcccagttctttgaattggtaaatcttttcaattcaattcaatctaatctaatccaatgcatctaaatctcattttaaccaatccaaagaatatgacctttaaagttaaattttgataatttttggtaatttttgtcaaatttaccctacctaatatattaaaattaacttttttaactttaacaattttaggtaaattttgataaatttaagtaaaaactagtaaattctatttacccatcaatttgacaaaccgtaatagtaaaagtatttaaaatataacgttcttaagcctcgttttttttatggctgatgggtttgtagacatcgtaccataactttcaaatttccactacaactcaccataacctatcaaatttcctttttattaaaagtgaaattttttcaaataaaaaatcaaaactttcattttattgcatctactattattttcaaattaaaatatctcgaccgaccttcaattatttcaccacaactttccacatttcaccacacttttcaaatttccaccacactgcaaccaaccgcatagtaaaaaaggagggggccttacacaaaccattgatatattagcaaaattcatggtaattgcaatttaccgaaatttaccagtttttgtctaaatttaccaaaatttatcaaagctcaccagaaattacctaagttaaaaacaaaatttttttttgatatattaatgtaattttgtcaaaagttaccagaattaaacaaaagttaccaaaatttaacttttacctaattgctttttattcataaatttgacacactagtacatttttttttctttttctaaaaaagagaaattaaatcattaaaaaagaaaagaaaatattctgaacgggtgtattttcggaccaaatggagccctagaaatggtgagctcactgacccaactattcaattcttcatcccttccgagctgattgctgaaacctgagaaaactatcgattctacaccctctcgcattatcctctcctcttcaaattatctcctttgttttgagccctataattttagggcatggagagcaatttagccctagtttccccaaaaccccttctgggtttaacctattcacctaatcccaccaacctttcccccaaacagacctttggcattcctcttctccccagaaaaccttctaggtcgctctcatcttcagcacccaggtcaagaacaacaaccctttttgctttatctagtcccaattcaggaaggaaagttgtcgataatactagtgataatggaaaaagaagtaatggggttgctgcatttgcaagcacttctacatcgaacaagggtagtagtatgcaagagactacttcggttggtgttagtccgcatacttatactcccccaccaccttcccagatgtaatttctctccgattttgtttctgggtgttgttgaatttgttgtttttgggttgaaagttgaatctttgtgatgtttttgatgtggctttcagtgggtcgcctctgttttggattggtgttggggttggtgtttctgcactcttttcctttgtggcttccagagttaaggtgagttttacactcttgtaaactgagtgaatgtctaacttcttaatggagagcagtgtgatttgaatgatgttattgaatgaagtaatttttgtgtttctagtgtaattgggttctcttgttgtgtccaatgtagtctgtgtcatcaccttttgcattgtataaattgaactcctgtgccctatggctagcgtatttgtataaattgatcaaattattgtaatcagtattctgtttggaagttgtggtggattctgcaacaattgagtgatcgatcatttctgccacgctgtgatcaagctttcttatgttgcttatgttatggtaccaaacttttcaggtgattcatactcaataatctgtgtagaatgtatccatctacttgtgtgcgcctgaggattgttcttctgccttgctttttgatgactgaccacttactagcttagtattatcagtggagcatatgaacttatctagtctaggctgtggtttttgatggctttctgggacgacccttcctagtggtgtcaaaaaggccctatataaggtttactggtaaaatgtccgtctcatgatcattttgagactcgacttttgtttcctctttcagcaatatgcaatgcagcaagctttcaagaccatgatgggccaaatgggcactcaaaacaatcaatttggtaacacggcgtttccacctggatcaccttttggattccccccttcatctgcatctggaccaagtgctcctgccggtttccctttcccaccatcatcagcaactcgaccaggtattgttactggttttccttatcaatcgtcatctacattaggacttaagtatccccggtggtttcactagtgcatgctatctactgcagggccaagtgccttcacggggtcggctttttctactgggcctgtccaagctccttcttcctctcctccagcctctgaggctactgtcactgtagatgtttcggcacccaaagtagatactgctgaacctgtggtttccaaagatgagactgaagttaagaccgaggcaaaacgatcgggtaatatttttttcccttttggtagcagtcttacccctacgttttgctatttaggcagactggttccaattgagccaagatgtaaaaattgttcacaacctacaactccatggaaaagaagcataggtggtttaacaaggcatttcactttagtccattacaatctaagttgaaagaataatctttttcaactatctggattatggacatagggagggttgaatgaggcatttcactttggtgttatcaaatatatttttaaaaaagtgctgtatgagggggtaaaagcatgagaattgtacatatttggacaccatagtagctttgtaacaccccaactatcctttcaaactagatcttctgcactctttcaatgctggcctttacgaataatatgtggttgctttaaagctgctccactcttcattgagtgagtagtagtgaaaactggttttgacgagtgttaactgtgcagcttttgttgatatctctcctgaagaaactcttcaaaaaagcccatttgaagatgttgtttcttcacaaaatggagctgcctcaaaggaggccactacttcacagacttcacaggaagcaacttctgattggtctcaatctacacgtaagtgacactttgaggcctaatattgatagttggtgcagatcttcatttgttcaagttttagtcgagtatttgacattagttaatatgcaaacaagtggccttataattgtttggaggctagtcgaagttttgaggttggcttttaattttctcatggttgtttattggactgttcagcctcttcgtgttttggtgcggttttcttagcatcatggagtaatgcttgtgattctgtgtgctaccaggtaacacgggctctcccttatctgtggaagctttggagaaaatgatggaggatccagccgtgcagaagatggttttcccgtaatataaccttccattctagtgattttacagtgttaccttttgaatacctactttggctttcaatatgaatgtcctatgtgaagtctccttctttcacatacaccaacatattcaaaatgaggaggcattccatttgtcactgtcgaaatcttctattgcttttggcggaaaaagaaaaaaaggcttttcccagaaagaatcttatagtttgtgaatgagttggtgggttctcaaatgatagtcaagtgtcttcaagcatgtgtcctgataaatggtctggcaaaatagaggcttgaaacctctgttaatggtttctgaaagtgttgtcattgccatacaaatcactggacaaagtttattgtgtatcttagactcttagacctagaatagctttgagtagtagatctattgaaatgaagatgatgggcatatcaagtgtatagtggagtgcggagcacataattatgtaattattttcttaaattttctcctttctatcgcagacatttgcccgaggagatgagaaacccagctacctttaaatgtaagtctgcagcgtattcatgtgtcatctgtgtcgtaattatggatacaaaagaaatcttatgttttgtgtgaggtcactttcgttgaactaactggtcaatatccgtcttcctctctagttttttcttggtggcgtgagatcttagatgcttcttgttttgctgcttcttctgtgggaagcacatgatgttacaaccttagtgatgctagttttgtttcttcctttggaaacgtgtgatgagatgtttcctcttgacctcctgaaggttgagacgggaaattgtttggtttttccatgttgaaagcatgattgctggtgctcctctagtcttatttaacctcagaattctgccttatctatggtttgatgacttggattcacttgttttgatgtctcttctcatagtaaaaccaaaactgatactccaaaatcccccccatgcgaggtatcgaggggtcggatgtgaaagtcgtacccctaaattatgcaatttagagagacttgtgccaattgacccaagatttagaaatagttcgctacttactattccatggaacagaagcagaggaggttgtttgagacattttacttcagtccactacaatctaagttgtctcttctcataatgttcaaacttaatttatgcgagtgattgggagcaaaatctgatatgtattgcagcaacgaacagttccctataggttgcactaaactagtcattggtgagaacatatgatctgccattatgggaatctattgagttcaattttctctcatatggaaactgctcccttcatgcaaagatagccattgttgctagaaaatatctgtgttgacattgactgattcatttatggtagattggttgcattcttgcgtacccgttagcttttcatgtgatttacactactctcgagactctaaacctaatttatggcagggatgctacaaaatcctgtatatcgccagcagctgcaggaaatgccgtgagtcatcctttttctctcctccttttcttctctggatctctttcgtgcaattgcgcatttgatcatttttctggttttctgttctcattggtgaaacttccgtatttgtattctgctagtaatccactgcatgtttcaaaatatgtggaagtctggcctgcatcggcgcatcgcacattctagttggatgcggtgatttccttgagcggagtgatgctcattgctataaatgtttctctaaccggataattttccttataatttttttcagagataagatggggggaaacgctgaatgggacagccgcatgatggaaactctgaagaatttcgactttaatagcccagatgttaagcagcagttcggtaagtttcatgtttcaccattactcttagcatcccttatatctgataatcgtttgggatcatggtcaaacccagaaaggttgtcgtatcttattaatcattcatgcatggttaatcattctagatgaaatcggtctctccccggaagaagtgatctcaaaaatcatggccaatcccgatctcgcaatggcatttcaaaaccctagagttcagcaagccattatggacgtatgctctcttccttttccagcacatcccttatctatcttatgatttctcacattttccgtttttgattatttgtttttccgttccagtgttcacaaaatcccatgaacattgccaagtatcaagatgataaggaggtaagcatagtttttccctttgactgtaacttctatcccagtgtcggagcttcggtggttctcttggtctttctcggtggcacgaacgatccggtttcttatttttcttttacttcttttcaggtgatggatgtcttcaacaaaatatcgcaactcttcccagggacaccaggtccaggtggcttctgatgcttcggacaattcgacttcttttaccacgtcatcaccctgcagttactgtaattgctggtgtgtactatcatctggctattcagcaggccaagtgaaacagcagtcgggtatatacgggtatggtccaaatatggggtcatatatacgggtatggtccaaatatggggtcattgtatttcaagcccgagtaaaatatgggtcggatgtatctcgttagcacagttttgagtggcctcaacaggtttataatcttttgtgtttctgagtcaatggtgctagatagatagatacattatttaatgatttgttaatcatctcttgctgataaataaggtatcagtaacaatggaacataatatacagtacttgagatgttgagacaatttgggtaacaagctgagtttctaatttgtaaattgtcctgtagattggttgtgtgccccactagacttgtcaattcgggtgggtgggtcgggttcggtatgcacgctgggtcgagtcaacttttgccaggcctagtccctacattctcgtctcttagatctcttgaaagaatgaactaccctgtttcttccatggtagcaaaccgtacttaccaaaaattaccacactattcacaaattatagtaatttaccatacaatatcacactttactataataatcataacttttgctctctaacttttcactttgctttttcctaatctaccacactaccccgttcttttatgcggctggtaggctgtggtgtcacaccgcaccacaacccaccacaatctactacaacctatcacaatctaatttttctaatttaatttatttttttattaaaagttaaactttccatatttaatcataatccaccacaacttttcccaacctatcacaatccaccacatttcctctacaccgcactgcaaccaaccgtatacaagaacggggcctaattattcttatcacaaattttactacaatctacctcattgtatcgtaacataatcatgcttcccacaattgaccaattaccataatacaccatttgtatattttacccattgcagaaaagaacatgacctatgtattgtattttactaccctaataaaagaggaaaaagcaaagcaggcaaatgtgtcatgaaagcaaagatacaaggtgtaaggtcatttttttagctctcttttttgaatcattatcaaaatgtgtatgcaaaagatttgcttattggaactttttaggttgattgtgaatgtatcttgttgtcctaacatacaatgttttaagtccatagcaagtgtttgacttgtctataaagtgggatcagtattgagagttgtaaaaatactagttagacaaatttgcctggtttggtttaaagtatgttggactttgaaatgaaagtggagtttaaagacatttcactgtagtttcttgttaatggtggtccaaaaagaatggtttatttcattatttgtgatgtatgtgtttgaagcaaattcagatgaatgactaaaattctcataatggtcccaaatgctaagttagagcttccccactaccatctacttaccatttttatcattggcaactttattattactaaatacctgttcttttcattgaaactatattatttgcgatgtatttaagcctctccatgaacttcaaattatgggcgaagactgtttatatctggatcctccgaccgtgcttaaaacgtgttttagttggaattgttgttgacaatatattgtattttgggtactgtcttatgtatttttaacaaattgtgttcatattttcttgtccgttagatgaagcgttaaattccttgaaaaaattactaattatgtattgtattgggttatggactataatatactttactttgaggttatttataatcatgcgctgtactatttgtttggattctgatacattgtattatggagttgggtgacgtcggtgcactgaacacggggatctttcatgactcattgtcatcgggactcgctctaagtgcacagactgcatctagccccatagtacagtgtattagagtctaaagaaaagtatattgtattatttttcaatatcccaaaatacagtatattgtagtctaataatcctattgtattttacccttaactaaaacgttgttatcactgtccaaacgcatgcaaaagatttgcttcttccaatttcggttgcgtgcaaatgcttgtcgttgtctaagctccatactatgcatctatccctttagcatatgcgtgaaatcaggcatcggattttcaacctcgtaaaagtgggagctgtcagctgtatgagagttgtaaaaatacgacagccaagatacaaaattgtatacttagactaacataatcttgaatatgaaaggaaataataatggagattattgacatttcactgtagttgcttaagttaatggtggtccaaaaaggattatctatttgtgttgtgtttgaagcaaactcagattattggctaactcttaatggtcccagatgctgtgcgaggactgcgagagctaccgatataacaatttgggcatgattttcgagtctttgttcgacattcgtccacaaatctacttggctagtttttcatggggaactttgctgctgttgttgtggttaaagtggtttcatttatgcctttaggataggggtggctatctcaaacctaaaccgaaatgtgaaccgcaaaactggtaaaaccaaaccggtaaaagtggttaaccgaattgtttttttgtaaaagcggtttaggttaaccaaaccgctttgaccggtttaggtttaggtttaggttttggatttttcaaaaacggttaaccgcgattaatcggttttaacctttaaaatttagatgatatttgttttgaggaaccatgcaatgacctttctagcgtatatgtatatcagtatatatagaaaaattgaattctaataatgcttattttcaccgattgtttgacaataatttatagggaaattggacggtaatacaccgacctttaggggtgttgaataacaatataccgaccttcacttttggacagtaatatcac

SEQ ID NO: 905 - DNA, 5124 bp, Portulaca oleracea
tttctgcatccaaagtagaagctgtagatgtttctgcatccaaactagaagctgcaggacctcaggttgtcgaaaacgaagctgaaactaagactgaagcaaaaaaatccggtattgttcccttgctcctagtgcttctgaattttgtttcttaaatgttgaagtaagtatcttggacaacagaacgtcaaatagatagtaacaggaattatatttatgttgggattagagttggcaaaattttgtcagacccgaaaaaaccgggtttggtcataaatttttcgtccgaattttgacattgaccgaatattcggacactgtatttttgtttatcctattgtccaaagtccgaacccgattatgacttggatttagttcccgtctgaattgtccgacccgaaaaacggggttcgggcatcaatttctcgtccaaatttcggcattgaacgaacttgactgacccgaatttgacccgtacccaaattcttatcagtgctagttagaatacttataaatgttactataatgacatctgattccattttttcagtttcttagttgtagaattgctttaggatattcaatcttgatgagaattttcatctgtagcttttgtggacgtctctccggaagagactttgctgaagagcccgtttgaggacgttaatggatcatccgcaacgccagcaagcccagcatcctctgctgaggtagtgccgacaacagagcctgcagtttggcatatttgtttgacattgattgtgtgttggttaaccttatttgctgcaggtggaggtggtacaaaatggagctgcttcatatgaagctagcggtatgaaggaagatgcatcttcaggttagttgtgacttgtgattgatgtgtggtttttgggggaaaaaaatacagatgtgaactttttcgtctttctcaaatgctcgagttgtgattttgttgttagagatattagtgatcttattgtagttgtttcagtcttccaaggaaactgcatgtgtaacttcttcatggattaatgtctgtggtcttgtgtgcaccaccaggaaaacgaagttctatcttatctgtggaagctctggagaaaatgatggatgatccaactgtgcaaaagatggtttatccgtaatatatcttttaccaattctgctttataacatatattgtttctactacttctgtttgatgcatgtttccatttgcaatcacaaacatcttttggacttcgaatttgaggatgctatgtcttcgttcctcaacactgctagttttttgttccgtggttttctgttcattgtcattctcggtaacagtactagtaaacctgtgatgtgatgaaattatgaaaataattttaaatttttacttgtcttgttgcaggcatctacctgaggagatgagaaatccaactacctttaaatgttagtatttctcatcttgaccttcttgttgatgatttcttacatttctgcttaaaccatttagggcaatcaaatatttaaaactggcagaattcagaccttatgtttgttcaaaatatgaaggtgaagagtttttatcaaacaataatatccgtccaaaacaaagactttttactccatattcccactttttacttatgaaactcgatgtcaagtttgaaaaaacttgctctatgttcgtttgctgcaaattgagtgggatgagactgttatcgctatgtgaatgcgagtgtcattctgccatttgtctgggtgacttagcagtacttttcatgccagggatgatgcaaaatccggtatatcgtcagcagctacaagaaatgctgtgagtattcattttcgtcttctctacgtttgggttttcctgattacttgacatcattctccccaaattctatgttatcattactgaactctgaagccgatataattgaacatatacctcaaataatcattaacgaaatcagcttttctggttgcctatgtcttggatcttcttaaacgatacttctcatctaagttctatgaccaatagagattctgagaaaccccgagtcatgtgatttttgcttttcttttctgtggtctcttgtgtcttaattcctacattttagtgtctgtcaagagtaaaacacaacaacaaactcttaggagaaacacgtttgagcgcaaccttttcccccatgagcatggaggggccgattcatgcggactcacagaaagcctttcaaaaaaacaaccttaaaaaccgtgtctttgtcaagaatgatgagtattattcccttttcagagacaacatggcaggaaaccctgaatgggacagccgcatggtggacaccctaaaaaattttgaccttaacagtcctgatgtcaagcagcagttcggtgagttggtgctttttctcgcaacattgtccgaaattaccgtttgatgggttgactcctttctaaagctttcgatatttgtttggtagatcaactcggagttacaccggaagaggttatctcaaaaattatgtcaaatcccgatcttgccaagggattccagaaccccagagttcagcaagccatgatggatgtacgtaccgagcccatattttagtttactattcgtcgatgtctatttgttcttttctttctccaccgattttcatctctaacctgttgttgctactactaatgcagtgctcgcagaacccttggaatattgccaagtatcaaaatgataaggaggtaccatattctactttcttttcttcaaaaccaggaaaaaaacactcacttccattgtagcaggagaatgagctttagaaatcttcaaaaccggatttttttcccatttcagtaatcttccccctcatttaacctacaaaatgcaaaatttctgatcaaacgaaaatgacgcgagcaaagacatcatcatagggttggtattttcaaacagaccgttgtgcgcgtttcttctggcatgtatcatgatgcaactcttgcttgtttgtgtttacttaggttatggacgtcatcaaccaactgtcacagctctttcccgcgcaggggggcccgcctcctttctgatggctgccataagccatgagattgtctgaaatcggttagtttgattgatatcagcagccaagaaaatcgatactatgatttagtcgttgtgaaagttttggtaaacctgcccttttgacgttttatgaatctagttatctagatatcttattcttgggagatctatcttctgttgttttttatgaagattgctttagatttgtttatatattatgcattagtttaattcccacattgattaattttttttttttggggatttggattgatacaagcatgtacataagattttaagaagtaatgcatatctttatgaggtgtggtgcatttttgtttattgtgtaagttgcttgcttgttttgataaagatttggtcaactcttttgttgtgtttttgaatcacaaagtgtattggatcaccacatttatttatggtttcatcaatggaatagtggggggatctggttgtacgaggtgctagctgttggtgatttgccttggtaatagtcttgggttaaatagtttgaaactgaatattaagatgtcaaaagtagttggtttaaattgtcttgcattgtagacggtagtgcagcgtagtttaggtcttgaggtcgtggtaaattgaactttaagattctatcacaataaattgaattgtgaaactattggattacaatttactatcatagagttgagtgaaattaagtgaaattaaagtatgacatgttggatttcagtaggtctgacatttcatgagttggattttagtacactttagtgtgacagatttgattgcagtaaactaaactatgcaatccaccaagttggttttattcaattgggtggcagtgcattgcagtcgaatattttcacaatttggtttactgtgatgcaatttcaaagttcggcttatcacaatctcaagacctgaaacgcggtacactatgatccatttttaaaaaaaaaaaaaaatcaaagacatcaaataatgcaattagtagattgaaaaatatgacaaattttgatggatggtccattaggaaagttgggttattttgtttgtagatggatggaaacaaaatgtggtcaaataaatggcttgttatggctataccaatggtcccttagataatgccatgcacatggatgcatatatagaggctaaggttcactattgtcaattttcaagctctaatatcctccatatgtttgtgtactctcttaccactttgctctttcatttgctatttgggtttccacattctaatctccaaatttcctttgtgggtctaaaggccaagttatatagcctataggacacttgttataggggaatttgcctttaagactttggtttcttttggtttgattggttttttaaaaacatttaaagataagttttaaaatttaagaagccttttcttgtaaaattctgcttaaattatcctcgtatgaaatgttggagagatttttgtaatggacttgatcccattttgcaagtctatctattgttcgattgtcttaatgatgaatatgattgacaaaacattttgaaataagtacaggttcttttcgattggattaatatgttgcaccttacttaacaagcgacatcattgaatgagatatatttcagcatttttagatgtatattgtcatcttcttagttcaataatgcgatgggtggaattgtttctcaaaaaaagtagcaaattaacaagaattaattatctgtaagtctatcttatttattggataaaactcaacaagaaaaattataaataaggcaatgattatgaagttttatacaatttatcttacatttacacgctattttcttttattaaatcagaagcagaagcgtggtagacccataacccacagattccatgatcgaaacctgactctgatagttagagtggcttcctataaccccatattttaaaaatgttttttagctgtcggttacaaaacctgtccatgattataattataatactacaataaagacaagtgatatttatcttttggtccaaccccattcttttttttttt

SEQ ID NO: 906 - DNA, 1982 bp, Senna obtusifolia
accaaaccaacgctcacttgccgcttcttctctttctccttctccttcacgtcgctgagctgaaagttgaaatcccagatagtgaagtgtgaaattttcagaagttctcttactccccgccctttctcttcaatatcttattccgcttaaccctgcagtttcagtttattgcttaatattatttagtttatctgttcttttcggcttcatatcttgcaagttaattagatggagaatcttaatctaaccctagtatcttccccaaaacccgccttgttgggacattgctctgctagaaactccactgtagacgtcttcagaagaaagcccttttcgtttggaatttcagtacttgcgccaccgtattctagatattgcgtgtctgctatgtctcgttctcatgttacccgggctgccgctaaaccccagcaaaacccaaaatctgcccaggagaagctaatactgaagcattttgctagcatttcttcatcaaatagtcaagaaacatcgtcgattggtgttaacccacaatattcagtgccaccgccatcgtcaactatcgggtcacctctgttctggattggtgttggtgttgggctatctgcacttttttcatgggtatctgcgagagtaaagaattatgcaatgcaacaagctttcaagactatgatgggccaaatgaattcccaaagtaaccagtttaacagtggtgccttctctcctggatcttatccatttccaatgccttcagcatcaggacctgctgcacctgctgcttcaccaggtgctcctcaatctcgagcatcttcagcatcaggtgtgtctcaatcttctgtcacagtggatgtacctgcaacaaaagtagaaccatcttcagccaccggtgtccaggacgaaacacaagcaaagcaagaacccaaaaaaattgcttttgtagatgtttctccagaagtaactcaagagaaaaatccatttgaaagcttcaaagatgttagtgaaacaagttcatccaaggaaacacgggttcctgatgaagtctctcaaaatggggctgcctctaaccagggttttggagcttcacctggttctcaatctacaggaaagtcagtcttatcagtggaagctctggagaaaatgatggaagatccagcaatgcagaagatggtttatccttacttaccggaggagatgagaaatcctactaccttcaaatggatgctgcagaatcctcagtaccgtcaacaacttgaagaaatgctaaacaacatgggtgggggcagtgaatgggacagccgaatgatggacaccttgaaaaattttgacctgaacagtcctgaagttaagcaacaatttgatcaaattgggcttacgcctgaagaggtcatttcaaagataatggccaatcctgatgttgcaatggcgttccagaatcctagagttcaagcagccatcatggattgttcacagaacccgctgaacattactaagtatcagaatgacaaggaggttatggatgtcttcaataaaatatctgaactcttccccggagcgacaggttcaccttgattcgttggtgcgctgcttttaccgggttaaagttattcttgcctttccagatgagcaattgatgatcactacttaaaccacacggaactgcaaaactcttctattgatggtctgggctaaattattcctatagtagatttatactgcaggctcgctgttatagtatccttttgacatattaggattaggacaaatgactagatggtctgggctaaattgttcccatagtttttcttttggtgagttagctaaaaaattgtgtattgttttggatatcagtctggattttgcatttttgcttgctgtgagtagttcttggatgtagctgataataagactacactacatgaaccagaaaaataaatattaaagcatttattgtgtaagcgtaagctgcatgagattttaccaaatta

SEQ ID NO: 907 - DNA, 606 bp, Sorghum halepense
tggatgctgcagaatccaatgtaccgtcaacaactacaggatatgctaaataacatgggtgcatctcctgatcaatgggataaccgcatggttgatcacctgaagaactttgacctcagcagtccagaagtgcggcagcagtttgcgcaagttggcatgactcccgaggaagtggtatcgaaaataatggcaaacccagatgtagctgttgcattccagaatccaaaaatacagacagccatcatggactgctcgcagaaccctctaaacattgtaaaataccaaaacgacaaggaggtcatggacgttttcatgaagatatcacaaatcttcccacaaattaacggctagccgaacttcatcgcgggattgcagttctgattttttgtcggcccatcatccatctcctgtctggaggactgctgcggtttccacgtgtcaagaaagggaacacctgttgggtcatgacgctccagatagatccctcactgtgtcaaggtcctttgagttgcctatgtacgtcgtatgatgtagcggccttggtttagctatgagtatgaccctactttcataaagtcagtctagcgagcatagcagggtcaaagg

SEQ ID NO: 908 - DNA, 690 bp, Sorghum halepense
ttgatcacctgaagaactttgaccttagcagtccagaagtgcggcagcagtttggtgagtgaatcgaatgctttctacataacttgggttttgtttggaatacatgaattctgcaaaaatccccgtactatgttcctgcctgcgattcattggtacagtaattgttgtcattctttgcttcgaatatgttcctctgatgtgaggctgccacaagctaacatattgagatttgagaatctggtgttcttagaatagtcggcacatgcttatgttagcatagtcggcacatgcttctagtgtttgcaaggcaaggtaacagttaattcatttagttaagaatctgtgcttctgtggtatcatttttttattgtttatcaaagaactctttagtgcaaatttgttcattggttatctgagatatgaactcctaaattatttgattgcttgtacagcgcaagttggcatgactcccgaggaagtggtatcgaaaataatggcaaacccagatgtagctgttgcattccagaatccaaaaatacagacagccatcatggacgtaagaccctgtagaaactcatctattatactgctttagtcattcgattcttctgacatggtgccgtcttgatgcagtgctcgcagaaccctctaaacattgtaaaataccaaaacgacaaggaggtatttcta

SEQ ID NO: 909 - DNA, 11314 bp, Spirodela polyrrhiza
ctctctctctctctctgccaatccaggttatgttttggcttcgtaaaaagcctatcttaaccacccccactatcaagcttgagtttggtgctgagcatttatgctgccaattttatgttatgccattacaatatctgtaaattatcaatgcgacccttatgtcttccatgtggatatttttggactttcaaaaagactatgggagcgttgtaatatagtctacaaaaccacatattgtaataaaaaaataaactggatgaataagtcactttaatgaccattatggactatttgttactatatatattgcttagtttgtgggttttcacctgaaaaaatgtgacgatagtggagagttgacccagatttgattgggagggagccattgctaagaattgagagagcgtaggaggggtgaagaaatgacaattctctccttttacttcatcttcgtccttgtcaaatgttaatagctgtgggagattgaggagggccaacaaaaagaaggtagagagagagaattgttaatgggtgttttagtcattttaaatatgattgaataaaaaaattagtaaatgacaattctctccgtccacctcatcttcatcgtcgccaaaatgataatgggagacatggagagagaggccagggggattgaaaagggccaacaaaaagatggtagagagggagagaacataggatgggggtattttagtcatttttatgtaggactgaataataaattagtaaattaattttagtgttcattggccaaatggaggagtttaggagaaatagaaagagaaaatgaaaaatattcggtttttactaacgagttaaaaagtttctggcaagttaaaaagaaatattttacaaggagaagctcaacgaaatgaagtacaaatggaaaaataatattttcaggggtcaaaaggttataaaaaaactgagaagcctattttatcgtctaagactctgggacgttttcccttagccatttcttccgtcttcctccactggcatctgctcaggccgctgcccgttacagtgctcccggggaggaggggggccggggagaggacgacaggggtttaggatttggccgtccctctgctattctgctcatctcctcttcgattcacgatggacggtctctcgctatcctcctccaaatacatcgtctcttgtcccctaaacccccgtcaactcgcgaagccgtcgctgtcttctccgtgtctcccagtcctgacgagggaaagaagcggttccaggaggattagatttcgcgtctcgggccgcggaggggggagcgttcagggagcttctctcaggtcctcggagaaaggtaacgactattgacgacgagttgttgtgttatcttgacgacagtgagctcgagtatcttttttagctatgccttcgcgaacaaagagaacgcatgcgagttttttaatcgacggggagaagtattgaagtagtcggcattaatctgattcattcctgtaaaaaggggttagcttcattcattatcgtttactttggacacatttgaattgccttgtacccctaaagtttgtatgtttctaaagaagcttatttatcggcgttaaaattttttttctactgcaccttagttctggcacgaccttatgcgggtacgtgcacctagttataatttctataatttttttctcgggaatacattatctcagtgattaaaaggtctgcatttattttcccactgatatgggctctgagtttctcagaccatggtaatcttttcctcatcgtcttgcaggtcagacagttgaagccttctttcttgtccttcttattttgggtcatagaatcgtttattcccatttaaattctcatgaattttgagattatattgactgactctttcgagttaagaaaaatatttcatattgtcctgataaaaaaagaaaaaaattcattactctggaactgcttttcagcttgtgaaaaggttcatgaaatgaaagataaggtatgttgacatccaaaggtgcctgtagaaactaggtcctgagttatgtagggagactgtcttgtttgccgaaatctttgcgttgattttgtgatgaaaaatggtattgtttctccaaatctgacggatatctggagaaggaaaagaaaccctgttctcctacgatgattattggccagttctgtgatatttactgtcgagtatgacctttgggagcttgagaaggtgggaagctgacctgccttctgccactaagcagggacaggaggttgtttccactttccagagcggtgggcacagagatcccggaatctttcaaaattggattagagatggtaggagtttatcacgggagagtcattagtcttgcattagtcgtataccaaattaatcttcttcgtgaacttaagataagaattttctatcaattcatcagctctgatgaactgacctacactcgtaggtgtgaagcacatactctaaccatgtgatgctcccagatttctatgattttatcacggaaaaatatgatccatcttatcctcaaataatgcaaaaattttaagagatacccttttaatgttttacttctctatgaagcctgatgattttgcaatcacgaccttgacacaaaatcctattttcataggttaatttaagtttttacaatttatgctcacgatgaaaaacatgatacatgtaccctgggatcttgcgttctgcacaggtagtaaaattaaggaagattggagtgtgcaccagtcagggatttgtcagcgcaattttcaaactaaatttgaagatactcctggctcagcaagagtggaataaaaacattaacattgagttgcaaacactaaatgcttatgttttcatcatatttctcccttcctggccctcaatatgatatactgctttatgtttgcaaaactttgactgccaaattcggcctcaaataggacataaatgtgctgaaaataaaatgacacgtttagcaaaatgctgcatgctgaattttgtgagaagtgtgatgaacccctagagtgagacgatttcgtggcgcagaataaatggagaagtcgaatcgaatataaggttgttatatttagcatgtaaaagagttattggtacccactagacgctgctgtaatgctagtgacggaatatacttgtcttgccaactgttcaatctttaaatgatattatttgatctgagattcacaagattttttttcctgtcacaaatctcggggaacgattctcggtcactagcatacccctgctagtttgacccattctccttatggcttagtgtgctgcaaaaaaaaaaaaacgaaccacctcactcttttttctggttttgatcaaaattgcctctgatcagatgtgtatcacggaaactgggagggtttccttgtggcctaacaaacatgctgatagaaggttgaatatcaaatctacatttagcccaaagctaaatgaagtagaacataaaagaagaaggaaagaattgagatagccatctgatggagagatctgctggaatcgcccaaatatttgctggcttcactggtctacctctttaggaagagttttatttgaataagaagtggagtagtccaactattcttttcaatattataccacggtttcgttgaaatgccaaaaaaggatgcaatgctaggaaatttcgttgtatgccttagagagaatatggtttctttaagaaggctacaccgagtttctgttatctgaatcatagttttctatgtgttctacgtttcaattcataatagatctttttatacagcaggattaaagcaggcttttgcaagtgtttcatcctcaggaaatgctgaaacttcttcaattggtacaccacaattcccaataccacctcagaggtcatcacccatgtaagcaattctactttttcctggcgtccgtatctttaggattgtagcttttcttttttatggtgtgggtcttttctatctaaaagagatgtggattcacaaatgcccttaaatctttttttttcttgttatttctaacttttttttcagaggttcaccattactttggattggagttggagttggcttgtctgcactgttctcttgggtgaggctctcaattctgacttattgccactggccccaaattctattcatagtttcatgcattaaatttctattgagattttcttgctaacagtctgatctgttttttaggtgacgggatatttaaaggtgagtcttctcaattttctttgactttatcgaggtatgctgtcagcttgagtgatattttttatttatgtgcaactatgacatttagatgcatcaattagcctgaatctataaaaatatacaatcaaatttatggtttgatacatcccaggcttcataatgtatttattgatgagtctattcatgcaggtggaaacatggatttcctttttttttctggcaatgctttgtatttttcaaggggaagtttgttatatttcttactatggttggaagttgatccacttttcttaactgatatcaggtggcctgattgcagctgtccccatgcattttatgcctagtagaaatacagaacttgtttatgctttttttttctttcacgatagtgttataaggtggtaagcaagatactgtccatcatccttgatatgtggtctagagagcaagaggcaaacagaaaagaggaaacattaatttatctccacgtttaactaaggacaccttttggatgaaggaatatttacataggttgcatgaaggaatgaactaattaacttttcctttaccgtgtcctgcttggccacaacagttcggatactaaagtgacgcatcaggtaggtaaagcatagcgaagaatagtttccaaggagcttacgagtgtaaactaagctcgactatttttgaagttcatgcttgacctaaatcagacaacctttgatgcttaaaacatcctcaaatttggcatcatgaaatcaattatttaattgataggaatataaagagtcatgtaaagtgctcatttgggtatatgtgaccaccttgcggctgtgatacatttctaacaataattcaagtgtttggtctctgtttaagttttaaagaagagttttggttcctctcgtaaggaacatacatgtaatgcatggactggggtctgtcttcgatgcaatttatcaggactcatatggggcgaacggcagaaaaaagggggttgatatggtatggcagtgatgggggtttggggacgttgacagcactggtgtgtaatgaggcatgaagagtggtggcgaatgatagaggtaccagatgtagaggaattggaagaaatagaggaacataaggagccggcagacagaaaattgagtcctctggaaattggtaggttggaggtagtgcagcaagttttaaaggagagaaagaggatcctcagcactactttgtgagagctgcgcgccgctatggaacatctgatacctctgtggtagacactcctcactggtttatgccgatcactccttttttttaataatcacggtcatttctctgtgttattgtattggtttctataaaaggtcataacctagtagttgatcctcttattccctcatcattagatataaaggctgagagtgagaacatagagtaacgatttaagttttgaagtcatttagagtaatttgttgaatattagtttttattttttctcaatacgtttctttatgctatcttatgaaagaaactgggaatgaatcgctgtacccgtatttcactttgtgctgttaatcagtgctgcatgcttaagaacaaactgaactttcaatatttcagttgctgtcatcccttgtaatattatcttttgttctcatgaagtttccagtgcttcgtgttcttgtttctttcatctggaatgtcttttccactaatgccacttttatcgttattttacttgagagatgattccaactctgggactaccatcaacaggatgcacaatggacaagaattctgagccaaggaatattactgcacaaatacgaaatagtttcactcattttgtcgactagtgttgaatttcatttttatgccaaagatgatatgatctacagatggaattcagttataagatggaattcagatggaactaagaccagactataaatagaatatgcatgaagccagctccttggaacatctatcggatggatgcattttttttactgaactgttttttgtagttgagagaaatcaagacgacacataatggatgggatttcaatataatcgctgtttctcagtgttatatcaatgaaattataacactgaaatttcaagataagacattataacgctgatgtccattgattgcatttgtgtagactcgcgctcattgattgatatcatcttgaggaagatggtgggcgatagttgtcgaaaatttgctccttttctactatttcttattgttctaggttacaacagccatactttattttttttggagtggatagtgctgtgttatcattaagtgataacaagaaaagggaacaatgtttaggaaacaatcatacttgttattcaccaaatatctgtacttagtaattgcttgatgttttggtgtctaatttcgtcgttctcattgaacaggattcatttatacatcctttttcagttttttgatattccagaaaatacgatagaacatgtatgaacacttctcatgatcatctagcgtatatagatccttttcctgctaatcatatgctattttttagtggatttaactaaatcgtctatagacaacgaccatcagtaagctgatgataaaggcttattgcttcttgttgttttcatcgccggttttccctctctgttcatgggaaattcatttatggtggcttcttgtcttttcctgatgtccagcaatatgcaatgaaacaagccatgaacactttgatggggcaaatggcagcaggaaacagagaatccaaaaattcagggttctctccttacgcatttccttcaggcccctttccatctcaaatggccacatcacctgtgcgtgatgcgtctcaacccgctcccgcaattgatattcctccagccaaagtggaagctacaactgcgaccgcagtcgggagtgacacagacaaagtggatgaaccgaagagatatggtatgtgtttcccacagagcaaatgttttcatgacatgtatacaatactcaatgaatttgttgcccctgaattactctgcctttactttcattcttcttgggtttagaaccaatctccatactgtaagcttgagcagatatttggtgctgcagtacaaccaagaggtgtcttatgtaatagatggcttttggtaagaagggagggagggagaggcaggtagaagtttcatatgttaacttcttggcctcaaaaagcacatatcgtgctgtgttgtgcacgtatcttgtgtctagtttctttttctggtttattttcgctaatatcttactattgcagcatttgtagatgtttctcctgaagaaatttcacagaaagattcctccacgggttcaaatgcatcagtaaaaccagaggtcgttgactccgtaagtgtgtgtctatgattcctgctggacaaatttttgcttccatggatctgtaacaatgacgtttttctattattatttaaggtttcttcaaatgggagtactgttaggccagaccaaagtcgttcagaagagcagtatcagtctcgtaagttacaacctctttatgatcatttttattcagttaatttatcttgttaatatttagtattccacttctctgatgatacccttgaccgctcctattatgcagaatgacacaatgatttaatggatatcgatagcatagcgttcaaaattagctattctaataatccaaaaacgcatttcttaaatgtaaaaggatgctaccatttctatgacggcaatatttctgttattttaatttcacgtttgaaagttcaaataagtcttcccacctcccatgttgcacccgggccctgaaagaaaaagagagaacattctctcaattttacccctcatgttatgttgtaaagttttgtgcgtcatttgattgcactcgctgaataaatctctggattttcaggaacagggaaaacttcacccttgctttcagttgatgcattggagaagatgatggaagatccaacagtgcagaagatggtctatccgtgagataaattaccatttatcagcgttataaattttcatttgctaatgtcctatctttctgaacatgatttaacttgtagccgttctcatgcctattttctttgtgataaagtgaatcgaatatgtggttctgcgcgtgttatggtttatctgcctcgcagtggcttaaatttagccagttctctttttaaaaggaactttattgaactttaattactttctaggaacttcttcgcttttgtatatgactctaaaataatatttgtattctactgaaatttgtctatccttacattatatcatatcaataatttggattctgcaattgtctagctggtatttatttgtcctctgatttattattgatatttcggccaaaaacttttgggagatattaggaagcaggtttttcccttaggtcattctacttgtgaaaatagtcgcgcgacttcaggaagtaacacttcctctgcatttcattttagtgatatgtagagatgttcgttatgcaatctgcatcctcttggtgatcgtttttctcatgtaggaaagttttttgttcaataccccattagagaaaatgaagtttggttctatcgagtggctccaggactttagcttgtcttttgaagtgtgttttcttctcatccacattccatagctcgcctgacttgaaaaaggcttactgtgagagaattccagtctctgtgagtgtttgacttgatcagctttcctgaatcgcatggctccccacttctgattggtttcaggccaataattggtgctaatattgatatttatcactatcctaaaccatgttaattggtattcttttagagattttcttggatacgttgtcgtcacgcaattacacatcgggcacttttcgttgtcatcacgaaattccttagactttcttatgattttattttattttctattaccccgcacaatgtggagggatatcaaataaactagttcatttttttacgttatttttctttaatcttctttctttttcctataagttgctcgggtgtttaattaacaaaggatctgtctttcattctgaaatcacgcagctatttacctgaggagatgagaaatcccactactttcaagtgtaagttctttgattttgggagtcgtcttagtcaatctctttttatttattgtatcgtacatgatattttttccacccggtacgacaaagctgcttaataatgttgaattttttttcagggatgttacagaatccagagtaccgtcgacaactgcaagacatgttgtaagtggcatactgtagactcttgaatattagttttgtgctaaaaaataaaggtcaataccttcttgataggcatccagattgtccccaagaattgagttgcaattgcttggcgggttaagagaatttattctatttgttattttattgtgtctgtggtctaccccctctgctacaaaagtttaaaggaccagtttgatggatcttatgactaagctacaccatgccatgcatttcttgcatgtatctatgatcgagtacatttttttaatttcttaatttccagggacaacatgggaggcggcggtggcgaatgggacaataggatgatggactccttgaaaaactttgacctgagcagtccagaagtcaagcagcaatttggtaagtcaacctgcaaaggattatactagtttggagcaggctacatatcatttgcactactggatccttcatgtcagggggagtagcggcatcctgacccgttgtttcatttattatacttatttgcgatgttgaagatgatcacgactttcgtcccatcaaatatctatcagttgttgtccagagtataaattattttagatttcaggtaaataaactaggattcctccgccaaacaaaatgatgtgctgttcctcggtggatacaaaaataaaaaaaccacaaagatgggtgatttaatttggtctcatttctttgttaatccccgaaatgatttctagcatgcgattggtcctgcattgaagcttttttttcatacccaccgagatatatttcctgccttttttatttcaaagaggaaacactttctactttcttctcgaaaacgcttttaaaattccaccagtcaacccgagttctgatcgattgcttatgatcgggctttctgggtttcttcgtcagtctgagctgggcatgcatgagctccacgccttttgaagaaaaagcttgagcattcatcatcgtctcagcatccaattgccatttcttcatcatcactccctcttcgatctgctgacttctttctttgcctgcgttgaccgggattacagagcagattgggctcaccccagaagaagtaatctcgaagatcatggcaaatcccgacgtggccttggcgtttcagaacccaagagtgcaggctgccatcatggacgtgagtcaaaaagacaagctccctcatcgtttacacttgcctttaccattttcctcccactctcctcagcgtatcactgtactcgtcaatttgcagtgttcccagaatcccttcagcatcgcaaagtaccaaaatgacaaggaggtgaggatatccattccccaactttcctcttttatttacactcagaatatcactttttctccctatttatagacctaatagcatctgcatggcaagtgaattgtgcaccaaaagaggcagcaagccagaaagagatactttggagcatgtccataataaggaaccaaatcccttagtctacttatttacagagatcgttctgaaaggggaatgaataatgttttttctttgttttttttttttttggggtgtgtgtggttggggagggggaggttcttttttggttctttcttctgttgcaagatgtgtcctttatagagatcgttctgaaaggggaatgaaaaaggattttttttttttgggtattggggggtgtttcttttttggttctttcttctgttgcaagatgtgccctttacagagatcgttctgaaaggggaatgaa

SEQ ID NO: 910 - DNA, 1172 bp, Taraxacum officinale
tttttcagttatcttccggaagaaatgagaaaccctacctccttcaaatgtcggtattgtttgatttaggttttatgaattatgattttttacatatatgtcaccttgataatatgatttgttttataaaaaatagggatgcttcaaaacccgcaataccgtcaacaactgcagaaatgttgtaatttttttttttctttttgtagtttcatgttttgcctttttttgtattacccatattcatagcaagagtaaagtatgcagctattaatcacaattttccctacataaaataatgtgggattaccatgttactatagtagtatttcagtgactaaatcaattataaaatatctgtttttaaatctatattacctcattcatttattattatttatttattttcaggaatagcatggggggaagtcctgaatgggacaaccgtatgatggacaatctgaaaaactttgatattagtagtcctgaagtcaaggagcaatttggtaacatgaaatcaaacaacttcatactattttaatatatatatacaaccgatataaatatatttatatacttatatcttttttttttttgttaaaaagaccaaatcggacttaccccagaagaagtcatttccaaaatcatggccaaccccgatgtggccatggcatttcaaaacccaagagttcaagccgcaatcatggatgtacgttttctaccctctattttccttttttgcacttttgtctcacttctcaacttttatcattaaataacacttacattatccttccagtgctctcaaaaccccatgagcatcatcaagtaccaaaacgacaaggaggtaagccaaaaaaaaatgatttaagattaaaaccctaataaaatgaaaggtaacaaatgttttattttaatgatttcaggttatggatgtgttcaataagatatcggagctttttccaggtgtgacaggggcaccttgatattgttttaagtcgttcatacagaacttaatctgtttttggtgttattgaaagtgagtgagtttagagcttcagaaagcaaaaattatctgttgcgatcctttaaccatagttaagtggatgagttaggtgtgatggctgtaacagctacgggaccacaattcagttatttgtatgatttaaggtttt

SEQ ID NO: 911 - DNA, 931 bp, Trifolium repens
catcctttctctttctcctacatgtttggtttcagaagcaacatgggtggaggcactgaatgggacagtcgaatgatggacaccttaaaaaatttcgaccttaatagtcctgatgttaaacaacaatttggtaagtgttattattattatttattatgcctcatattttaaaagacatgtctgttatgagagttggatcaatttgttaatgctttaagtatgaatctttccacattatcttttgtattttctaacattttgcattttcacttcatcagatcaaattgggctttctccagaagaagtcatttcaaagattatggccaatcctgatgttgcgatggcttttcaaaatcctagagttcaagcagctatcatggatgtatgttttaattcaagtacttcacttcattaatatttcatataaatctctgaacgcttcatatgttttgattgcagtgttcacagaatccactgaatattgctaaatatcaaaatgataaggaggtatgatgatacttatttgactacaatgtccttccctgaagcatgtttggctccttgtaaattgaatgaacataaataattccttcttttaaaatatttggctccttgttgtacttgtacattgaatctgacatttagcatctttctattacatttcaggtcatggacgtcttcaataaaatatccgaactcttccccggggtttcaggtcccccttgattcattattttgttggtcaatttatctgcacctttcctgatgagcaatgagattagctagacgtgtcaccttaatgaactgtgccaaaactcttccggtcattgctgtatactgcaggctcatggttccaacttcattgtgatatacagataataataactacggcttggtctaaattgttgccatagttgaatttttgttttgc

SEQ ID NO: 912 - DNA, 1261 bp, Xanthium strumarium
gccttgtgcagattcttgcttctttatcatattcaacaacccgcaatacatggataatctagccctttatgcttcttctccaaaaccaatattgggttctacaaccaaccctccaacccattccttaatctccaacaaacccttgttctgttccttcaaaatacccaaatcaagaacttcagtttctgctctttctcgccatcaagactcaaccccaaaaagaattatcaaatcagaagatgggtttgctagaatctcaaagtcaagtaatcagcatacttcatcagttggttcagccccacagattgcagtgccaccaccatcttctcaagtaggctctcctttgttttgggtgggagttggtgttgcattctctgctgctttttcatgggcggcttcatatttaaagaataaagctatgcaacaagcctttaagaccatgatgggcacacaaaataaccagtttgctaatgctggcttttcaccgggatcaccttttccatttccgccacctgcagcacaaggctcgccacctgtatctccttttcctttcccaccttccccagcaccaggatcaagtgccacatccgcatcacgtccagctgccacatcagcacctgcttctcaacgcacagtgactgtagatgtacctcctactaaaacagcaccacctccacctgaacctgcgaattctgaagatgacttcgaatcacccaaggagccaaagaaatctgctttcattgatgtgactcccgaggaaacattgaaaacgagttttgaaaagcttgaagaatctaccgacactgaatccccaaaagatactcaatttgcataccaagcttcccaaaatgggtctgcttttaaaccgatggatagttcgttcgagggggcttcgtccacaggcacaaaaggacctactatgtctgttgaagctttggagaagatgatggaggatccaactgtacaaaagatggtctatccctatcttccggaagagatgaggaaccctacctcttttaaatggatgcttcaaaacccgcaataccgtcaacagttgcaggatatgctgaataacatgggtggaagccctgaatgggatagccgtataatggactcattgaaaaattttgatattagcagtcccgagatcaagcagcaatttgatcaaatcggacttaccccggaggaagtgatatctaaaatcatggcaaatcctgatgtcgccatggcatttcaaaaccctagagttcaagcagccatc

SEQ ID NO: 913 - DNA, 3926 bp, Abutilon theophrasti
taataatactattaggaagatgaagaagaagaagaagagcgatgcactcgaagcatggaaatcgagtgcttctgtctcagactcacaacacttaaaaacttcgatccccgttgtttatccttaagccgcaactgctacggcaagacaactgcttttcccctctcagcacctgtgccaccgttctttcggcagaaatcttgctttcctcggtctacacgcatgttcaacacttcaggaaatcgtttccatcctccacgtgctactgttggtccggatgaacctcaggcagcaagcactaccatgccagatggtcttcttgaaaagcaagattttgattcattatatcctcaattacagtcactagaggagtttttatctactggaattccttcccacccaaagcttcatcgagggcaattgaaaaatggccttcgctaccttattttgccgaataaagttccttcaaacaggtttgaagcacacatggaggttcacgctggatcaattgatgaggaagatgatgagcaaggaatagcacacatgattgaacatgtcgcattccttggaagcaagaaacgtgaaaaacttcttggtactggggctcgctcaaatgcttacactgatttccaccatacagtttttcacatccattcaccaactcgtaccaaggatggtgatgaagatttacttccacttgttctggatgcattgaatgagatagctttccatccaaaattcctttcttctcgggttgaaaaagagaggcgcgctatactttcagaactacagatgatgaatacaatagagtaccgtgttgactgtcagttattacaacatttgcattctgaaaataagctaagcaaaaggtttccaattggattagaagagcagatcaagaaatgggatgcagataaaataaaaaaatttcatgaacggtggtattttccagctaatgcaactttgtacattgtgggggacattgataatatcccaaaaactgtatcccagattgaagctgtttttgaacaaactggccttgaaaatgagaccgcctcaccacctacttctagtgcatttggtgccatggctaattttctagttcctaagctctcagctgggtttgctggaagttcgtctacttcttcagatcaatcgaaaattcttaaaaaggaaaggcatgctgttcgtcctccaataaagcacaattggtctcttcccggccataataccgacatgaagcctccacaaatatttcagcatgagttgcttcagaatttttcaattaacatgttctgcaagattcctgtgagcaaggttcgaacattcagagacttgagaaatgttctgatgaaaaggatatttctgtctgccttgcattttcgtattaattcaagatacaagagttcaaatccaccttttacttcagttgagttggaccatagtgattcaggaagggaagggtgcactgtcacaactcttacaatcacagcagaacccaagaattggcagaatgcaattaaggttgcagttcaagaggttcgaaggctcaaggaatttggtgttactaagggtgaattgactcgctatatggatgcactgttaaaagatagtgaacagctggcagcaatgattgacaatgtttcatcagttgacaatttagattttattatggaaagtgatgcactgggccatgtagttatggatcagagacaaggacatgagtgtttgatggctgttgtggaaacagttactcttgatgaagtcaactctattggtgcacaggtattagaatttgtgtctgattttggaaaacctactgcaccccttccagcagcaattgttgcgtgtgttccaaagaaggtccatgttgatggcattggtgaaactgaattcaagataacctcagctgagatcacatctgctatagagtctggattgaaagaacctattgaagctgagcctgagcttgaagtgccaaaagaattgatatctccactgcagttgcaagagttaaggatgcagcggaggccttcttttattcctgttagtcctgaaacaaatgtcacaaaattgcaagatgaggaaacagggattactcaacgccgtctttctaacggaattcctgtaaattataagatctcaaaaaatgaaaccaaaggaggtgtaatgcggctcatcgttggcggtggaagagctgctgaaacttctgattcaaaaggagctgtagttgtaggcgtccgaactctcagtgagagtggtcgagttggcaacttctcaagggaacaggtagaacttttttgcgtgaatcacctgataaattgctccttggagtccactgaggaattcatttcaatggagttccgttttactttgagagacaatgggatgcatgctgctttccagttacttcatatggtgcttgagcatagtgtctggcttgaggatgcatttgatagagctagacaactgtacttgtcctactatcggtctattccaaagagtttggaacgttcaactgcacacaaactcatgttagccatgatgaatgacgatgaacgctttgttgaacctactccaaaatcattacaaaatttaacacttgaatctgtcaaagatgctgtgatgaatcagtttgtaggtgataatatggaggtaagtattgtaggggatttcactgaggaggagatcgagtcttgtattcttgattatctgggaacagttggagcgcaaagagactctgaaagagagcataaatttgatccaatcttgtttcgaacttctccatccgacttgcagtctcaacaagtattcttgaaggacaccgatgaaagggcgtgtgcatatatcgcagggcctgcacctaaccgttggggttggacagttgacgggaaagaccttttggagtcggttgctgatactccaattgctgatgaagcacaactccattccgaggagggaacaatattcaaaaggatttgcaaagaaagcttcgtggtcatccccttttctttggcataacaatgggacttctagctgaggttataaattctaggctttttacaacagtccgggattcccttgggttaacatatgatgtatcgtttgagttgaacttgtttgatcgacttaagcttggatggtatgtgatatctgtaacatcaactccaagcaaggtatataaagctgttgatgcttgcaagaatgttcttagaggtttgcactctaacaggatttctcctcgggaactggatagggcaaagcggactctattaatgagacatgaagcagaaacaaagtcgaatgcgtattggcttggattgttggctcacctacaagcttcttcagttcctagaaaggacatatcatgcgtcaaagagcttatttctctatatgaagctgcttctattgaagacatctaccttgcttacgaccagctgaaagtggacgaagattctttatactcatgtattggaattgcaggagttaatgccggtgaagatactatagttcccatagaagaggaagaaccaagtgacggctttcaaggagttattcctgtagggcgtggtttatctacgatgacaaggccaacaacatgaacctctttgatgccgtttgtcattctgttggcgaaaagctggttttaaaaagcacaccgggaaatccctcgggatcctttcttcataagcttttgcagtttggtgaaaacgttcaggaagattatttgaggatcaatgcaacacattggtattaaagcaagcaatcatgaagaatgatgtgtacaatatgctggaaaggccagattttatgtaattatatgatattgataccaacagtcttttgtattctttgggaataagagatttaagtggatggtattgggaaattttggctgaataaaaagcccctaagcagtaggtactcat

SEQ ID NO: 914 - DNA, 3908 bp, Abutilon theophrasti
taataatactattaggaagatgaagaagaagaagaagagcgatgcactcgaagcatggaaatcgagtgcttctgtctcagactcacaacacttaaaaacttcgatccccgttgtttatccttaagccgcaactgctacggcaagacaactgcttttcccctctcagcacctgtgccaccgttctttcggcagaaatcttgctttcctcggtctacacgcatgttcaacacttcaggaaatcgtttccatcctccacgtgctactgttggtccggatgaacctcaggcagcaagcactaccatgccagatggtcttcttgaaaagcaagattttgattcattatatcctcaattacagtcactagaggagtttttatctactggaattccttcccacccaaagcttcatcgagggcaattgaaaaatggccttcgctaccttattttgccgaataaagttccttcaaacaggtttgaagcacacatggaggttcacgctggatcaattgatgaggaagatgatgagcaaggaatagcacacatgattgaacatgtcgcattccttggaagcaagaaacgtgaaaaacttcttggtactggggctcgctcaaatgcttacactgatttccaccatacagtttttcacatccattcaccaactcgtaccaaggatggtgatgaagatttacttccacttgttctggatgcattgaatgagatagctttccatccaaaattcctttcttctcgggttgaaaaagagaggcgcgctatactttcagaactacagatgatgaatacaatagagtaccgtgttgactgtcagttattacaacatttgcattctgaaaataagctaagcaaaaggtttccaattggattagaagagcagatcaagaaatgggatgcagataaaataaaaaaatttcatgaacggtggtattttccagctaatgcaactttgtacattgtgggggacattgataatatcccaaaaactgtatcccagattgaagctgtttttgaacaaactggccttgaaaatgagaccgcctcaccacctacttctagtgcatttggtgccatggctaattttctagttcctaagctctcagctgggtttgctggaagttcgtctacttcttcagatcaatcgaaaattcttaaaaaggaaaggcatgctgttcgtcctccaataaagcacaattggtctcttcccggccataataccgacatgaagcctccacaaatatttcagcatgagttgcttcagaatttttcaattaacatgttctgcaagattcctgtgagcaaggttcgaacattcagagacttgagaaatgttctgatgaaaaggatatttctgtctgccttgcattttcgtattaattcaagatacaagagttcaaatccaccttttacttcagttgagttggaccatagtgattcaggaagggaagggtgcactgtcacaactcttacaatcacagcagaacccaagaattggcagaatgcaattaaggttgcagttcaagaggttcgaaggctcaaggaatttggtgttactaagggtgaattgactcgctatatggatgcactgttaaaagatagtgaacagctggcagcaatgattgacaatgtttcatcagttgacaatttagattttattatggaaagtgatgcactgggccatgtagttatggatcagagacaaggacatgagtgtttgatggctgttgtggaaacagttactcttgatgaagtcaactctattggtgcacaggtattagaatttgtgtctgattttggaaaacctactgcaccccttccagcagcaattgttgcgtgtgttccaaagaaggtccatgttgatggcattggtgaaactgaattcaagataacctcagctgagatcacatctgctatagagtctggattgaaagaacctattgaagctgagcctgagcttgaagtgccaaaagaattgatatctccactgcagttgcaagagttaaggatgcagcggaggccttcttttattcctgttagtcctgaaacaaatgtcacaaaattgcaagatgaggaaacagggattactcaacgccgtctttctaacggaattcctgtaaattataagatctcaaaaaatgaaaccaaaggaggtgtaatgcggctcatcgttggcggtggaagagctgctgaaacttctgattcaaaaggagctgtagttgtaggcgtccgaactctcagtgagagtggtcgagttggcaacttctcaagggaacaggtagaacttttttgcgtgaatcacctgataaattgctccttggagtccactgaggaattcatttcaatggagttccgttttactttgagagacaatgggatgcatgctgctttccagttacttcatatggtgcttgagcatagtgtctggcttgaggatgcatttgatagagctagacaactgtacttgtcctactatcggtctattccaaagagtttggaacgttcaactgcacacaaactcatgttagccatgatgaatgacgatgaacgctttgttgaacctactccaaaatcattacaaaatttaacacttgaatctgtaaaagatgctgtgatgaatcagtttgtaggtgataatatggaggtaagtattgtaggggatttcactgaggaagagatcgagtcttgtattcttgattatctgggaacagttggagcacaaaaagactctgaaagagagcataaatttgatccaatcttgtttcgaaattctccatccgacttgcagtctcaacaagtattcttgaaggacaccgatgaaagggcgtgtgcatatattgcagggcctgcacctaaccgttggggttggacagttgacgggaaagaccttttggtgtcggttgctgatactccaattgctgatgaagcacaactccattccgaggagggaacaatattcaaaaggatttgcaaagaaagcttcgtggtcatccccttttctttggcataacaatgggacttctagctgaggttataaattctaggctttttacaacagtccgggattcccttgggttaacatatgatgtatcgtttgagttgaacttgtttgatcgacttaagcttggatggtatgtgatatctgtaacatcaactccaagcaaggtatataaagctgttgatgcttgcaagaatgttcttagaggtttgcactctaacaggatttctcctcgggaactggatagggcaaagcggactctattaatgagacatgaagcagaaacaaagtcgaatgcgtattggcttggattgttggctcacctacaagcttcttcagttcctagaaaggacatatcatgcgtcaaagagcttatttctctatatgaagctgcttctattgaagacatttaccttgcttacaaccagctgaaagtggacgaagattctttatactcatgtattggaattgcaggaattaatgccggtgaaaatattatagttcccatagaagaggaagaaccaagtagtgaaggctttccaggagttattcctgtagggcgtggtttatctaccatgacaaggccaacaacatgaacctgtttgatgccgtttgttgttctgttggcgaaaagctggttttgaaaagcacaccgggaaatccctcgggatcctttcttcataagcttttgcagttaggtgaaaacgttcaggaggaatatttgaggatcaatgcagcacattcgtattaaagcaagcaatcatgaggagtgctgtgtacaatatgctggaaaggccagattttatgtaattataacgatattgataccaacagtcttttgtattctttgggaataagaaattttggctgaataaaaagcccctatgcagtaggtactaggt

SEQ ID NO: 915 - DNA, 695 bp, Abutilon theophrasti
cactgagaatgatccgagcctctgtcagtgttcttcatcctttctgttctctgcaggatctctttgttgttttctgttttgatagttgagcatatgaactagggcagtgaaactactattgcttgaaatctgctaataggatgtttggaaatagtcttgcacagaatttttctatgtctttgtgaaaagtgtgcatctcctgcataccatgacagagctagtttctatcatttgaatgaatgatgtttttaaattcctttgttcttgccatttgcccgaacatgatttggtgcaaagattttttctttcttcagaaagaaatatcacgttattttatagacgtggattttccatgttgtctggtgcattagactggtgttaacttgaagcaattgtgtgaaacatgtgattctgctcttttcttggcgcttaataccacaattttaaaataaaagaaattccttactatcatatttcaactgttctgtcatgtaggtcaactctattggtgcacaggtattagaatttgtgtctgattttggaaaacctactgcaccccttccagcagcaattgttgcgtgtgttccaaagaaggtccatgttgatggcattggtgaaactgaattcaagataacctcagctgagatcacatctgctatagagtctggattgaaagaacctattgaagctgagcc

SEQ ID NO: 916 - DNA, 1209 bp, Abutilon theophrasti
tccaacctatccctaaaagtaaatctattaagcatagtaaagaagttgcagcttatcattcctgttccatgcatgcagatagctttccatccaaaattcctttcttctcgggttgaaaaagagaggcgcgctatactttcagaactacagatgatgaatacaattgagtaccgtgttgactgtcaggtgctaatgagggtcataccatggtttgtctgctaattattctgagtttgttcaaattgtaatctaacttaatttgtttcttctgaatgcagttattacaacatttgcattctgaaaataagctaagcaaaaggtttccaattggattagaagagcagatcaagaaatgggatgcagataaaataaaaaaatttcatgaacggtggtattttccagctaatgcaactttgtacattgtgggggacattgataatatcccaaaaactgtatcccagattgaagtatggcacaagctgtttagttatgttttcttgtgtctgttgtcctaagaagaggcatcaaagttcttgactgaatccttttgattctatgcaggctgtttttgaacaaactggccttgaaaatgagacagcctcaccacctacttctagtgcatttggtgccatggctaattttctagttcctaagctctcagctgggtttgctggaagttcgtctaattcttcagatcaatcgaaaattcttaaaaaggaaaggcatgctgttcgtcctccaataaagcacaattggtctcttcccggccataataccgacatgaagcctccacaaatatttcagcatgagttgcttcagaatttttcaattaacatgttctgcaaggtttgaaaatgatgctcatttagtgattatttaattagttttcctactgtcaaaattttcattgtctccttgtttttgttttcataggaatacattgtgctgttatgctaagactttgggataaaaattccctgctgttttgctctaattttagattaattaaggttctttctctgcagctttagttttagttcaattagggatgtgctttatcagtggtggtcttactgcttcaaaactttatcaatggtcaaatacttgtttaaataggaagattcagacatacataaaggaaacactactttgtgtcacttcattcaagttgacatatacttctaattaagcaataggcagtatctgctt

SEQ ID NO: 917 - DNA, 918 bp, Abutilon theophrasti
ctgttatcacttcttaaatggttttttttgaaactatgaacatgattagtaccttattttggattcaattcaactgttttaaatagtggtggactgggaaaaatgagtatggaaatgcttgatgatcaaatatttggtcttattataaaatgaaaatttgaggataactaccaattgtcctcttttgcgacgatcatatgctctgttcttactgctctatcggtagtggccagtcataattgatccattcccactgctacaattgtcatgctgatttaatctcacaaaaaattctcagcctttctttgtccacctattatttatctcatgtgcgtttagatgtgattctcaggtagaacttttttgcgtgaatcacctgataaattgctccttggagtccactgaggaattcatttcaatggagttccgttttactttgagagacaatgggatgcatgctgctttccagttacttcatatggtgcttgaggtatcactgtgttgataattatacctatatatgttgatcttttccttttgtttactagttatctagtggtaaggaacatattaatgctgggaagagctgttccttttatgggatacttgattttcatcataaaattatgatatcatgatactcactttgttgtaataaatgatggcttctggtttgcagcatagtgtctggcttgaggatgcatttgatagagctagacaactgtacttgtcctactatcggtctattccaaagagtttggaacgttcaactgcacacaaactcatgttagccatgatgaatgacgatgaacgctttgttgaacctactccaaaatcattacaaaatttaacacttgaatctgtaaaagatgctgtgatgaatcagtttgtaggtgataatatggaggtaaatattca

SEQ ID NO: 918 - DNA, 1334 bp, Abutilon theophrasti
cttgcagtctcaacaagtaagaccattgctcaagttatagttacatcattatttgctatatttttgaaaatcctctggaacttatcagcacatttacccatgcaccgtgttgtttattttctttcaaataggtattcttgaaggacaccgatgaaagggcgtgtgcatatatcgcagggcctgcacctaaccgttggggttggacagttgacgggaaagaccttttggagtcggttgctgatactccaattgctgatggtgagttccctaatgatgtgtagaattggattttttttccatctcaagtcttttgctccttggactgctagtgagtgcgaggttggatggtgtccaatcttgattactaatataagacaagttagatggtttgaagagtttttaacttaaaagccatgccatcaagcttgctgttgacttgattgaaatgtaggatgtacgaattgtggtaatcaactgaacattgggtatgaatgtgaattatgagacctttgtaaaggttacagctaatcactgaacattggtaatcaacttgagctttagtctttggagggtaacatggtttaggctttcttgctaggtcagtggtggttgaacttgggtcttatgtcagcgatagagcaggtgcctgcccagtcagggctctcacatcgtgctgataagatattgtttaagcgacgtggaacttgactgtgattgagatgtgaggtcttggtgaggacatcaagtattcccaatcacatatgaatattaatgtgaatattgagactcatatgagcgttctagtcaattacttgtaacaacttgagtcctaggtttcaagagccatataagcctaaaaaagttgttgcttagacccggatatctatgtatctgaccgatgtgggctctttcattgcacacgtatgatcttagttcttagttcctgtagagttgatttccttgtgagccaaatgggtgctcatttattgtctgagccgatggttttgtcagtatagcagaatacaagttaataatttcaaatgattttcaaatgaaaaaaaatgttatagaatagatattttcaaatatttttgtgtgatatttatgtaaaatgaggtgcgatttccttaaagtttagacaaatgtactttttctcttatggctggccatttactttgcagaagcacaactccattccgaggagggaaacaatattcaaaaggatttgcaaagaaagcttcgtggtcatccccttttctttggcataacaatgggacttctagctgaggttataaattctaggtaattcttcttaaccacatattgagcaagtg

SEQ ID NO: 919 - DNA, 280 bp, Abutilon theophrasti
gtatttgcttcatcatagctattatttaattgaagaatttgcctgacaatctgtgaaaataagttaaacaaacaagtatgatttttctctctgcatttgcttgatgatctgggaaaagattaatggaagaattgtctgttgaatttttctaagtattggttgaaggttttggtttataccaacatgtttcttgtatattgatggtgaatggcttgtttactaggatggtgatgaagatttacttccacttgttctggatgcattgaatgaggtatgcaac

SEQ ID NO: 920 - DNA, 203 bp, Abutilon theophrasti
ttttataaatttatccttatgaaatctttatctttgtttagatctcaaaaaatgaaaccaaaggaggtgtaatgcggctcatcgttggcgggggaagagctgctgaaacttctgattcaaaaggagctgtagttgtaggtgtccgaactctcagtgagagtggtcgagttggcaacttctcaagggaacaggtcattgttttt

SEQ ID NO: 921 - DNA, 219 bp, Abutilon theophrasti
gaaggtcactgctaaatttcttttcttttctgcagcttgaagtgccaaaagaattgatatctccactgcagttgcaagagttaaggatgcagcggaggccttcttttattcctgttagtcctgaaacaaatgtcacaaaattgcaagacgaggaaacagggattactcaacgccgtctttctaacggaattcctgtaaattataaggtaatgccttgca

SEQ ID NO: 922 - DNA, 546 bp, Abutilon theophrasti
acatacataaaggaaacactactttgtgtcacttcattcaagttgacatatacttctagttaagcaataggcagtatctgctttatactattcccagaaacaaaccagtgtccttaatctgtagtagttgtacagtgttctcctggtgcattgtttattacttcatttatgtttgatagtctgtcttctcccttattaaattgtattgttatcaataccgtttgaaactttaacaacaagactcaggtgtggcatttgtctcatatattctgttgtaaatcttcctgcagattcctgtgagcaaggttcgaacattcagagacttgagaaatgttctgatgaaaaggatatttctgtctgccttgcattttcgtattaattcaagatacaaggtgtgctgattctctaacctgaaattactctattctccatgttgcccacgtaaagctttatttagtcccaatttggcacgcagttgctcttccctacctgctattgtgaattgagtataaattctgctatgtggcaatcttcatctctaatttg

SEQ ID NO: 923 - DNA, 363 bp, Abutilon theophrasti
ataataatactattaggaagatgaagaagaagaagaagagcgatgcactcgaagcatggaaatcgagtgcttctgtctcagactcacaacacttaaaaacttcgatcccccgttgtttatccttaagccgcaactgctacggcaagacaactgcttttcccctctcagcacctgtgccaccgttctttcggcagaaatcttgctttcctcggtctacacgcatgttcaacacttcagtaagtatttgtttcttaaggtgctttcaactcctccattgttaaaaaaaggagttttttagagtgtcttttgttactgacttattgaattcgttaatcttactgagcattaatttcagggaaatcg

SEQ ID NO: 924 - DNA, 551 bp, Abutilon theophrasti
tcagcttcgtatacatgttaatagttatgatgttgaaagcacagcacttctgaggtgtttcaatatccaaaaacttctaatttgacttttgaatgataacatgctgaaataggaatcattcatacacagacccgcttcatgtagatgagacagtattcactgattcttgccatttacttagtaatattttaacacaactgtaggtttgaagcacatatggaggttcatgcgggatcaattgatgaggaagatgatgagcaaggaatagcacatatgattgaacatgtcgcattccttggaagcaagaaacgtgaaaaacttcttggtactggggctcgctcaaatgcttacactgatttccaccatacagtttttcacatccattcaccaactcgtaccaaggtttgtccttgtccttttctatacatctaatcttcaacattgactttcggactcaattgtaccatctttgcttgcttcaggatttaagttatgatgttttgccacattatgtctatatttgtattttaatctttgtcaagtgctttgtt

SEQ ID NO: 925 - DNA, 2256 bp, Abutilon theophrasti
ttcttattttcaatagttcataccttttttttatgtttgtaacttattttaatgtaaaagtaccaaattttgtcaattcttggtagtctcatggtcatggtaataaacttccaatttttctttttctttttttgttgttggaattcaggacatatcatgcgtcaaagagcttatttctctatatgaagctgcttctattgaagacatctaccttgcttacgaccagctgaaagtggacaaagattctttatactcatgtattggaattgcaggagttaatgccggtgaagatactataggtgaggatatgcctcgatttaccggccttgataaatctgaaaacagtagccagtttctcgattttttatcaattttttgttgttgtcttttgttttctcctcttcttgttttcagttgtttttcgtattcaattttacttattttgtcttcacaaacttgtgtgcagttcccatagaagaggaagaaccaagtgacggctttcaaggagttattcctgtagggcgtggtttatctacgatgacaaggccaacaacatgaacctctttgatgccgtttgtcattctgttggcgaaaagctggttttaaaaagcacaccgggaaatccctcgggatcctttcttcataagcttttgcagtttggtgaaaacgttcaggaagattatttgaggatcaatgcaacacattggtattaaagcaagcaatcatgaagaatgatgtgtacaatatgctggaaaggccagattttatgtaattatatgatattgataccaacagtcttttgtattctttgggaataagagatttttttagtggatggtattgggaaattttggctgaataaaaaagcgcctaagcagtaggtactcattgtcctccattttttttaagttatgaaaaaggaaaattaatgaattcagggctgattttggtgtgggttcatactttttcatttcacacgacataatgatttacagtgtcgaatcaggcaagttagttctatatttggcttatttataaccttaatcattatattataattatgtctaaagatattttattcagaaaactcttcgaaattaaattaataatcaattggtcctttttagatgttggatcaattggattctttaagtgattaaatgatctgtttgaaaactagtcctcatttttttgcttttggctggcatgggtttcacaagatcgattgattaattattgatttattttcgttaattttttggctaataaaatttagggttaaatgtcaatttagggtctctatatatggggtcttaaaaatttttaatatttttttgggtctcaataattttttgtttcatataatggggtctcaacaatttttaatatttatatattggggtctcaactattttccgttcacaatattggggtctctaaatacatggaaaaaatttgagaccccaaaaaaatattgaaaattcttaagacccaaactgataatttgatatatgtagagatcctaaattgatatttaacatggttatgaatttgtcaaactatgaaagtatttataaacaaaatattaaaatatattacgtatatttataagccaatttatttggtccactaaagttaaagggttaaataccttaatgagtcttcagttgtatccaattcacaggttggagtttcaaatttttttgtttacaggttgggatctctacttgtatcctgttacattcagtgggcctcccgtaacagaattcatttgaagggtctaaatcgtgccacgtgattttttttaatttttttaatttttttcctttaattattttttttaaaaaaaatttaacccgataaattttttttcactccccaccttaaatcatcttctacctccgaacttaaacacaccccattgaatcatttcatcttcttcctcactcctctcttcttaccactgttttgaatttttttgcttcttatccctaaaatgtcatcttcttctaactcatcatccaccacacaacaacaagacttctcccctttcttactcccggcgatgaggaacctccatcgagctcttcaagatctgggtatcgacaaaatcccaatctccaccactttctccttcttgtccacgatcaccaccgctttcccttcgtcctccgccgagttccaacaacccgccggcgacaacatcataagacccttactacagttcttggaacaaacgaattcccctttcgtcat

SEQ ID NO: 926 - DNA, 312 bp, Abutilon theophrasti
ttttttgtttgtgatttaagtgtttcgagttttcatcactctggggatactttacaaatccatacatgtctctggaaattatgtaatgcaaattctaccctgcttgacacaggctttttacaacagtccgggattcccttgggttaacatatgatgtatcgtttgagttgaacttgtttgatcgacttaagcttggatggtatgtgatatctgtaacatcaactccaagcaaggtgcgcgataaacccagaattccagatacatcttgcattcttttgttgttttgtggtggttattattgtctttaacctc

SEQ ID NO: 927 - DNA, 2310 bp, Abutilon theophrasti
taatgagacatgaagcagaaacaaagtcgaatgcgtattggcttggattgttggctcacctacaagcttcttcagttcctagaaaggtgaaatgaaattagatagttcagtctccatgtttattatgttattatattcttattttcaatagttcttacccttttttttgtttgttacttattttaatgtgaaaaaagtaccaaattttgtcaattcttagtagtctcatggtcatggtaataaattcccaattgttctttttctttttttcattggaattcaggacatatcatgcgtcaaagagcttatttctctatatgaagctgcttctattgaagacatttaccttgcttacaaccagctgaaagtggacgaagattctttatactcatgtattggaattgcaggaattaatgccggtgaaaatattataggtgaggatatacctcgatttaccggccttgataaatctgaaaacagtagtcagtttgtcgattttttttgttgtcttttgttttctcttctttttgttttcaattgttttttgtattcattttcacttaatttgtctttataaacttgtgtgcagttcccatagaagaggaagaaccaagtagtgaaggctttccaggagttattcctgtagggcgtggtttatctaccatgacaaggccaacaacatgaacctgtttgatgccgtttgttgttctgttggcgaaaagctggttttgaaaagcacaccgggaaatccctcgggatcctttcttcataagcttttgcagttaggtgaaaacgttcaggaggaatatttgaggatcaatgcagcacattcgtattaaagcaagcaatcatgaggagtgctgtgtacaatatgctggaaaggccagattttatgtaattataacgatattgataccaacagtcttttgtattctttgggaataagaaattttggctgaataaaaagcccctatgcagtaggtactaggtactcattgtcctccattttttttttttttgaagttatgaaaaaggaaaattaatgaatttagggctgattttggcgtgggtttcatactttttcatgtacaccatataatgatttacagtgtcgaatcaggctagttagttctatatttggcttatttataaccttgatcattatattataattatgtctgaagatattttattggttttactcagaaaactcttcaaaattagattaataatctatctattggtcctttttagatgttggatcaattggattcttaaatgaaaaattgttattaaaagatctgtttgaaaactggtactcattttttttcttcttttggctggcatgggtttcacgagatcgattgaccgtgtttttctatttgtagagtaaattgatctaatatttcaaataagaccaattaattaattattgatttattttcgttgatttttttggctaataaaatttatggtggactgggtcgcgtcccttttggccctttccgttatttttcatcgtagattcttacgttactatccattattccaattggccctaactctcatctctgttaaaatttttttacatacattaccgatataaccaatgaatgaaggtcatgtggtttgaatatttctatcatgacattatttacgtgaaatattaatcaaaatttaagtatattgcttttcattaatatattcattaactaaaataactcacctgaattttttttaacaaagatgaaagttatggccaaatgagataataaatagtaatgtaagggattacaatgtgaaaaaaatgaaaatggtcaaaatgggagcaacccaaacgataagggccctaaagtgaattaagtctaaacaaaatattaaaatatattatgtatatttataagcaaaattatttggtccttaaaaagttgtacctacaaaattatgagtgtattaataattaaagaaattagtcttataaaaaataataaatgtgaatcctatttaacaaaaaaagggcgttggcgttgggagggttattcattttcagagaaaaaacttggaaaaaagtggagaaacaataagggaggactgtagtagagcggcagaggactagaggtgtccatggcccgggttcgggcgggttcgggccgagcccgtgcataccattaatgtgtgttttatgtgcccaagctcggtccgatgaacgggcccagaatttagaccagacccgatccggctattaaatgggttaaacgggtcgggttcggaccgatccgtttaattttattttaaaaaaatgtatttttt

SEQ ID NO: 928 - DNA, 770 bp, Abutilon theophrasti
tgatgggagaaaattgttttgatggattcacatcaaatggctttaaaccctaatatattgtcttggtcacaggttcgaaggctcaaggaatttggtgttactaagggtgaattgactcgctatatggatgcactgttaaaagatagtgaacagctggcagcaatgattgacaatgtttcatcagttgacaatttggattttattatggaaagtgatgcactgggccatgtagttatggatcagagacaaggacatgagtgtttgatggctgttgtggaaacagttactcttgatgaagtaagttcactgagaatgatccgagcctctgccagtgctctccatcctttctgttctctgcaggatcactttgttgttttctgttctgatagttgagcatatgaactagggctttgaaactactattgcttgaagtttgttaataggatgttttggaaatagtcttgcacagaaattttctttttgtctttgtgaaaagtgtgcatctcatgcataccatgacagagctagtttctatcatttgaatgaatgtagtttttttatggaaaaggaatgtagttttttaatttcctttgttcttgccatttgcccgaacatgatttggtgcgaagattttaatctttcttcagaaggaaatatcatgttattttatagacgtggattttccatgttgtctggtgcattagactggtgtaacttgaagcaattgtgcgaaacatgtgattttgctcttttcttggcgcttaatatca

SEQ ID NO: 929 - DNA, 596 bp, Abutilon theophrasti
gtggcaatcttcatctctaatttgattttctttggcattgtgtttacattgcaatctatttaactccagttgtaatgccaaatgggctattattaactagtgggggttataagagaagtattaggtacgtggtggtattactaattttaaggaatggtttacgaagaggctaaaaagttacaatgttttttttttggaattagggtcaagatgaattgcgcattttgtttattgtaccccccccccaaaaaaaaaatcccacttccaagtcacgaaaataacataaacatttatttcgaatatttgggctaatttattgaattgccagagttcaaatccaccttttacttcagttgagttggaccatagtgattcaggaagggaagggtgcactgtcacaactcttacaatcacagcagagcccaagaattggcagaatgcaattaaggttgctgttcaagaggtttgtgtttccttatcattaacagtcttttattattttctgttgattttacctgatgttctccagttgttaccttcaacttttccttctttatttgtttattatagggtgatgggagaaaattgttttgatg

SEQ ID NO: 930 - DNA, 875 bp, Alopecurus myosuroides
ttttctttgggatcactttgagtttgcttgctgaaattattaattccaggctatttacgacagttcgagattccatgggactaacctatgatgtttcttttgaattaaatctttttgacaaactggatcttggttggtatgtgatcgcggtaacttcaaccccgagcaaggtccataaagctgttgatgcatgcaaaggtgttctcagaggtttacatagtaacaaaattgttgaaagagagctggaccgggcaaagaggacactgctgatgaaacatgacgctgagacaaagacaaatgcctattggcttggtctgctagcccatctgcagtcttcttccgtgcctaggaaggatatatcctgtattaaggaaatgacgacactatatgaaagtgccacaattgaggacttgtatcttgcatacgagcacttgaaagttgacgattcatctttattttcctgcatcgggattgctggcgccgagtctggcgaagacatgaatgatgatgagcctgatgtggggcttcctggtatggttcccatgggaggccggggtctgtcaactatgaccagaccaaccacatgagtcgatacattttcacgccccaactttctcgaggtatcaacctagctcctgaagagaggatctgtatgtgaccctgtggagattctgcacatgatgaccatatatactagcaagtactctgtagacacactgatgcattcggtcaggccaatttttattccttgagcattttcagcagaaagcgaggctgttgcattttctcggagaaatagagttgattgctgccaaggtttcgaaaacctgtcttggatggccatgttcagatgtatagtaaaaatcgattcgttt

SEQ ID NO: 931 - DNA, 658 bp, Alopecurus myosuroides
cataaattgctcgctggaatccaatgaggagttcatctttatggaatttaggtttgctttaagagataatggcatgcgtgctgctttccagctcctgcatatggtccttcagcataatgtgtggctagaagatgcgtttgatagagcagctcagttatatttgtcttactaccgctctatccccaaaagtttggagcgcgccacggctcacaagcttatggtagccatgttgaaccatgatgaaaggttcgtagagccatctccacagtcattgcaaaagttgactcttcagtcagttaaagaagccgtcatgaaccagttcgtgggtagcaacatggaggtcagtatagttggtgatttcacagaagaagaggtagaatcttgtgttctcgattatcttgggactgtaagggctgcaaattcttcaaacgtcgcggagcatattgagaagatctcctttctgccgtttccatcggatctgcattcccagcaagtatacataaaggatacagacgagagagcttgtgcttacattgctggtccggcacctaatcgctgggggtttgctactgaaggaaaggacctcttaaatgtaattcgaagttctagtgcaaatgaaatctctgatgtaacggagaagacacatattaatgttcgc

SEQ ID NO: 932 - DNA, 938 bp, Alopecurus myosuroides
cgtgctgctggacctgacgaaccacatgttgcaagtccaacatggtctgaaacagctcttgataaaccttatcttgatcacgcggttggaaacgaggagcttgaagctgtcctggacactcctcttccttcccatccaaagctaatacggggtcaattgaagaatggcctcaaatatcttattttgccaaacaaagtccagcagataggtttgaggctcacatggaagttcatgttggatcaattgacgaggaagaggatgagcagggaattgcacatatgatcgagcatgttgcatttcttgggagtaaaaagcgcgagaaactcttggggacaggtgcaaggtctaatgcatatacagacttccaccatacagtcttccatatccattcgccaactaaaacaaaggaatatggtgaagccttactcccttctgtgctggacgctttgaatgagatcgcttttcatccaaagttttcttcatctcgcgtcgagaaagagagaagagcaattctttcagagctccagatgatgaacacaattgagtaccgtgttgattgtcagttgttgcaacatttgcactcggaaaacaaattgagcaacagatttcctattggacttgaggagcaaatacttaaatggaatcctgacaagatccgtggattccatgagaaatggtattaccctgctaatgctactttatacctagtaggagaaattgacgatattcccagagcagtgcgggagatagaggctgtgtttgaacatacactttctgaaaatggagcagcccctacatcgactgcaggtccatttggtgccatggcaagcctttttgcgccaaaactgccaggtggcttggctgcaagcctaactggtgaaagatcacctgctgcagataaactaaaacctataaaagggaaagacaggcagttagac

SEQ ID NO: 933 - DNA, 1045 bp, Amaranthus albus
agagtagaggtagagaagtttttaaatgctgaacttccttctcatcccaagctatatagaggacagttgaaaaatggactgcgttacataattttgcccaacaaagttccaccaaacaggtttgaagcacatatggaggttcatgttgggtctattgatgaggaggatgatgagcaagggattgcacatatgatagaacatgttgcatttcttggtagtaaaaagcgtgagaagttacttggtacaggagcaaggtctaatgcctatacagattttcatcacacagtttttcatattcattctccaactcgtgcgaaggactctgatggtgacttgctcccttttgtactggatgctttaaatgagatagcttttcatcctaagtttctctcgtcaagggttgaaaaggaaaggcgggcaatattgtctgaacttcaaatgatgaatactatagagtatcgtgttgattgccagctgttacaacatttgcattcagagaacaaattgagtaaaaggtttccgataggattagaggagcagatcaagaagtgggatgttgataaataaaaaaatttcatgagcgctggtactttccagcaaactctactttgtatattgttggggatatagacgacatcactaagactatttaccaaattgaggctttatttagtcagactggcttggagaatgagacagaggcttccccacctccaacaccaaatgcctttggtgcaatggctagttttttagtgcctaagcttccagttggacttggaggtagttctcaagacaaagcatcaagttctgagcaatcaaaaacttcaaaaaaggaaagacatgcagtgcgtcctcctgtccagcataattggtcactaccaggaagtggtcgtatatctgatcctcctcagatatttcagcatgagttacttcagaatttttcgttcaatatgttctgtaaggttcccgtgaataaagttcggacatatggagacttaaggaatgtactaatgaagaggattgttctttctgccttgcatttcag

SEQ ID NO: 934 - DNA, 818 bp, Amaranthus albus
gggatcacaatgggtttattagcagaggttataaattccagacttttcacaacagttagggattccttgggtttgacatacgatgtctctttcgagctgaacttatttgataggctaaattttgggtggtatgtgatttctgtgacatcaactcctggaaaggtacataaagctgtcgatgcttgtaaaaatgtgctcaggggcttgcacagcaacagaattgctccaagggagttggacagggcaaagaggaccttgctaatgaaacatgaagctgaaatcaagtcaaacgcttactggcttgggttgttggctcatttgcaagcggattctataccaaggaaggatttgtcatgcataaaagacctgaccttcctttatgaagctgccactatagaggatgtatatgttgcatatgaacaactgagggtggatgaaaattccctgtattcctgcattggtattgctggagcgcaggctgaggaagaaatttcagatgctgattctttgttggacgatcaagagtcattcggaatgcatcaaggaggcttgcctgctgggcgtggactatcgacaatgacacgaccaactacatgaaaattgttacgtgagtaacagatctgagcacaagtttttgcctaaataaggtaacaaggctatgctttcgagccagtaacagtgcaactgttgaatatcagaagaccgatacttttactcgagacttgaatggaaatcattcttctttatgtggaagtcaggtcaatattgtttggattttggaatatggctccatgttaacatccctcaaaacagcaaaa

SEQ ID NO: 935 - DNA, 517 bp, Amaranthus albus
gctcctgcagcaattgttgcttgtgttcccaaaaaagtgcacattgatggaactggcgaaactgatttcaagatatcacctattgaggtttctgaagctataatatcaggattgaaggaacccattgaggctgaaccagagcttgaggtgccaaaagatctcataaccacagctcaactacaagaattaaggttgatgcgcaatccatcttttacaccactggactcagaacaaaatggcactaaaatctatgacaaagagacaggaatcacccagcgtcgtctttcaaatggtattccagtaaattacaagatttcaagacatgaaagccagagtggtgtcatgcgtctcatagttggtggtgggcgagctgtggaaagtttacatgagaaaggatctgttgatgttggcgttcggactctcagtgagggtggtcgtgtcggaaacttttccagagagcaggtagagcttttctgtgtgaatcatttgataaattgctctctggaatccactgagg

SEQ ID NO: 936 - DNA, 635 bp, Amaranthus chlorostachys
aaatgatgaatactatagagtatcgtgttgattgccagctgttacaacatttgcattcagagaacaaattaagtaaaaggtttccgataggattagaagagcagatcaagaagtgggatgttgataaaataaaaaaatttcatgagcgctggtactttcctgcaaactctactttgtatattgttggggatatagacgacatcactaagactgtttaccaaattgaggctttatttagtcagactggcttggagaatgagacagaggcttccccacctccaacaccaaatgcctttggtgcaatggctagttttttagttgcctaagcttccagttggacttggaggtagttctcaagacaaagcatcaagttctgagcaatcaaaaaacttcaaaaaaggaaagacatgcagtgcgtcctcctgtccagcataattggtccctaccaggaagtggtagtgtatctgatcctcctcagatatttcagcatgagttacttcagaatttttcgtttaatatgttctgtaaggttcccgtgaataaagttcagacatatggagacttaaggaatgtactaatgaagaggattgttctttctgccttgcatttcaggattaacacccgatacaagagtt

SEQ ID NO: 937 - DNA, 408 bp, Amaranthus chlorostachys
ctctctcttattcttcctctgaaatttcactgtaattcagttgatgattatatttgttcttcgattgattgatttatcaggtggaaaaggaggagattttgatgatatagtgttgagttgagtgtttgaggattgtaattgaggttaacaatggcggcggcttcaccttcagcttctgctttacttggtggtgtttcaaatcttcaaattcgtaaaaaattcaataagaattgggatgataattgttcgaagaatattgtggctacttctgggttttctaggtctttttattcgtattctagctctaattgtcctcggttaagtcttcgccgaactcctaattgcaggtggtcaaatgttggtcgaactattgcatctagatcacttactgtgaggaacaatccccgg

SEQ ID NO: 938 - DNA, 1247 bp, Amaranthus chlorostachys
cagtttcagcaggttttcattaaagacactgatgaaagagcttgtgcctatattgctgggcctgctcctaatcgatggggcatcacaattgatggtgttgatctttttgagtctgttcaaaatggtagtggtgagctattaaattctgagacttcgccatctgagagctccaatgatgtaaagaagctgcagagtaaaattcggagccatccactgttctttgggatcacaatgggtttattagcagaggttataaattccagacttttcacaacagttagggattccttgggtttgacatacgatgtgtctttcgagctgaacttatttgataggcttaattttggttggtatgtgatttctgtgacatcaactcctggaaaggtacataaagctgtcgatgcttgtaaaaatgtgctcaggggcttgcacagcaacagaattgctccaagggagttggacagggcaaagaggaccttgctaatgaaacatgaagctgaaatcaagtcaaacgcttactggcttggtttgttggctcatttgcaagcggattctataccaaggaaggatttgtcatgcataaaagacctgaccttcctttatgaagctgccactatagaggatgtatatgttgcatatgaacaactgagggtggacgaaaattccctgtattcctgcattggtattgctggagcccaggctgaggaagaaatttcagatgctgattctttgttggatgatcaagagtcattcggaatgcatcaaggaggattgcctgcagggcgtggactatcgacaatgacacgaccaactacatgaaaattgttacgtgagtaacagatctgagcaaaggtttttgcctaaataaggtaacaaggttatgctttcaagccagtaacagtgcaactcttgaatatcagaagaccgatgcttttactcgagacttgaatggaaatcattcttctttatgtggaagacggtcaatattgtgtggattttggaatatggctccatgttaacgtccctcaaaacagcaaaaaactgcacctttagttttacagaaaattagtgaattccaagtttatagggttcactttataggctttttcattcatttgaatacacaatagttcatagtatagtcttgtaatgtttgttactcctatttcagtattcatttccaaagttgtgatttttctgtgttgtacacttgtacttctacccttcaggaaatgggtcaaatgaat

SEQ ID NO: 939 - DNA, 2115 bp, Amaranthus graecizans
aagatctcataaccacagctcaactacaagaattaaggttgatgcgcaatctatcttttacaccactggactcagaacaaaatggcactaaaatctatgacaaagagacaggaatcacccagcgtcgtctttcaaatggtattccagtaaattacaagatttcaagacatgaaagccagagtggtgtcatgcgtctcatagttggtggtgggcgagctgtggaaagtttacatgagaaaggatctgttgttgttggcgttcggactctcagtgagggtggtcgtgtcggaaacttttccagagagcaggtagagcttttctgtgtgaatcatttgataaattgctctctggaatccactgaggagtttatttgtatggaattccgctttacattgagagacaatggaatgcgtgctgccttccagttactacacatggttcttgagcatagcgtctggctggaagatgcatttgacagagcaagacagttatacttgtcttattatcgctcaattcctaaaagcttagagcgttcgactgcacacaagctcatgttagcaatgttgaatggagatgaacgctttgttgagcctacacctgaatcactgcaaaagttaacgctaaaatcagtgaaagaggctgtaatgaatcagtttgtgggtgataacatggaggtcagtatcattggagacttctcagaagaagagattgaatcttgtattcttgattaccttggtacggtcagtgcttctcgtgatgttgagaagaaggtgtatgatgccattattttccgcccaccttcgaatttgcaatttcagcaggttttcattaaagacactgatgaaagagcttgtgcctatattgctgggcctgctcctaatcgatggggcatcacaattgatggtgttgatctttttgagtctgttcagaatggtagtggtgagctattaaattctgagacttcgccatctgagagctccaatgatgtaaagaagctgcagagtaaaattcggagccatccactgttctttgggatcacaatgggtttattagcagaggttataaattccagacttttcacaacagttagggattccttgggtttgacatacgatgtctctttcgagctgaacttatttgataggctaaattttgggtggtatgtgatttctgtgacatcaactcctggaaaggtacataaagctgtcgatgcttgtaaaaatgtgctcaggggcttgcacagcaacagaattgctccaagggagttggacagggcaaagaggaccttgctaatgaaacatgaagctgaaatcaagtcaaacgcttactggcttgggttgttggctcatttgcaagcggattctataccaaggaaggatttgtcatgcataaaagacctgaccttcctttatgaagctgccactatagaggatgtatatgttgcatatgaacaactgagggtggatgaaaattccctgtattcctgcattggtattgctggagcgcaggctgaggaagaaatttcagatgctgattctttgttggacgatcaagagtcattcggaatgcatcaaggaggcttgcctgctgggcgtggactatcgacaatgacacgaccaactacatgaaaattgttatgtgagtaacagatctgagcacaagtttttgcctaaataaggtaacaaggctatgctttcgagccagtaacagtgcaactgttgaatatcagaagaccgatacttttactcgagacttgaatggaaatcattcttctttatgtggaagtcaggtcaatattgtttggattttggaatatggctccatgttaacatccctcaaaacagcaaaaaactgcaccattagttctacagaaaattaagtgaagtccaagtttatagggttcacgttataggctttttcattcatttgaatatacaatagttcatagtatagtcttgtaatgtttgttactcctatttcagtattcattctcaaagttgtgatttttcttcgtgttgtacacttgtacttctagccttcaggaaatgggtcaaatgaataattgtaactaaaattcttttccttgatttttccaatgtaaaatcataaatattc

SEQ ID NO: 940 - DNA, 2165 bp, Amaranthus graecizans
gcatactctaccagttttgaacgtcttctctcctacaccaatcacaattatatcctttttctctcctccgggtggaaaaggaggagattttgatgatatagtgttgagttgagtgtttgaggattgtaattgaaggttaacaatggcggcggcttcaccttcagcttctgctttacttggtggtgtttcaaatcttcaaattcgtaaaaaattcaataagaattgggatgataattgttcgaagaatgttgtggctacttctgggttttctaggtctttttcttcgtattctagctctaattgtcctcggttaagtcttcgccgaactcctaagtgcaggtggtcgaatgttggtcgaactattgcatctagatcacttacaatgaggaacaatctccggaggcagaaaggttaccttcaaatggatgagcttcccttgacagctttatcccaatctaaagtgcacttgtgctgcaaccacatccatcggagaagagggtcattaattaaaaatgttggttcaagatttcctgcagacaaatcaacatttccattgtcaaagaatgtgcctgacactctatgtgtgaaacaaaatcatgttagatgctctgctgttggtcctgatgaaccacatgcagtcagcacgagttcaccagagggaacattagagaaacctgaaatggactttttcgatcctgaagtaagaagagtagaggtagagaagtttttaaatgctgaacttccttctcatcccaagctatatagaggacagttgaaaaatggactgcgttacataattttgcccaacaaagttccaccaaacaggtttgaagcacatatggaggttcatgttgggtctattgatgaggaggatgatgagcaagggattgcacatatgatagaacatgttgcatttcttggtagtaaaaagcgtgagaagttacttggtacaggagcaaggtctaatgcctatacagattttcatcacacagtttttcatattcattctccaactcgtgcgaaggactctgatggtgacttgctcccttttgtactggatgctttaaatgagatagcttttcatcctaagtttctctcgtcaagggttgaaaaggaaaggcgggcaatattgtctgaacttcaaatgatgaatactatagagtatcgtgttgattgccagctgttacaacatttgcattcagagaacaaattgagtaaaaggtttccgataggattagaggagcagatcaagaagtgggatgttgataaaataaaaaatttcatgagcgctggtactttccagcaaactctactttgtatattgttggggatatagacgacatcactaagactatttaccaaattgaggctttatttagtcagactggcttggagaatgagacagaggcttccccacctccaacaccaaatgcctttggtgcaatggctagttttttagtgcctaagcttccagttggacttggaggtagttctcaagacaaagcatcaagttctgagcaatcaaaaacttcaaaaaaggaaagacatgcagtgcgtcctcctgtccagcataattggtcactaccaggaagtggtcgtatatctgatcctcctcagatatttcagcatgagttacttcagaatttttcgttcaatatgttctgtaaggttcccgtgaataaagttcggacatatggagacttaaggaatgtactaatgaagaggattgttctttctgccttgcatttcaggattaacacccgatacaagagttcaaacccccctttcactgcaattgagttggaccacagtgattctggaagagaaggttgcactgtaaccactcttacagttacagcagaacctaaaaattggcagaatgctatcaaagttgcagttcaagaggtcagaaggctgaaggagtttggtgtgacaaatggtgaattagctcgttatagggatgccttgttgaaagacagtgaacatttggctgcgatgattgacaatgtgccatctgtggataaccttgattttattatggaaagtgacgcattaggacacaaagtcatggaccagcttcaaggtcatgagagtttgctcaatgttgctggaacaattactcgtgaagaggtcaattccattggtgctgaagtactggagtttat

SEQ ID NO: 941 - DNA, 1163 bp, Amaranthus hybridus
tcatgagcgctggtactttcctgcaaactctactttgtatattgttggggatatagacgacatcactaagactgtttaccaaattgaggctttatttagtcagactggcttggagaatgagacagaggcttccccacctccaacaccaaatgcctttggtgcaatggctagttttttagtgcctaagcttccagttggacttggaggtagttctcaagacaaagcatcaagttctgagcaatcaaaaacttcaaaaaaggaaagacatgcagtgcgtcctcctgtccagcataattggtccctaccaggaagtggtagtgtatctgatcctcctcagatatttcagcatgagttacttcagaatttttcgtttaatatgttctgtaaggttcccgtgaataaagttcggacatatggagacttaaggaatgtactaatgaagaggattgttctttctgccttgcatttcaggattaacacccgatacaagagttcaaacccccctttcactgcaattgagttggaccacagtgattctggaagagaaggttgcactgttaccactcttacagttacagcagaacctaaaaattggcagaatgctatcaaagttgcagttcaagaggtcagaaggctgaaggagtttggtgtgacaaatggtgaattagctcgttatagggatgccttgttgaaagacagtgaacatttggctgcgatgattgacaatgttccatctgtggataaccttgattttattatggaaagtgacgcattaggacacaaagtcatggaccagctacaaggtcatgagagtttgctcaatgttgctggaacaattactcgtgaagaggtcaattccattggcgctgaagtactggagtttattgctgattttggcaaaccaactgctcctgctcctgcagcaattgttgcttgtgttcccaagaaagtgcacattgatggaattggcgaaactgatttcaagatatcacctattgaggtttctgaagctataatatcaggattgaaggaacccatagaggctgaaccagagcttgaggtgccaaaagatctcataaccacaggtcaactacaagaattaaggttgatgcgcaatccatcttttacaccactggactcagaacaaaatggcactaaaatct

SEQ ID NO: 942 - DNA, 1460 bp, Amaranthus hybridus
catggaattccgctttacattgagagacaatggaatgcgtgctgccttccagtactacacatggtcttgagcatagcgtctggctggaagatgcatttgacagagcaagacagttatacttgtcttattatcgctcaattcctaaaagcttagagcgttcaaccgcacacaagctcatgttagcaatgttgaatggagatgaacgctttgttgagcctacaccggaatcactgcaaaagttaacgctaaaatcagtgaaagaggctgtaatgaatcagtttgtgggtgataacatggaggtcagtatcattggagatttctcagaagaacagattgaatcttgtatccttgattaccttggtacggtcagtgcttctcgtgatgttgagaagaaggtctatgatcccattattttccggccaccttcgaatttgcagtttcagcaggttttcattaaagacactgatgaaagagcttgtgcctatattgctgggcctgctcctaatcgatggggcatcacaattgatggtgttgatctttttgagtctgttcagaatggtagtggtgagctattaaattctgagacttcgccatctgagagctccaatgatgtaaagaagctgcagagtaaaattcggagccatccactgttctttgggatcacaatgggtttattagcagaggttataaattccagacttttcacaacagttagggattccttgggtttgacatacgatgtgtctttcgagctgaacttatttgataggcttaattttggttggtatgtgatttctgtgacatcaactcctggaaaggtacataaagctgtcgatgcttgtaaaaatgtgctcaggggcttgcacagcaacagaattgctccaagggagttggacagggcaaagaggaccttgctaatgaaacatgaagctgaaatcaagtcaaacgcttactggcttggtttgttggctcatttgcaagcggattctataccaaggaaggatttgtcatgcataaaagacctgaccttcctttatgaagctgccactatagaggatgtatatgttgcatatgaacaactgagggtggacgaaaattccctgtattcctgcattggtattgctggagcccaggctgaggaagaaatttcagatgctgattctttgttggatgatcaagagtcattcggaatgcatcaaggaggattgcctgcagggcgtggactatcgacaatgacacgaccaactacatgaaaattgttacgtgagtaacagatctgagcaaaggtttttgcctaaataaggtaacaaggttatgctttcaagccagtaacagtgcaactcttgaatatcagaagaccgatgcttttactcgagacttgaatggaaatcattcttctttatgtggaagacggtcaatattgtgtggattttggaatatggctccatgttaacgtccct

SEQ ID NO: 943 - DNA, 463 bp, Amaranthus hybridus
tggctacttctgggttttctaggtctttttattcgtattctagctctaattgtcctcggttaagtcttcgccgaactcctaattgcaggtggtcaaatgttggtcgaactattgcatctagatcacttactgtgaggaacaatccccggaggcagaaaggctaccttcaaatggatgagcttcccttgacagctttatcccaatctaaagggcacttgtgctgcaaccacatccatcggagaagagggtcatttatcaaatatgttggttcaagatttcctgcagacaaatcaacatttccattgtcaaagaatgtgcctgacgctctatgtgtaagtgaaacaaaatcatgttagatgctctgctgttggtcctgatgaaccacatgcagtcagcacaagttcaccagagggaacattagagaaacctgaaatggactttttcgatcctgaagtaagaagag

SEQ ID NO: 944 - DNA, 549 bp, Amaranthus hybridus
atcttcgtttttcaacttaatgttcatactatttcctagaagtatttctcttctttatttccatcatcttcttctacaatctcctcatttatgcatataagtcaggagaaattcaaatagatattggttgtcggcgcctgactttcttcactattgctctttgcagtttcatcgtcgaggagttgctgattttccttatcaaaaaaagtgtgagaaaatggcggcttcagcttctgctgtactcggtggtgtttcgattctacaacttagcaaaagtagggatgcaaagacaaagtgttcgacagttgttgctgtttccggatttcctcggtcaattacttcttgttctagcccgaatcatcctcgattaagtgtttgccaaactgcttccagcttttccaagtttaggctaaaagattttcacacattagcaataccatccaagagacatcactttgtacttacaccttgttgctgtagtgctagtacagacattgacccagaggaatcaagcattaatatacagcttcctagaagaagattgcttgt

SEQ ID NO: 945 - DNA, 900 bp, Amaranthus lividus
ttctccaactcgtgcgaaggactctgatggtgacttgctcccttttgtactggatgctctaaatgagatagcttttcatcctaagtttctctcgtcaagggttgaaaaggaaaggcgggcaatattgtctgaacttcaaatgatgaatactatagagtatcgtgttgattgccagctgttacaacatttgcattcagagaacaaattaagtaaaaggtttccgataggattagaagagcagatcaagaagtgggatgttgataaaataaaaaaatttcatgagcgctggtactttcctgcaaactctactttgtatattgttggggatatagacgacatcactaagactgtttaccaaattgaggttttatttagtcagactggcttggagaatgagacagaggcttccccacctccaacaccaaatgcctttggtgcaatggctagttttttagtgcctaagcttccagttggacttggaggtagttctcaagacaaagcatcaagttctgagcaatcaaaaacttcaaaaaaggaaagacatgcagtgcgtcctcctgtccagcataattggtccctaccaggaagtggtagtgtatctgatcctcctcagatatttcagcatgagttacttcagaatttttcgtttaatatgttctgtaaggttcccgtgaataaagttcggacatatggagacttaaggaatgtactaatgaagaggattgttctttctgccttgcatttcaggattaacacccgatacaagagttcaaacccccctttcactgcaattgagttggaccacagtgattctggaagagaaggttgcactgttaccactcttacagttacagcagaacctaaaaattggcagaatgctatcaaagttgcagttcaaga

SEQ ID NO: 946 - DNA, 528 bp, Amaranthus lividus
aattagctcgttatagggatgccttgttgaaagacagtgaacatttggctgcgatgattgacaatgttccatctgtggataaccttgattttattatggaaagtgacgcgttaggacacaaagtcatggaccagctacaaggtcatgagagtttgctcaatgttgctggaacaattactcgtgaagaggtcaattccattggtgctgaagtactggagtttattgctgattttggcaaaccaactgctcctgctcctgcagcaattgttgcttgtgttcccaagaaagtgcacattgatggaattggcgaaactgatttcaagatatcacctattgaggtttctgaagctataatatcaggattgaaggaacccatagaggctgaaccagagcttgaggtgccaaaagatctcataaccacagctcaactacaagaattaaggttgatgcgcaatccatcttttacaccactggactcagaacaaaatggcactaaaatctatgacaaagagacaggaatcacccagc

SEQ ID NO: 947 - DNA, 469 bp, Amaranthus lividus
gctgcaaccacatccatcggagaagagggtcatttatcaaatatgttggttcaagatttcctgcagacaaatcaacatttccattgtcaaagaatgtgcctgacgctctatgtgtgaaacaaaatcatgttagatgctctgctgttggtcctgatgaaccacatgcagtcagcacaagttcaccagagggaacattagagaaacctgaaatggactttttcgatcctgaagtaagaagagtagaggtagaggagtttttaaatgctgaacttccttctcatcccaagctatatagaggacagttgaaaaatggattgcgttacataattttgcccaacaaagttccaccaaacaggtttgaagcacatatggaggttcatgttgggtctattgatgaggaggatgatgagcaaggaattgcacatatgatagaacatgttgcatttcttggtagtaaaaagcgtgagaa

SEQ ID NO: 948 - DNA, 381 bp, Amaranthus lividus
aacgtcttctctccttcaccaatcacaattatatcctttttctctcctccgggtggaaaaggaggagattttgatgatatagtgttgagttgagtgtttgaggattgtaattgaggttaacaatggcggcggcttcaccttcagcttctgctctacttggtggtgtttcaaatcttcaaattcgtaaaaaattcaataagaattgggatgataattgttcgaagaatattgtggctacttctgggttttctaggtctttttattcgtattctagctctaattgtcctcggttaagtcttcgccgaactcctaattgcaggtggtcaaatgttggtcgaactattgcatctagatcacttactgtgaggaacaatccccgga

SEQ ID NO: 949 - DNA, 1774 bp, Amaranthus lividus
taaattgctctctggaatccactgaggagttatttgcatggaattccgctttacattgagagacaatggaatgcgtgctgccttccagttactacacatggttcttgagcatagcgtctggctagaagatgcatttgacagagcaagacagttatacttgtcttattatcgctcaattcctaaaagcttagagcgttcgaccgcacacaagctcatgttagcaatgttgaatggagatgaacgctttgttgagcctacaccggaatcactgcaaaagttaacgctaaaatcagtgaaagaggctgtaatgaatcagtttgtgggtgataacatggaggtcagtatcattggagatttctcagaagaacagattgaatcttgtatccttgattaccttggtacggtcagtgcttctcgtgatgttgagaagaaggtctatgatcccattattttccggccaccttcgaatttgcagtttcagcaggttttcattaaagacactgatgaaagagcttgtgcctatattgctgggcctgctcctaatcgatggggcatcacaattgatggtgttgatctttttgagtctgttcagaatggtagtggtgagctattaaattctgagacttcgccatctgagagctccaatgatgtaaagaagctgcagagtaaaattcggagccatccactgttctttgggatcacaatgggtttattagcagaggtcataaattccagacttttcacaacagtaagggattccttgggtttgacatacgatgtgtctttcgagctgaacttatttgataggcttaattttggttggtatgtgatttctgtgacatcaactcctggaaaggtacataaagctgtcgatgcttgtaaaaatgtgctcaggggcttgcacagcaacagaattgctccaagggagttggacagggcaaagaggaccttgctaatgaaacacgaagctgaaatcaagtcaaacgcttactggcttggtttgttggctcatttgcaagcggattctataccaaggaaggatttgtcatgcataaaagacctgaccttcctttatgaagctgccactatagaggatgtatatgttgcatatgaacaactgagggtggacgaaaattccctgtattcctgcattggtattgctggagcccaggctgaggaagaaatttcagatgctgattctttgttggatgatcaagagtcattcggaatgcatcaaggaggtttgcctgcagggcgtggactatcgacaatgacacgaccaactacatgaaaattgttacgtgagtaacagatctgagcaaaggtttttgcctaaataaggtaacaaggttatgctttcaagccagtaacagtgcaactcttgaatatcagaagaccgatgcttttactcgagacttgaatggaaatcattcttctttatgtggaagacggtcaatattgtgtggattttggaatatggctccatgttaacgtccctcaaaacagcaaaaaactgcacctttagttttacagaaaattagtgaattccaagtttatagggttcactttataggctttttcattcatttgaatacacaatagttcatagtatagtcttgtaatgtttgttactcctatttcagtattcatttccaaagttgtgatttttctgtgttgtacacttgtacttctacccttcaggaaatgggtcaaatgaatagttgtaactaaaattcttttacttgatttttccaatgaaaaatcataaatattc

SEQ ID NO: 950 - DNA, 4429 bp, Amaranthus palmeri
cgagtttactcgaacccagtcccagttttgaacgtcttctctccttcaccaatcacaattatatcctttttctctcctccggtggaaaaggaggagattttgatgatatagtgttgagttgagtgcttgaagattgtaattgaaggttaacaatggcggcggcttcaccttcagcttctgctttacttggtggtgtttcaaatcttcaaattcgtaaaaaattcaataagaattgggatgataattgttcgaagaatgttgtggctacttctgggttttctaggtctttttcttcgtattctagctctaattgtcctcggttaagtcttcgccgacctcctaagtgcaggtggtcgaatgtcggtcgaactattgcatctagatcacttactatgaggaacaatctccggaggcagaaaggctaccttcaaatggatgagcttcccttgacagctttatctcaatctaaagggcacttgtgctgcaaccacatccatcggagaagagggtcattaataaaaaatgttcgttcaagattttctgcagacaaatcaacatttccattgtcaaagaatgtgcctgacgctctatttgtgaaacaaaatcatgttaaatgctctgctgttggtcctgatgaaccacatgcagtcagcacaagttcaccagagggaacattagagaaacctgaaatggactttttcgatcctgaagtaagaagagtagaggtagaggagtttttaaatgttgaacttccttctcatcccaagctatatagaggacagttaaaaaatggattgcgttacataattttgcccaacaaagttccaccaaacaggtttgaagcacatatggaggttcatgttgggtctatcgatgaggaggatgatgagcaagggattgcacatatgatagaacatgttgcatttcttggtagtaaaaagcgtgagaagttacttggtacaggggcaaggtctaatgcctatacagattttcatcacacagtttttcatattcattctccaactcgtgcgaaggactctgatggtgacttgctcccttttgtactggatgctctaaatgagatagcttttcatcctaagtttctctcgtcaagggttgaaaaggaaaggcgggcaatattgtctgaacttcaaatgatgaatactatagagtatcgtgttgattgccagctgttacaacatttgcattcagagaacaaattgagtaaaaggtttccgataggattagaggagcaaatcaagaagtgggatgttgataaaataaaaaaatttcatgagcgctggtactttccagcaaactctactttgtatattgttggggatatagacgacatcactaagactatttaccaaattgaggctttatttagtcagactggcttggagaatgagacagaggcttccccacctccaacaccaaatgcctttggtgcaatggctagttttttagtgcctaagcttccagttggacttggaggtagttcacaagacaaagtatcaagttccgagcaatcaaaaacttcaaaaagggaaagacatgcagtgcgtcctcctgtccagcataattggtctctaccaggaagtggtcgtatatctgatcctcctcagatatttcagcatgagttacttcagaatttttcgtttaacatgttctgtaaggttcccgtgaataaagttcagacatatggagacttaaggaatgtactaatgaagaggattgttctttctgccttgcatttcaggattaacacccgatacaagagttccaacccccctttcactgcaattgagttggaccacagtgattctggaagagaaggttgcactgtaaccactcttacagttacagcagaacctaaaaattggcagaatgctatcaaagttgcagttcaagaggtcagaaggctgaaggagtttggtgtgacaaatggtgaattagctcgttatagggatgccttgttgaaagacagtgaacatttggctgcgatgattgacaatgttccatctgtggataaccttgattttattatggaaagtgacgcattaggacacaaagtcatggaccagctacaaggtcatgagagtttgctaaatgttgctggaacaattactcgtgaagaggtcaattccattggtgcggaagtactggagtttattgctgattttggcaaaccaactgctcctgctcctgcagcaattgttgcttgtgttcccaaaaaagtgcacattgatggaattggcgaaactgatttcaagatatcacctattgaggtttctgaagctataatatcaggattgaaggaacccattgaagctgaaccagagcttgaggtgccaaaagatctcataaccacagctcaactacaagagttaaggttgatgcgcaatccatcttttacaccactggactcggaacaaaatggcactaaaatctatgacaaagagacaggaatcacccagcgtcgtctttcaaatggtattccagtaaattacaagatttcaagacatgaaagccagagtggtgtcatgcgtctcatagttggtggtgggcgagctgtggaaagtttacatgagaaaggatctgttgttgttggcgttcggactctcagtgagggtggtcgtgtcggaaacttttccagagagcaggtagagcttttctgtgtgaatcatttgataaattgctctctggaatccactgaggagtttatttgtatggaattccgctttacattgagagacaatggaatgcgtgctgccttccagttactacacatggttcttgagcatagcgtctggctggaagatgcatttgacagagcaagacagttatacttgtcttattatcgctcaattcctaaaagcttagagcgttcgaccgcacacaagctcatgttagcaatgttgaatggagatgaacgctttgttgagcctacaccagagtcactgcaaaagttaacgctaaaatcagtgaaagaggctgtaatgaatcagtttgtgggtgataacatggaggtcagtatcattggagatttctcagaagaagagattgaatcttgtattcttgattaccttggtacggtcagtgcttctcgtgatgttgagaagaaggtctatgatcccattattttccgcccaccttcgaatttgcagtttcagcaggttttcattaaagacactgatgaaagagcctgtgcctatattgctgggcctgctcctaatcgatggggcatcacaattgatggtgttgatctttttgagtctgttcagaatggtagtggtgagcaattaaattctgagacttcgccatctgagagctccaatgatgtaaagaagctgcagagtaaaattcggagccatccactgttctttgggatcacaatgggtttattagcagaggttataaattccagactcttcacaacagttagggattccttgggtttgacatacgatgtgtctttcgagctgaacttatttgataggcttaactttggatggtatgtgatttctgtgacatcaactcctggaaaggtacataaagctgtcgatgcttgtaaaaatgtgctcaggggcttgcacagcaacagaattgctccaagggagttggacagggcaaagaggaccttgctaatgaaacatgaagctgaaatcaagtcaaacgcttactggcttgggttgttggctcatttgcaagcggattctataccaaggaaggatttgtcatgcataaaagacctgaccttcctttatgaagctgccactatagaggatgtatatgttgcatatgaacaactgagggtggacgaaaattccctgtattcctgcattggtattgctggagcgcaggccgaggaagaaatttcagatgctgattctttgttggatgatcaagattcattcggaatgcatcaaggaggattgcctgcggggcgtggactatcaacaatgacacgaccaaccacatgaaaattagtacgtgagtaacagatctgagcaaaggcttttggctaaataagtgtatttcaggtaacaaggttatgttttcaagccagtaacagtgcacctattgaatatcagaagaccgatacttttactcgagacttgaatggaaatcattctttatgtggtagacggtcaatattctttggattttggaatatggctccatcttaacgtccctcaaaacagcgaaaaactgcacctttaacagaaaattagtgaattctaaatttatagggttcactttataggctttttcatttatttgaatacacaatagttcatagtatagtcttgtaatgtttgatactcttatttcagtattcatttccaaagttgtcattttttctttgtgttgtacactggtacttctagccttcaggaaatgggtcagatgaataattgtaact

SEQ ID NO: 951 - DNA, 17980 bp, Amaranthus palmeri
attcttgccaataagagtgaagaatgacaagaatttggatttgcaggaagacttcacaataaataggaacaaatcgaggggaagaagatatgtggatgatcactaaaattgaatttcttaatcgtagtcttgtagattagtattaacatggacagataaaatacaggtagaattgaaattattctccactgaaagtggtccgcatttaaaattttcaacattgagttttttatcttgaaatcccccttataactgtatctgcgtttaaagcactaaaaaacttgttacctctacaaagggttacttttttatttttgaatttgttatttaaaaaatgaatcaaagcaattgataaaggataaatatctaaactaaataaatataaacaaacaaaatatagaaaaaaggtaaacaagaaaagaaaaactatataaaattagcaaaaccttccccttacgaacaccacagtcaaaccctaccctttccccaccctacaaaggacaaatgaccacccttcttatcctcagctgcaaacatctctcaacaccgggtctgactcacagacaccttgacaggcatcacaagcggattggaggttggagctatcattggctcctgtcaattcaggagctgtgggtgggggagggtttgcctgggtgggagctgatgggcaggggggtgtcagggtgggagctgtggttgtggttgtggggtgtacagtgggccatggctagggtggagagggtagtaaaagggggtgcaggtccaggtgaggtgatgggggggagagtttaagattttaatttcttttttataatatgtacctttaggttaatcaagattagcatcagcatgtatactgtaagtaaaaatacaattttatcagatcagataatggaaacaaaatgcacagtgattcaaagatcaccctccagcttagtctcaaagaaaactacagaagataaacggcaccctaagcataaaaaggaaaattacctcaactttggggtctacttcagagttcaacaaactggatagcacttcaaggctattcttggtaatttctaaaaactctttcttttgctcactgctataggtgtgcggcagcatcacattcgatagaccatttgattctgatccaggaactggatagctttcgggtggcaagacagcatcttcaccaatgtaagactccaaagaatactgcactggtggatattctccatcctctacctgtgcagacatgcttctctttctcaagttctgtcaatttcagttgaagaggcagcacgggagcaaacaagagatattagcactattgtagtatttaagaccaaaataagcactgaataaaatgatattaaatgtaatatggtataacacagatacataatttagtacaatctcagttagtgtggtacttcggagagactgatacacccttttatcattgtacaaaacaccaacttctttacatttcttaaaaacctcagttgaaatacaagaatgctaactcaagcccggcccgaagcttgagtaatgaaactatcaaggtgttaagcaagtaatcagtgatctgaattcaggaatcacttttggagccctagagctacatgtggtaatatatagaaaaaaagtgtcaatatcataatttcatttttaataaacaacaatatttttatctctcaaacagcttcagcaaaagttccataaagtttcaccccattttttgacaactagctcacttcctcagacaagcagagataaaattcacaggagctgtcagaagccagagagtaacgaaaatgaaaatttctcaaagtctccaataaagcatcttacaatacaggaaccaggaatgcaacttcatcactgatcccctcaactacaaaattctattatccaacttcattgtcgatccactaaaatataaaatcttaatacccaaattcatcattaacattactccctcaatccagaaatagttgtaattcgcactacttatcaaccatcccaaaatagttaattgattacactgctctatgtggtatggtttcaccaaaagtaagaaacagaccataaaaataacccatatggcaatactgttctcttaacaaagaaatattaaagaacattctgaacaaaacggaacaaatttgcataacatttagatcatactaaaaaaaattactttatgtgtatgtatttggtcaggctgtccagtcaaattgtataaatttgtatgaatctgggtgccagcccttaacacaaaggaagtttgataaatctcctaaagcacacagcacaaatgtgcccacatggatgactgtataacaagtattaataaagtgaatatattccactataaatacactattactcttcatttagaggtaattgaagcatttactaagaaagaccttaagtcacaaccaaacccaaattactccaaaagccaaaggtcactgtgcacttggagttgggcaaccttctgagcccaattgttcatctttgccttcatctaaaggtggtcttactcgaagactacatagcaccaacaaacctcacgggtatactaatcctcgacttaaccctagtaaaagacaaattaataataattaaattatgttcagcccaatgtaagaccaattactaaaacgttcacacatttcatttaaagcaaaggaacaaatacaacaaagtcatcaaaacgcaataaaacaatctgaagaatgttttcaattcaactaatttgcagaacacttggattatttcaagcaaactatcaaaccataacgtaacacgttcatgcatttgatctaagcaaagaaacaaactcatcaaaagcaacaaaatatccttaatagtacctcatatgtttgtcgaaaaatcggcaaataactcaactcatcagactcaccccaagccctaattaactccatagctctaacctgagactcacgatcagcttgtggattctcaatcaatttaacaaccatatcctccacaactttctccgacgcgatctcagaaaacactttctcacaattcatcgcacaagcttcaagtaactccaatgctaacctcatcgcaaccgcatcaacatttccaacattattaatcttcttcttaattgccttcacaatttctgccccactcaattcttcagcattaattaaagagcaaattctcaaattaagaccccagtcaggggattcaagtgtcggagtcgtagcttggtcgacgattcgtgattcaggagtaggagattgaagaagatccttcatttccttaactttgagggaaattgtccttcccatttgtgctccgcctagtttaaggcgttctccaatggaagctagcttggatttgtccattgttagggtttgtgatgaaggaagttctagggttacggatttgtgaaatgtaattgatggtgatgaatttgaagtttgaagagtggaaataggaacgattgttgatgaatgaaaagaggaaagtaagggagtgcttggactttttcggaattgagaagagagctagagcgggtacgcgcgggcactatgggatgttcaacaaaagaataataattaatacttccccgaaccaatttagttgtcctttttacttgggcacagttattaaaggtgatgtagggtctattaaaaaaattgatagttaaggtattttaattaataaaattaattgtaaaggtggtagttagagtattgtaagtagtaaaagtagaggtattttggtctttacttgtgtgaacataggatatttaggtaaaaaaaaaaagattgacaaaaaaatgtgacaattgatatgaatttgtcaaataaggaaatgtgacaaccaaattggttcagaggaaggagctgatagttgaatgggatatctagttgattataaatttttgaaattaattatatcaatcagttgattttaaattcgttgctataggcattttgttaaaaataacttattttgcatacaaattgtgtactaaaattatcgaatagattattgtgccaaactcctatatgtgtactaaaatttgatgatatatgatttctcaaattcagattttaggtgatatgcactaatttttataatgttttggtttagtctatttggacatcattgttaccattttatagaagtattactcagtaaggtccctttaagcttgcagttcactatttaaaggaatagactaaataatgtagtattacatttaggcttatagtcttaataaggcttttaagatgttaaggcggggtggttgttgtccatgtgtggataggtggttgttgagatggggaaaggcggtggaagggcaatatattaatatcttttgagatgaggtggttttcgctttaggtaggggaaagatttaggaagatagaggccgataatgggcttgcgagggggtttgtttgtgtcgacagtgggcgaggaggagaggggtggttagttggagcaagggcaggtgttcacgaatgttttatcatcgtcatcaaactgtgtatattctacttatagaaaaatatgatcagggtatgaaaagggaagaaaaacggtaattcataaccgtaaaaggaaaatgcgatcaaagagtctttcggctcaagaaaaatcctcataaaagagtgaatctgttcgacaacctgcaactcacaacactcaatggcggttaacaataattaaaaaagaataaaaaacaaataaaatacacaggaaagaaaaagcaaaaataagaaggcagaaagataaaaagagagtaaaagaacaatatataaaaaggcaaacaagtggaacataattaatatttaagacgtggataagacgcgtgaataagacgtctccaactacccttgtccccgggatctagttcatgcaagtcattttttatttgttcctctcacattttcttaggtctcgcttgacttctcttattctccactataatacgttcgattcttctcctatattttgatagttataattcctaatatacacttattaagatccacaatttgacatatgaaaaagattttattttctagttttgtctctattttgatgcgtaacagaacgaaatagagccacgcaattcaacttgattttagaaagatattatggcattacacctaaatttccaaaccgccaagccattatcccaaaccccaaaacaaaaccaccagaaatccaaactcttaaaactcatttcttaattttttttaaatgagtaatttaatttaactcatttcatttccatttattttttccatattgataaaaaaaaatatatgaagattttatattttattttagcatagcgatcaatttaaacacataggaagtattattttatgatctttagtagttgctacatggtcgacttattttcaatttaaatttattttatttaatttaatactttttttttgcaatgattttcataatttttatttgattttcatccataaatttattttgatattttataaattagttgtctttcttaccaacaactttttgatatttaaatatttacaaagggttgcaaattataagagacacggaaaatgacaatagttatacataaaaaattttaaatctcattatttagtttttgcatataactaaatataatcaaatataattttaagtggtttgtgttaatgtataaaggtattttatatcataaaatttttatttatttaataaattttttaaaaatttttttaacaatgtatatcaaaatatattaataaaaaaaaaataaattatgcatttggtgaaaaatattagtactattatttatttaagaaaacattaatgttaataatctaaccttttatcaactcgccatgaataattctaattttaaattattttttaataaaccaatatttacttttacttttaatttcctgttatggtaagctggtagtaaattaagaccaaagattaaattattataaaataaaaaattatatcaatagcaaactaaaattaaaaattactttattaaaaaataacctaagataaaatttattgggattccttgatggacaaaaatagaattataaatatcaaaattttcttttatttatttaattttgtgcaacgagtttactcgaacccagtcccagttttgaacgtcttctctccttcaccaatcacaattatatcctttttctctcctccggtaattcactttctctctcttattcttcctctgaaatttcactgtaattcagttgatgattatctttgttccttgattgattgatttatcaggtggaaaaggaggagattttgatgatatagtgttgagttgagtgcttgaagattgtaattgaaggttaacaatggcggcggcttcaccttcagcttctgctttacttggtggtgtttcaaatcttcaaattcgtaaaaaattcaataggaattgggatgataattgttcgaagaatgttgtggctacttctgggttttctaggtctttttcttcgtattctagctctaattgtcctcggttaagtcttcgccgacctcctaagtgcaggtattattgcatatttcaaattgcttttgtttacatggttaggtttagagcttattaattgagattataattggtttactttaccgaatacttatatttagttgtgtaatattgtcatttcaaatatccatgcatattaattgtaggttctgaattacgatctagtatgttgttagttttaattagttgtattacatggagtagtaaataacttactggtttgtgtgagaattctacatttactattttgggatatattgagactgttgtttgttaagtcttatgataattttcccagtctcgggtaatgtctgagcgtccaacttgctggattattgaaatttgaaaatattatatttttggtcctgacattgagtactcgagataaaatgagagccaataacaaatgttataattgccattggagtttgtatgagtttctttattttgagggacagtctgagattagcgtgaccatttagtaaatttatatcatcatcataccggtatatcactctcatagtgcattttattttataatagggtattattcattattaaggttcgtctaataaaaatcgatgaatgtatttggttgaaggaatttaaattttggagtcagggctgtcatatcaggttgaagatgtggtacatgtacaaaagtcattttttaaaatttgttatccttatggttgtgtacaaaaaagttgctaaaagaaggggattttatgatgttgagtggtgaacatttgttgtaaatattctatacacttaattgacattgttaaatgatattgggttgatgctacgagagttggaatttagttaaaaatacacaccagggtttatccagttctgaacttgattcaacaaaacaatcgtactggaaataagaagcgagggctatgatgtatgtttgtctacagccaaaggttgctagttgctgcctttgacgtttggtaacattttacacgggatacggcttttttcattgactgttttttgggtggacaaaggatttgaaaaacaatattaaggtcgaaaaggatttttcatatgacaagcttttagacatcgtaatgtgtagtttttggtatttagttgctctggatctaatattgtaccgctttttctttgcaattgaattgagaaaggtggtcgaatgtcggtcgaactattgcatctagatcacttactatgaggaacaatctccggaggcagaaaggctaccttcaaatggatgaacttcccttgacagctttttttcaatctaaagggcacttgtgctgcaaccacatccatcggagaagagggtcattaattaaaaatgttggttcaagattttctgcagacaaatcaacatttccattgtcaaagaatgtgcctgacgctctatttgtaagtaagcttaattgcttaaacctttcatcaaatttactaaatgcttgatctcattttgcatcttttttttacattgcccatcagtggtgatagctactcatgcactgatcatcagcatactatgctattaggagttgcttatttaaacagctctattgaggggatctaactatttagtttaataagaaatgtgtaggcattgaaatgttaatttattgccaatggtcctttctatatgaatagtaggtttcaactgttcttttgcagctgcttgaacttcagtcttgacaatgattgcaatcaaaagcgtaaatctcattttaattatgcttagttgcttcatttattgaatagaagataccgttagccatatagacactctttctgctccctggagtctggactattgttgagttctgagcactcaaatgagatgcatatggaacgttcatatgtcatgtaggctgttaacctaataggtattcttattttttcattgagacatgcatcaacatcatatttggtacagttttcaggctttctgtttatcttataaggattagccataagcattgtgtttctccagtggaaagttctcctgtttctggattatctggaagctttttaatgagtgtatagtgaacattttcagactctcatcaagtttcttagtataacgtagtgtggcatctggcatggaataaaatgaggttgttacgccaaataatggttgctttataacggattttgagcttaccattccaagaaaccttatcatgtaacttttgatgtaagatgttattctaaacatattagccgtcatatttatttttaatatgtattaggttctaaaaggtctattaaaagctttagtttaaatacatgttctagaaaacttgaatactataaaatgatgttttttcaagataacaagttagtttgtgatgtccctgaaactattcgtaactcgtaaccccataaggttcctccctacgtgacgtctaattgttaccataatcgaaacaacatctgcgattttttcaatgctgtgtggtcagagttagcaatctagcctccctgcttatgctactgttatattttatgcacctccctgcttatgctactgttatattttatgcatccaaacactttctcctaggacaagcattggatgcatggaatcctagcctcatattttgtgatttgaggaataggaggcttgagctgaaagttccaacttgataaagattaatggatgcaattgcataaataggactgtatcttaattcttaaggatgttgtgacttttttttttttgaaaaattttcatctcatttaatatttgtatggtttaggtgaaacaaaatcatgttaaatgctctgctgttggtcctgatgaaccacatgcagtcagcacaagttcaccagagggaacattagagaaacctgaaatggactttttcgatcctgaagtaagaagtgtagaggtagaggagtttttaaatgttgaacttccttctcatcccaagctatatagaggacagttaaaaaatggattgcgttacataattttgcccaacaaagttccaccaaacaggtacgatggcaagttttccgtttccctcccatgattcatgtgtttaattacagtctgcatgtctctactgaattatgttccactttctacacctctttgattgatgaagttcatgtctttgggtcataaaatgtgttcaaacttgagtcatgggagtgactgttgtccagcttctttttcttttttttgtttttttttattgctattatttaccatattagattgcaattcattcacttattaccttttaggtttgaagcacatatggaggttcatgttgggtctatcgatgaggaggatgatgagcaagggattgcacatatgatagaacatgttgcatttcttggtagtaaaaagcgtgagaagttacttggtacaggggcaaggtctaatgcctatacagattttcatcacacagtttttcatattcattctccaactcgtgcgaaggtctgttgctttcttcagaaatctctgtttgtcaatgatgtatatcggttccagcactggtcaaaatttctaattcaacacactttgcttactgctgtacttcctttatctctcgtttaaagagtaactaatatttagaactagtaaatgctcgcaagagtacatgttataaaatattcataactcaggatacacaatttgtttcatgattttttttgttatctaaaatatcatgttgattggagtggtgcagtagctctgaatttttttgaggttgtgtaataaactgtgtatagtgaaagtatggcctgtattaccatatcgcgatcatattgtaaatgttccgcaattgaaatgatggccgattcaaccgcaaaaccatatgcattgaaccaaaaaaccatatgcatcggtggtttgttaaaataaaatatgtacgcctacactataaaatgtgaccagtttgatgggcttctgaaaagagcctattggattataattagcatatagggagtaaatttacattaaacaagagtctgtatggtgtttggtgatgtgaatgatttttacttataatagcatgagcatttttaaatgagtgtttttgacttttaatcttgagtttgtgtatgtattttgtttacggaagactttattctacatgttaatttctattttctgacaaggacgtaggttaacaagtatttgctcatttatatgctcaccaactacatatttgtggtattttctaggactctgatggtgacttgctcccttttgtactggatgctctaaatgaggtattactttacattgctcgatttccagaattatcctattttcctttacttcctagcaacttattggagtaccaagaatatattaagtgaaggtagtttttctgtgttccatgcagatagcttttcatcctaagtttctctcgtcaagggttgaaaaggaaaggcgggcaatattgtctgaacttcaaatgatgaatactatagagtatcgtgttgattgccaggtttgtgaaggtttgagggtggccacacctcatctatgtctattttatctgcttgttgtaccggtggtttcttttgatgaaaataacaactttcaagtgtattttttcatttcattgcttcttgcagctgttacaacatttgcattcagagaacaaattgagtaaaaggtttccgataggattagaggagcaaatcaagaagtgggatgttgataaaataaaaaaatttcatgagcgctggtactttccagcaaactctactttgtatattgttggggatatagacgacatcactaagactatttaccaaattgaggtgagaggcatatatctctattgctcctccttcttgtcttttgtctagctgtgggtttcatctttcatgttatgctttaatgaaaatgcaggctttatttagtcagactggcttggagaatgagacagaggcttccccacctccaacaccaaatgcctttggtgcaatggctagttttttagtgcctaagcttccagttggacttggaggtagttcacaagataaagcatcaagttccgagcaatcaaaaacttcaaaaagggaaagacatgcagtgcgtcctcctgtccagcataattggtctctaccaggaagtggtcgtatatctgatcctcctcagatatttcagcatgagttacttcagaatttttcgtttaatatgttctgtaaggtaatgaaattctttttgctctcaattttttaggtttaatttgaaatgctttgtgcgctatttctttggtttttaatgctttcttgttgcgtatcttgaacggtcaagttcttttctttcaaaagtctgctgaactaatgcctctagctattctatcatactgttccacttatttagctcccaattcgtagcagcttatatgagaaatgttttactgttgcatcatttttcacggtccactctgggcacaaagtgaagttgtacgagctattgtttatatctgaggcacgaggggtgtttaggggttagatgtacgtacccttgtaacaacaaagatgtttgtgatttactttagagcggaaatatcatctacaagttcacgtaattcataagtacaaatgatctaataagctattttacagtaatccattacaaacatataatcataaaatcttgttatgaatgtaattacctatcttcatcatctctagagatgaagaggcgatttaattgaagttaaaatatatgtgaaatcttgttatgaatgtaaccgaaatcaattgttgacttgttatcccacatgcccaactagtgtggatttcgatcctacgtgcctcccttgagaggcgaagacgacattcaaaagtgtggtcaacttggaatcaaggttttcttacagtctttggggttgtttgacaaatgattatacttggattcaaggcgttcatgcagtcttttgggttgtttgactaatgattgtacttgaattcaaggctttcataccgtctttggggtttgacaaataattgttggttgctagctttttgtataggcctgtttttgttggtgtttaagcttgctagctaaatgtttagggagatgtttgataaaattatttagtttagcctacattataagactcgaaacctaactagtcacttttgagtgctcttgacttctttgtttcaaatttgacattttggattgagaatgacccacactcggatcaattcaaaattttggactctcaaacttgtgaaccacccaaacccacgcctgagatgaactaaaaatttgggacatcaaacttgatgtgcacccaacatgctattggcatagcctaaaccctaaaatatatgacaaagcccaactctagatgcaatttcactagcaagttcaaatgtagttgccgacttgatgtggtatggaccgaatttgaatttaattagaccttagatgacatgatccaacgcgagtcaacctcgttgtcttatggcccgacctataaggacccaataccctacaagtaaattatttaacaatcctatggaaaaaggtaactaaaacttgacccgaagacaactcaagattcaatagttgagttgagtggatacgtgatgtacacttttaatggggctttgactcaaagtgacctaatatttggctttccccaagttgtaatcaacttgacttgcaattaaatactttaacaatttaattgacatgaacatgacataaacttgatacaatatgactggtggttacgggctttactatattaagcgtgtcattagcgggacaagtcgtctatggggcgggccgttaagggattttatcacggttgtctcgttccttttttggccccggtgggaaacatgaaagagcccctaaagacgtaaggagtaataaatgatataatatttgagtactttataaaatagcattaatgactgataaaacttagcaaaaaaatgtaaatcgtatttcaatttaatttaagtaaaaattaaacttgtacataaaataattattttggaccatacgatagttagggccttgctctgctttgcctttgttaatcgaagaccatggattttattaaattggctcaatagtgggtcaaaaatgcattcataaatgagccaaacaataagcaactgaatctattttttaacttgattaactatgtacttttcaatacacggaaaatggtgtttttagtttcatgaaattgattatagtatgattgttattaaaatagtcatgaaattgattatagtatgattgttattaaaatagtagtattcttgctacaaacaaaagataattataaaattggattattatgttaaaacaatagtataatattgttataacatcaaataacttggtaaaataactacaataaataactccctgtcaaactgctttaaagatatttgacccgtgacccgccccatgatctgcacgaccgtcgccccgttacctgtaccgcacccgcaaaagcatttgatgacctacattcgacctgtgtcgcatccgatccccccaactaccatgtctgttgggcacaatgtctcttcaaacaacacggatgcacattctttatgttataggcttgagtgttaaatttttgctgagaagtttttctggcttgataatgtttttctagtaacttgaggcatataatgtttgctgttaaatgtcaattcaaaaaaacctttttgttataagggtaagatggcttacatccaatcctccaatctatgccaaagtgggatcaattttatagcattgggggtttgaagtgtttttgtaaaacgccctgcgcatgcatttcttttttgttacttattacttaaaaaaaacttcaatagtgaatttagacagtccatgaattataattttatgcgttttatatctttatcattgtagagtcgtcgtggttaatgcttactgttttgacattcttgttatttccatagtgggaaaatttcgtttctttttctaatttatcgctcttttttccttccatgtgctcaccagtcgtcattgctctattgtaggttcccgtgaataaagttcggacatatggagacttaaggaatgtactaatgaagaggattgttctttctgccttgcatttcaggattaacacccgatacaaggtgctttaattgacaattagtaggctgtatgatgccccttttggccttctcaactcctgtggttctgttacataaatttgaaatcatatatttttttctttaaagttattcattgctatacaatagccagaggcatgtagatcttttctgcaaattgttggttcatttacaacgccgtttgatcattgcatagtactttgaatttgaattgaacgacaaaatagagcatatttgtggttaagttggttgttcatggaaatgttgtaaagtaaaatgcttcatttgtttacgttatgagaatgatcataatttttaagtcgagttgcttgctcatggaataaatgccaattgacaatttagaaagacttgatttctcgagctgagggactcattggccgcaacctcctttcaagggtaaggttagctgtcttctttccctcctcaaagcctgatcacaacttctataggtggaatacactgggtatgatgatgatgatagaaagacttgtttttatttcatgtttgagaatgagagatttagctattgcttatgctttgtgtatacttaggtattttgcctgtcttttacttcgttttatgtgattgtatctcattaaggtccttgaaatccatatatttgtagatgatttttgtgcatgagcttgagtacatttctttaacaagctgtctccccctttatacatctccatgtgtacctctaaatcacagctatttactgaatatgtagagttccaacccccctttcactgcaattgagttggaccacagtgattctggaagagaaggttgcactgtaaccactcttacagttacagcagaacctaaaaattggcagaatgctatcaaagttgcagttcaagaggtttgtgtgatgttaaactagttaaattgtgccacaatctttgctatttgctactgaaatgaatatcaagatgtgggttgatactatttgctttggttgcaggtcagaaggctgaaggagtttggtgtgacaaacggtgaattagctcgttatagggatgccttgttgaaagacagtgaacatttggctgcgatgattgacaatgttccatctgtggataatcttgattttattatggaaagtgacgcattaggacacaaagtcatggaccagctacaaggtcatgagagtttgctaaatgttgctggaacaattactcgtgaagaggtatttctcatatttttttagtctcacattaaaggtctgtgttgaatgtttatacaaatagactaagggtaatgtgagactttggagattcctattgatgagactaaaacaacaattttcaactgagggaaaactcattagcgagctgttaatttctgatgtgatgcatatgggtgtccaacttggtattagtccaagtgttggacttgtcaagtttgaatttttaggacatggggactcatttttgaaggttctgagttctgaatgatttttcaatttggactcagttgtttatgttaagtgtagttgtaatttgtaaagtcatatatttattatagttaatagaattagcaaaaaaggatatataaaatagtctttgtgttataaaccaacaaaggcataagaaagatgccatcttatgaaaaattacaccggtactactaaaagacaaattttttagaaaaattctggatgtgaagctaaatcttgactttttcttcacccttccaagtctcaacatattatattaattaattttttttttgaatttgtattttttttgatcaagaaaaatttatggatgtgaaatataatcttgagtcttgacctttccttcatccttccaagtcccagctttctctcctctgcataagaaagatgccatcttatgaaaaattactcattccttccttctatataaaatttatcgttctctcaacacaatgttggggtactgactattgagattgattcatgccaatggtggctaataggactccttctccttgatttgatccccgattttaagatctaggggtttctttgagttattgaaaggtcagctttctctcctctgcattcaacctgtagtttgttttgacacctgggttaatttgtatggacaccagtacagctggcaggagaaccaagtcccagcatcacagaatgtcagaacggagtcattcaaagtattctgtatttattatgcctctgaatgttaagattaggcactcagtttaaaaagtttgagtagggagtgaaggttcttttgctattagtgtaatagtaagaaaataagctgactgagagtgaagttggtggacaactccatcacttgggatgaagagagaaagagagagagttcgtgtagaggatccacatcttataggatgagttatgtaatcaggagttcatttgctattctggagaaaggaaaacagggaatttatttgatacccatgggttgaaagtgtttgagaattgtgcaccacatatcatacttcttcctttgctatatgcccatatgcccatatatgatgctgcctctgatagtattaacactctcattcttgggctgtctagaatttttctttgttatgtgtgttaaacactacatttcaattttcaaacaatgtttcaaaaattttctctttcagttttctatttcttaggtttttcttgcttttatcgtgtctattctccaattccacttttattttacttttatttgttcatgtctagggatcaccccacatgtgaaatttgggatggaaagtagttttttgacattggtaggaaatttgtgcaaagggattggatcttagttttaaaacaactcctttaagataggctctaaaatcgcttcttttagtcttggctcagcgagatatgcaagttgtgcgcttttgtgtgcattttgcgtgttgtgcattttttttcttcgttttttgagcttttggtctctttaggcataagcctttttagtaatctagaacaattagataaaaatagtctgattcgaagagagaaaaagaaaaggaaaagtaagtgggtcctctactactactaggttgcttcttttagactcttggatggatatgtttgtctttcatacctggtttttaaagttatactctgtagtctaggtcataaggacttgtgtcaactggtaacttggagccagcttttggcgcaaacctttaaaacctctgggctcagacctgagtcctttgggatttcttaactatggttgtaggtattgtgaagcagtaagttactaggtt

SEQ ID NO: 952 - DNA, 1931 bp, Amaranthus palmeri
ctaggactgtgttaggatcttatcctgaatattttatggactgatcatttctagtatattttacaccttttcagagtaaaatagaaatgcttcagtatttctttttcgatgtgaatggggctgtcatctatattcaaataaatcttagggatcaaaggtttttattggttaaaaagcatcctgtacttgaaggaaaaatattggtggcagaactctgttctcaaggtccaattgaattttcaacttaatttgtctaaatctatccttcctactctttgttcttgtgtgagttttgtgttccatgagaacatgcaaatatctttaatattttacaatatgttgtgaaataacgggtggaaagtggtcgtgattttctagtgtaacttttctttaccaaaattaagggcttttggggtggaattaatttggtactttggctgcttgtgaattttatacttcacttttgataagattgggtcattacatggctttgagtctactattctatcctttaatattgcatttgtatgtaaagtataagtttcaaaagctataataggactaaaattggctattccttgaaggttaattccattggtgcggaagtactggagtttattgctgattttggcaaaccaactgctcctgctcctgcagcaattgttgcttgtgttcccaaaaaagtgcacattgatggaattggcgaaactgatttcaagatatcacctattgaggtttctgaagctataatatcaggattgaaggaacccattgaagctgaaccagaggtgcagttcttaaaagaatttttaaatgcttcttcaatttatatttatttttgtcttgttgattccattattgttctgtcttaatttttccagcttgaggtgccaaaagatctcataaccacagctcaactacaagagttaaggttgatgcgcaatccatcttttacaccactggacttggaacaaaatggcactaaaatctatgacaaagagacaggaatcacccagcgtcgtctttcaaatggtattccagtaaattacaaggtaggacagccatttcatgtgtatttgttggttatatttattttgtgggattgtcatgcattgtatcttgcattttggtctactgccattattgaaggtcattcaaatctgttataaggtctagaatcacataggagattcctgtatgacaatgcttttgtgcagtgtcttcttgtgttgtgtacttgtgtattcttctggactaccctaaatgctcgacatcccaatgaataggtattggtctagagaaaagaaaccttttcaactagaatggctgtttttatatgctgcttgtacgaggtttcctcatcacctcctgtatatttggcaaagagtatgttttctcaaaaagtaccttataaaaccttcagtatataagaaactactgacctcaatataattttggtctgagatactagacaagtttgtgaattagcactgtagcactttttgcctatttctttaaagaagtcatcattcctgctgtagtgctgtgtaactcctttttcccccaacagcccacagtattgtgttcttcaggaaacacaactttatgccggttcagttgatataaaaaaagaaagggaatgtgaaggtgcaaaggcataagcataaggtgggtaaaatggctagaatagatggtacaacacctggaaattcgatttccttgtcacaataatggcttttatcctgtaagcttgttttgttctgtaaggaattcctcgccttcaaaaaaactgtaaaatgtatttccttcttgaattgaaggttttaaaattttttctttcgtaaaaaataaaaaataccgaagtataaatgattgaattgaagaaagagaaaactgaaaaaagaagcagtttagggaccagaaagtagaga

SEQ ID NO: 953 - DNA, 3630 bp, Amaranthus palmeri
ctcaaaacagcgaaaaactgcacctttaacagaaaattagtgaattctaaatttatagggttcactttataggctttttcatttatttgaatacacaatagttcatagtatagtcttgtaatgtttgatactcttatttcagtattcatttccaaagttgtcattttttctttgtgttgtacactggtaattctagccttcaggaaatgggtcagatgaataattgtaactaaaatccttttccttgatttttccaatgtaaaatcataattattcttttttgacctttatcttttctgaaacaggggatcaattattttccagcacatcatgttttacatgcagacttgagattagagtacaaaagctatcatatgatagtataattgggattgctcggattatattatctcttaaaccttccaaacaattttgaattcaatcaacaagcataacccacaaatagttaacttcggataaatcaatggctacaaacttcaaaataatcttgcaaaaagaaaatgcatgcattagaatagtaactgattcgactatagctcatagggctgaacatagtttggtcaaaaccgtaaaccaaatcagaccaaaccgtaattcacttatatggtctggtctaccgtctacggtctaactggtctggtccggtttttatttttaaacaattacggtttccggtccggtataggttttaaaatttttagaccaatccggaccataaaaccggaataattatgaacatagacttaaaggcccacttttaaaataaacttaaagcctaagttgaaaaccctaagctggaacttatagaataccaacatttcattagaataaggaataatgtttcatctttaactgcggtgctcttcttcatctttcatggttcttctactcttcttattttcttattttctttttttttttttcctttttgaataactcttctcattttctttcatcaacccttaagtctaattttcaagataaataactgtaacaatcttgtaatgtatatatactattatcagtttgttgttctttaatacaagaatttctgttgtttttttgttgatttttcatcaattttttttgttgatttcaatatgtagcaatgttagggtttgctagtttgctactcttttttcagtatgttattctttatttttggaatttcagttttgtgatgtactagtgtttagtgtttgctgatgattattatttcaaattataaaaaggaaaaattgctttaaaaaatgtagatgaatacatatcttattaaaaatggctttaaatagaaaaatcgtagactaaaccggatcaaaccgttgtagaacggtccggtcggatctggtgttataattggtctggtctgatctgaaaattttccagaccggaatttctggtttggtctaatttttgtaacagataagaccagattgtaccgtgtgcacccctaatagctcactcaatgataattcatttttacctaattttattttaaccaacaaaaagtcaaaaacaatgatcttattatatggagtaaatccatattattattgtagatttaccttttcatataacacaatttgatttcatatgattgaaaatatcacacttttttcaatttgttttatcattattgtatgtaatgtattctgctcataagatttatgattaaagcctgaagagggatgaatgatgatatataactcatatccataaaggaagatgtggccgaaaagttcttgggcccctcaaatagagagatttctgcaacgatagagaataaatgaatttaaacctatagaccgcaagcctgatttctatgctcatcttctttaatttatttttgttacattatacccgatgttacatctatactattccaacaaaataacaaaatcgtaagcaaaagtttagttgtcccctagatttgcctccatctataattgacatttggaaaatcaattgatttctcaaagaatctcatgatagttataaattgctttataaaagaaaaaagaaagcatgcattatcattgagggactacactttcaaataaaagaacaaacaagtaaagatttattttctccttagatcctaaagtaggtccatttttaactttgcttctttttataaataatctaaaaaaattacaaaccattaattagtttctcaattttgaaattataaagaataaatacaagaatataataatagcataaacttgacttgttcaatgtattgcaaattgcaatgatagtaataactcatattgtcaaacttagatattattataatatacttttatgtccaaaaagcaaaaatggtgtattcattgtagaaataggtgatgattaaatgggtttttattggattctcaattaagtatttatttcatttctttttatttgctctacttttaaaaatacccataaaatgtatatttttaatacttaatactgctaattatataaagtaataaaaaattatttattgaatctgcttattaagatgatattaactaaatctcaaatgactatatttttttaaaaaaaaaatatttaaagagatgatcaaaataggaatatcatataagtcaagactcaagagtattagaagaaaacaaggacaaattattaaaattgctgtgggtccatttggaactgagatttgtgagggtcatcgtggatctctaaacacttagaagttcagtacagatgtctcataaagcctaattgttcaatcatcaagcatggattgctaaacccatgcttaaccctatgttttgctactaattattagttggtccaatacattgatatttaagtagaatctgatattatcttagttaaagtaagtatcgcttttttaggtaaaatcttatgtttaattcacattttttacatttcgatattttatctttttgtataatatttcaacaacttttttgaattgttatacatttttttttcttaattatccaataattttaatatttttcacacaacttaattgcactgtattttttaaaataattgtataaaagtatattgttgtacctttttacatattatttttttattcgtttttatctactcacttttatttatttatatgtattttatatatttacatgtttttgattactaagggttttttcgaggatcatttgtagatctttttcaagttaaaggactttttgtttgtactctcctctataaatatgagttaccgcctttttttcctctccaaatcctgattatagttcctataaatgaaatacatcgagtatgatgactctttggaataaaaagggagtatatagcaagacctaaaccttcaaatcatcatttgaaattgaggtatacttctatgtagtatattcaacttacctatggagattagtagagtagctaggccggctagtcaaagtttgatacttgatagcttcatatttcctccgttccataatacttgttatatttttcattttgagaaattttatattacttgttacatttccttttaagtaaaaaaccaatcatttaaagttatacctacttatattattatcctactctatatctaattactcctatttttctttt

SEQ ID NO: 954 - DNA, 2312 bp, Amaranthus palmeri
cttttgtgtatttcttaatattttagccacatggaccgtttccgatatagaaggataaagttattacaagggtaagcttgcttatatcccatccccctaaatttgcctggacgggattggattattgtaatgttgttgtataccctttcagatatagtgtttcttttctgtaatgatgcaataaagcaatagttaaggggagttggctttaattttctatcatccagatgattagcattgattactaaattagtctatgcataaaaggatttgcggtcttgtacgacatgtgattgactctgtatgtgatgagttccacacagcttttcaaactacctagtacttgagatgtcgtttgtgagtcctatttattgttttctttattgccttgtgtggtatgatgtatatacattatagttttgtttgtcctatagaagtataattttgcatttagcttttttattttaatttctgctgttgacttttacaataatttctgtccaaattaattaataaaaatattataatatacaggcaaagaggaccttgctaatgaaacatgaagctgaaatcaagtcaaacgcttactggcttgggttgttggctcatttgcaagcggattctataccaaggaaggtaaaagttgcctttcaagtttcaactataactttcctctaatctgtgaagcaatttgtttccttcagatctgatgtggtctcttttttttcctctcccatttgacatactttcaggatttgtcatgcataaaagacctgaccttcctttatgaagctgccactatagaggatgtatatgttgcatatgaacaactgagggtggacgaaaattccctgtattcctgcattggtattgctggagcgcaggccgaggaagaaatttcaggtgacaagatgtagttataagttttatatttataaatatgtagaacaaggggaagggggatctattcggaagttcttgtaaaactaaatttctgtcgattggtttgaccatgataatttttttgaaatggaccattattttaaaggtgttgaagttaagatcttataaaacttattgagcagtgccaacggccttatactttgatgtgaagatctatttttcatttccattatgtttagttataatagttgtcaaaaataactccaagtgcttagctaacattacttgtccacataacttattttaagtagttaagcataacacaattaatacgaccaacatactctatttataaatgacttgttttttgactggatatagtattaatagttgctttatgttcaaaaactgcatacatgcatggtttaatttcagtatgcttagtggtgttatagcaactctgagacaattgtctgatctgtagatgctgattctttgttggatgatcaagattcattcggaatgcatcaaggaggattgcctgcggggcgtggactatcaacaatgacacgaccaaccacatgaaaattagtacgtgagtaacagatctgagcaaaggcttttggctaaataaggtacttatctggccttattcatacttatgtcatgtttgtattggagtgaatattctaggggagataaaagtcaaattatgtcaataaatgcaagtaagcgtgatctgagagggaagatgatggaaaggtacacattaatacgaggagggtgaaaaaaaaagaagattatcaagttattttgcggaaggaggagggaaatatttttccttcaacccactagggtatatatttacccctaaattcctctttctccatcaattcatgattatctcttatcatagaagatcaaaacaagcatgattgtaataactagtaaaacacttttgcttataaatttaacattttgatgttttagcccattgaaagttgtgggacttgtcccaactgtggggggtttatcgattaattggattctcacaattcacacctaatagagtagtcttatctcttaaggaatgagctttccctgttgaacttgacaatatccaattatctatagttctctattggtgctgacatttcttgtttgaactttgaccctatgctcaactcttctacggaaacttctgtaaaaaaaaactggtagttcttgattgaccctgtggttgtctcttatggaaaagtcgttgctgttctcgattgaccttataatcaatctcattttaagcagccaagctatacaatgcttagttcttagtctttagtgtatttcaggtaacaaggttatgctttcaagccagtaacagtgcacctattgaatatcagaagaccgat

SEQ ID NO: 955 - DNA, 3187 bp, Amaranthus palmeri
tatatatatatatatatatgtatgtatattcaattttttgtatttactaagttgtctttattattgaactagcaagtttaaaatggggaacaagtctgataagttgcaaaattagatactaattttgaccatgcattggaacctgatttctgaattgaaacattttttattatattttgttctgtacctggccatccaatatccaattttcttgataattaatttggatatccaaatttgttgaattgtttgttagccctaatcggctaatcctgaatgataaatttgttgattgcgaaactggattggtttcttcatgtttgcaggttttcattaaagacactgatgaaagagcctgtgcctatattgctgggcctgctcctaatcgatggggcatcacaattgatggtgttgatctttttgagtctgttcagaatggtagtggtaagttccttacacaactgctggttttgtttgattgctggcctactgctttactcagttgggtgttcacaaattttagatgatactcttatggatgctgctttataatatactccactttgtttatccatctcagaattcatgttcttttatcaaatatactgctgatactattctacccatctccctgaaagggacaaagatagtgtcctgcaatcctacaagttacaactatacagtatggatcctgttgttcacagaccaagatcaattgtcatattggttgtacacaatcatcgacatcactctaatgtagctaaagaagcttcaaagcttctgtcttgggtggaattgagggggaggtctgatgcatctcgtcttatctcattaggagagggttttgagtgacattgaatcttgtgtgctctaaaactaatgcacttcacagtaaatagaagctttgataatttaacaggcgttcgatattgaagttgaataatattacatttaggactccacggggaaatgtgcatagcatttatatggtttctatcttgcgagttgttgtaaaggagcttgaacttgttcacttcacattttatctttggccctgttctttcactgtcaagagccagaaacagaatttagtgaattttaatttgaagacacttgtaaatattatttggaagctaacaaatttgtaccttgctgtgttgatgaattaaaatcctttcttttgatagatttttattacgtcatattgcaaaagaatgtctcttactattcttgtgagtttctgataggtgagcaattaaattctgagacttcgccatctgagagctccaatgatgtaaagaagctgcagagtaaaattcggagccatccactgttctttgggatcacaatgggtttattagcagaggttataaattccaggtaatttattaaatagcttattagattttctttgggattgcaacaaacgcagcacatacacattatgtatgtgtttatgcacgtctttggtcgcacacatagcattggctatttttaaccgagtccacatgcttttgcgatcatcttctaaattgatttacttggcctatattctttgtccagtaattgtgaagtttgcttatgatgaatgtgtagttgtttcggcctctgactaaagtgtatatcccatagtacttttgttatagctagtttattacatgatgttttttctgaatttatgcttatgatatttggatggggtacacttgaatttttttgttgaagatttctgttgaattagttttgttattcagtgttcttcacacccttgatggcagaagattagtggggtgggcaggggctttgccccctcataaactgtttttagaaattgttggttttctctgtcagtcaaatgatgaagcctacatatattagtataaagtctttgagtaggcctacaataaatttcattatagtagtactatttcattgttactctaatttagtggttaccagtttaataattgaataagttcgtgattggtagttttaataaaatttgctttcttcataaataaaattctcatttattatggtctcatcggtttcataatgagacaattcaaaattggactaaattgtccaactaaattaattaaaacatttgctttcatactcaaaatatccactttaattagttattgtttaatatgacattttatatgttaaaccttaaaaatgacactttggatatatacacttattttttgaatttgagctctttgtatggattgtctcaccctgagacgatctcatacaagaattgttcacgaatacaaatattctaatctataaacttgtgttggttgatgctagtagtgtcttatgtatgtgtattatgtttttttgacttaatgattaaatattattatgaaatataaattgttaataaatctcgcccctcccaaaactttagccaagtttcgccgcttcccacccttgtaccttggactaggtgtactatatataaggacagggcattaattcatacactggttccttgttttcctgtgtctttttgttggtggattgcaaggcgtgtatatttcagtgcttagctttgatcggcttcttcgataatttgtgtttggttatttcttcagactcttcacaacagttagggattccttgggtttgacatacgatgtgtctttcgagctgaacttatttgataggcttaactttggatggtatgtgatttctgtgacatcaactcctggaaaggtatggactctgttcgggcattagaaccttctttcatatttcatagaggctttgcttgggagttctgctgatcgaataaatcttcaggtacataaagctgtcgatgcttgtaaaaatgtgctcaggggcttgcacagcaacagaattgctccaagggagttggacagggtaagcgtcttatcctatctttgtaagcttataattatagtctacccccatattttggttgggggatgtgtcaaataaagaagacttacaaagtggtgaggagaaaattaatctcgaaagcaacattggtttatgtctgcatgtgaaccatgtcttagttgatttccatatcttcatatgactggaaaaatcagtctttttgtgtatttcttaatattttagccacatggaccgtttccgatatagaaggataaagttattacaagggtaagcttgcttatatcccatcccc

SEQ ID NO: 956 - DNA, 2663 bp, Amaranthus palmeri
gtaaaaaataaaaaataccgaagtataaatgattgaattgaagaaagagaaaactgaaaaaagaagcagtttagggaccagaaagtagagatgtttggttagattgattttctatgatgtaattcccttttcatatctttagttttaattatttctttcagctttcagtgctctgccttttctttgtttgcctaattgctgattgcattagttcatgcaattttattcatgctccatttatatttttgtagatttcaagacatgaaagccagagtggtgttatgcgtctcatagttggtggtgggcgagctgtggaaagtttacatgagaaaggatctgttgttgttggcgttcggactctcagtgagggtggtcgtgtcggaaacttttccagagagcaggttggtagtgttcatctagtgttttgactgattgcaagtcagatgaatacctgatggattttgattaattctgtggatgccatgatttattgaggcttttgaatgccagtgaatgtgttaggcattagccactactgctgtaaatgttccctgagggctgactagatcttaataacttgggttgtgtattatagaaggctggctggacactaactaaattgccacttgtatctccattacaatgaaattcttatcactgaactagtaatagcgacaaatttgttttagactgttatatgcccagtatcttctgcaccattttcattaatgcttttgaattaaatgaagggatatcttttgtagtagctgttgctgttcatagcttgtaaatgttgctctgatggtaatgattcgtctggcaggtagagcttttctgtgtgaatcatttaataaattgctctctggaatccactgaggagtttatttgtatggaattccgctttacattgagagacaatggaatgcgtgctgccttccagttactacacatggttcttgaggtacttttgctcttttgctattcagaaaattcagatttatatgacttgctgcctgtttgaagcatgcttattctatgctgggagctaataactttttttctttaatgtggatgacctggtctagattagttagaacaataggatcatttacgatgcaacttgttctatcttaagattattgtatttattatccaacactctatagaagtgctttcagttcataatgctgaataaatgtgttatagcatacgaagctcctctttggtctatgccctgttgaactttttcttaagtaattctttgttaatttctataaatgttatgtttttgggaatgatagtacgtgaattgagcttaaattctgaagtgtaaaagttttgctattagcgtttaacaacaacaaaaagtccattataccattaccgtgagactaaaacctgtggacatctcaatcaatgtgctgccaatttgtttcttaggtgctgcaatgtgtttgattttctatcgttgtttaagcttcttgttgacttgcagcatagcgtctggctggaagatgcatttgacagagcaagacagttatacttgtcttattatcgctcaattcctaaaagcttagagcgttcgaccgcacacaagctcatgttagcaatgttgaatggagatgaacgctttgttgagcctacaccagagtcactgcaaaagttaacgctaaaatcagtgaaagaggctgtaatgaatcagtttgtgggtgataacatggaggtaaatgctctttcggtataaaattcaatacatcgttttgaaatatctgtaacataagtcctttggaaatctaaatgatcaggtcagtatcattggagatttctcagaagaagagattgaatcttgtattcttgattaccttggtacggtcggtgcttctcgtgatgttgagaagaaggtctatgatcccattattttccgcccaccttcgaatttgcagtttcagcaggtaagatagttaagatacatatattatcttaaggagtgtttgtttcaaagtttttttctccttagatacaaaatttggcatggctattggtcttttcataaagtggctggactggatatctggtgactggtctgattaaaactggatcagacctccaattgataataatattcacaatcaagtcctgatttggcttaacgggaaagccactttagactggattgaaaaggataatttggatttagtatgccaagatttagtatacagtagtaaaaaatttactctgatgaaaattcatgaatcacaaatcggtcagtgacagttctgctataaagtcataactgtgttttgagaaattattggtcaaagttgtcaaacttatacctaaaaagtcaaacttggaagaatgtataagatgcacagaagggaagaactaataataccgtaaatgaattctgacaagaacgaattacaatattagagtatagaaaaatcttagaagtatattaaactgtctattctaaactagtcacctggaataagttagcaacttaccatagaatctataccagtaaggcataaaaataaaggtattaattctctggcgactagctaagcactcatgataacatgatatacaattggagacattgaaacatgatcattcatacatacatacatacatatatatatatatatatatatatatat

SEQ ID NO: 957 - DNA, 1510 bp, Amaranthus rudis
ggacccaatagcaatgtcttcaacactggcattagagccaccatgaacaaagctaagacaaaccagtacaagaggcgtcttgaatgtcagtattaagctttagcttaatctcgatccatcagcagtagttggtgtcacagtgagaacagggcatccctcagccagcagccacaagttcacggattggtacaatctgtgcagacaacgagggctgctaccttgtaccaattcaccaccatcataatagactgtgaggcagcaaacacgactttggtgagggaaccaggctatctgcaaccagcaccaggaaagctggtgtatcctcagctgttacaacatttgcattcatagaacaaattgagtaaacggttatccgataggattagaggagcagatcaagaagtgggatgttgataaaataaaaaatttacatgagcgctggtactttccagcaaactctactttgtatattgttggggatatagacgacatcactaagactatttaccaaattgaggctttatttagtcagactggcttggagaatgagacagaggcttccccacctccaacaccaaatgcctttggtgcaatggctagttttttagtgcctaagcttccagttggacttggaggtagttctcaagacaaagcaacaagtcctgagcaattaaaaacttcaaaaaaggaaagacatgcagtgcgtcctcctgtccagcataattggtctctaccaggaagtggtcgtatatctgatcctcctcagatatttcagcatgagttacttcagaatttttcgtttaatatgttctgtaaggttcccgtgaataaagttcggacatatggaggcttaaggaatgtactaatgaagaggattgttctttctgccttgcatttcaggattaacacccgatacaagagttcaaacccccctttcactgcaattgagttggaccacagtgattctggaagagaaggttgcactgtaaccactcttacagttacagcagaacctaaaaattggcagaatgctatcaaagttgcagttcaagaggtcagaaggctgaaggagtttggtgtgacaaatggtgaattagctcgttatagggatgccttgttgaaagacagtgaacatttggctgcgatgattgacaatgttccatctgtggataaccttgattttattatggaaagtgacgcattaggacacaaagtcatggaccagctacaaggtcatgagagtttgctcaatgttgctggaacaattactcgtgaagaggtcaattccattggtgctgaagtactggagtttattgctgattttggcaaaacaactgctcctgctcctgcagcaattgttgcttgtgttcccaaaaaagtgcacattgatggaattggcgaaactgatttcaagatatcacctattgaggtttctgaagctataatatcaggattgaaggaacccattgaggctgaaccagagcttgaggtgccaaaagatctcataacc

SEQ ID NO: 958 - DNA, 1685 bp, Amaranthus rudis
ggtcgtgtcggaaacttttccagagagcaggtagagcttttctgtgtgaatcatttgataaattgctctctggaatccactgaggagtttatttgtatggaattccgctttacattgagagacaatggaatgcgtgctgccttccagttactacacatggttcttgagcatagcgtctggctggaagatgcatttgacagagcaagacagttatacttgtcttattatcgctcaattcctaaaagcttagagcgttcgactgcacacaagctcatgttagcaatgttgaatggagatgaacgctttgttgagcctacaccagaatcactgcaaaagttaacgctaaaatcagtgaaagaggctgtaatgaatcagtttgtgggtgataacatggaggtcagtatcattggagacttctcagaagaagagattgaatcttgtattcttgattaccttggtacggtcagtgcttctcgtgacgttgagaagaaggtctatgatgccattattttccgcccaccttcgaatttgcaatttcagcaggttttcattaaagacactgatgaaagagcttgtgcctatattgctgggcctgctcctaatcgatggggcatcacaattgatggtgttgatctttttgagtctgttcagagtggtagtggtgagctattaaattctgagacttcgccatctgagagctccaatgatgtaaagaagctgcagagtaaaattcggagccatccactgttctttgggatcacaatgggtttattagcagaggttataaattccagacttttcacaacagttagggattccttgggtttgacatacgatgtgtctttcgagctgaacttatttgataggctaaattttggttggtatgtgatttctgtgacatcaactcctggaaaggtacataaagctgtcgatgcttgtaaaaatgtgctcaggggcttgcacagcaacagaattgctccaagggagttggacagggcaaagaggaccttgctaatgaaacatgaagctgaaatcaagtcaaacgcttactggcttgggttgttggctcatttgcaagcggattctataccaaggaaggatttgtcatgcataaaagacctgaccttcctttatgaagctgccactatagaggatgtatatgttgcatatgaacaactgagggtggacgaaaattcgctgtattcgtgcattggtattgctggagcgcaggctgaggaagaaatttcagatgctgattctttgttggatgatcaagagtcattcggaatgcatcaaggaggattgcctgcggggcgtggactatcgacaatgacacgaccaactacatgaaaattgttacgtgagtaacagatctgagcaaaggtttttgcctaaataaggtaacaaggttatgctttcgagccagtaacagcgcaactcttgattatcagaagaccgatgcttttactcgagacttgaatggaaatcattcttctttatgtggaagacggtcaatatggattttggaatatggctccatgttaacgtccctcaaaacagcaaaaaaactccaccattagttttacagaaaattaagtgcattccaagtttatagggtttacgttataggctttttcattcatttgaatatacaatagttcatagtatagtcttgtaatgtttgt

SEQ ID NO: 959 - DNA, 1079 bp, Amaranthus rudis
ccgcatgtgaaccatgtcttagttgatttcaatatgttcatatgattgggaaaatccggtctttttgtgtatttcttaattattttagccacatggaccctttccgatacaaggataaggttattacaatggtaagcttgcttatatcccatccccctaaatttgtctggatgggattggattattgtatgttgtataccctttctgatagtgtttcttttctgtaataatgcaataaagcaatagttaaggggagttggctttaattttctatcatccagatgattagcattgcttattacttggttagtctatgcataaaaggatttgtggtcttgtacgacatgtgattgacgctgtatgtgatgagttccatacagcttttcaaactatctagtacttaagaagttgttcgtgagtcctatttattgttttctttattgccttgtgtggtatgatgtatatacattatatttttttttgtcctatagaagtataattttgcattttgcttttgtttttattttaatttctgctgttgacttttacaataatttctgtccatattaatcaataaaaatattataatatacaggcaaagaggaccttgctaatgaaacatgaagctgaaatcaagtcaaacgcttactggcttgggttgttggctcatttgcaagcggattctataccaaggaaggtaaaagttgcctttcaactataattttcctcaaatctgtgaagcaatttgttacctttagatctgatgtggtctctttttttcctctcccatttgacatactttcaggatttgtcatgcataaaagacctgaccttcctttatgaagctgccactatagaggatgtatatgttgcatatgaacaactgagggtggacgaaaattcgctgtattcgtgcattggtattgctggagcgcaggctgaggaagaaatttcaggtgacaagatctagttataagttttatatttataaatatgtagaacaaggggaagggggatctattccgaagttcttataaaactaaatttctgtcgattggtttgaccatgatatttttttt

SEQ ID NO: 960 - DNA, 615 bp, Amaranthus rudis
ttaaaggtgttgaagttaagatcttataaaacttattgagcaatgccaacgaccttatactttgatgtgaagatctatttttcatctccattaagtttagttataattgttgatgtcaaaaagaactccaagtgcttagctaacattacttgtccacataacttattttaagtagttaaacataacacaattagtgcgaccaacatactctatttgtaaatgacttgtttttttgacgggatatagtattgttaatagttactttatgttcaaaaattgcgtacatgcatggttcaatttcagtatctttagtggtgttatagcaactctgagacaattgtctgatctgtagatgctgattctttgttggatgatcaagagtcattcggaatgcatcaaggaggattgcctgcggggcgtggactatcgacaatgacacgaccaactacatgaaaattgttacgtgagtaacagatctgagcaaaggtttttgcctaaataaggtacttatctggcattattcatacttatgtcatgcttgtattggagtaaatatttaaggggaaataaaagtcaaattatgacaataaatgtaagtagacgtgatctgagaag

SEQ ID NO: 961 - DNA, 3371 bp, Amaranthus rudis
cacaaatcggtcaatgacagttctgctataaagtcattagtatattttgagaaattaatggtcaaagttgtcaaacttatacctaaaagtcaaacttggaagaatgtataagatgcacagaagggaagaagtaataataccgtaaatgaattctgacaagaatgaattacaatattagtgtacagaaaaattttacaagtatattaaactgtctattctaaactagtcacctggaataagttagcaacttaccatagaatctataccagtaaggcttaaaaataaaggtattaattttctgtctactagctaagcactcatgatatacaattggagacatttaaacgtgatcaaacataattttttttcaattttttgtatttactaagttgtctttattattgaacgagcaagttcaaaatggggaaaaagtctgataagttacaaaattagatactaattttgaccatgcattggaacctaatttctgaattgaaacatttttgattatattctgttctgtacctagccatccgatatcaaattttcgtgataattaatttggatatccaagtttgttgaattttttgttagccctagtcggctaatcctgaatgataaatttgttgattgagaaactggattggtttcttcatgtttgcaggttttcattaaagacactgatgaaagagcttgtgcctatattgctgggcctgctcctaatcgatggggcatcacaattgatggtgttgatctttttgagtctgttcagagtggtagtggtaagttccttacacaactgctggttttgtttgattgctggcctactgttttactcagttgggtgttcacaaattttagatgatactcttatggatgttgctttataatatactccactttgtttatccatctcagaattcatgttcttttatcaaatatactgctgatactattctgtccatctccctaaaagggaaaaaaatagtgacctgcaatcctacaactatacagtatggatcctgttgttcacagaccaagatcaattgtcatattggttgtacacaaacatcaacatcactctaatgcagctaaacaagcttcaaagctaatgtcttgggtggaattgagggggaggtctgatgcacctcgtcttatctcattaggagagggttttgagtgacattgaatcttgtgtgctttataactaatgcacttcacagtaaatagaagctttgataatttaacaggcgttcgatattgaagttgaataatagtacatttaggactcaacatggaaatgtgcatagcatttatatggtttccatcttgcgagttgttgtaaaggagcttgaacttgttcactttacattttatctttggcactgttctcctttcaatgtcaagagccagaaacagaattaagtgaatcttagtttgaagacacttgtaaattttatttggaagctaacaaatttgtaccttgctgtgttgatgaattaaaatcctttcttttgatagattttattatgtcatattgcaaaagaatgtctcttactattcttgtgagtttctgataggtgagctattaaattctgagacttcgccatctgagagctccaatgatgtaaagaagctgcagagtaaaattcggagccatccactgttctttgggatcacaatgggtttattagcagaggttataaattccaggtaatttattggatagcttattagattttcttttagattgcaacaaacgcactcgcgcgcacatacacattatgtatgtgtttatgcacgtctttggtcgcacacatagcattggctatttttaaccgagtccaaatgctttggcgatcatcttctaaattgctttacttggcctatattctttgtccagtaattgtgaagtttgcttatgatgaatgtgtagttgttacggcctctgactaaagtgtatatcccatagtacttctgttatagctagtttattacatgatgttttttctgaatttatgcttatgatttttggatggggtacacttgaatttttttgttgaagatttctgttgaattagttttggtattaagtgttgttcttcataccctcaatggcggaagattttttaatagtgcggtgggtaggggctttgcccaccaagtttggccagattttttaaatacttcataacttgtttttagaaattgttggttttctctgtcagtcaaatgatgaagctatatatattagtataaagtcttcgagtaggcatacaataaatttcattatagtagtactatttcattgttactctaatttaatggttaccagtttaataattgaataagttcatgattggtagttttaataataatttgctttcttcataaataaaattctcatttagtatggtctcatcggtttcatcatgagacaattcaaaaatggactaaactgtccaactaaaataattaaaacatttgctttcatactcaaaaaaaatatccacactttaattaattatttaatgtttttaatatgacattttatatgttaaaacttaaaaatgatactttggatatatacacttattttttgaatttgagctctttgtatggattgtctcaccctgagatgatctcatacaagaattgctcacgaacacaaatattctaatctataaactttgttgatgctagtagtgtcttatgtatgtgtattatgtttttttgacttaatgattaaatattattatgaaaaaaaaaattattaataaatctcgcccctcccaaaaatttggccaagtttcgccgctgcacacccttgtaccttggactaggtgtacactatgtaaggacagggcattaattcatatactggttccttgttttcctgtgtctttttgttggtgggttgcaaggcgtgtatatttcagtgcttagctttgatcggattcgtcgataatttgtgtttggttatttcttcagacttttcacaacagttagggattccttgggtttgacatacgatgtgtctttcgagctgaacttatttgataggctaaattttggttggtatgtgatttctgtgacatcaactcctggaaaggtatggactctgttcggacattagaaccttctttcatagaggctttgcttgggagttctgctgatagaatatatcttcaggtacataaagctgtcgatgcttgtaaaaatgtgctcaggggcttgcacagcaacagaattgctccaagggagttggacagggtaagtgtcttatcctatctttgtaagcttataattatagtctacccccatattttggttgggggatgtgtcaaataatctacccccatattttggtt

SEQ ID NO: 962 - DNA, 1187 bp, Amaranthus rudis
aatttcctaatgtatgccaagaataaaattaagaagtcattcacatttttcatgccaaagtgtatcgatcatcaatagtaagcactagtaattgcaatcttaacttaaagttttggtacaatatatatcaaaactacatacatacatgattgtattttgattcttcttttaaagttggcgggtatatataaattaatttcaaatttatatggacttacattatatggacttgtattatatataaattaatttcaaaatggtctaatccttagaggtagtcacaatatttatttcaaattttaatttcaaacacaaaattaagattgatcactatgcataaattcaaacaaaaattatatggacttacattattcaagttgtgcctggctgttggacccaatagcaatgtcttcaacactggcattagagccaccatgaacaaagctaagacaaaccagtacaagaggcgtcttgaatgtcagtattaagctttagcttaatctcgatccatcagcagtagttggtgtcacagtgagaacagggcatccctcagccagcagccacaagttcacggattggtacaatctgtgcagacaacgagggctgctaccttgtaccaattcaccaccatcataatagactgtgaggcagcaaacacgactttggtgagggaaccaggctatctgcaaccagcaccaggaaagctggtgtatcctcagctattacaacatttgcatttatagaacaaattgagtaaacggttatccataggattagaggagcagatcaagaagcattatgtagcaacaagcaactaaaccaatgatcataaaaattacaagcaactaaaccaaagatatgatgaagaatttcaggaagtgcttatgatctagtgtaatcaggtgtaggtaaatgcgtagttataatcgtgtactgggacttactcatggtgtaatacatagtctacccctatgacagcagcacgtcacagtaatgataacagaacgcagtagcagcgattgcaacatcattgatatgcccacagattcaacaacaaaaagcaaccgctacagcctcaataagcccacaacagcagcctcgataagctcacaacaacagcactgacagcaacacaagacagaagcacaaacaacgatagcacatatacaattttctaaattaggatg

SEQ ID NO: 963 - DNA, 1857 bp, Amaranthus rudis
ggctgactagatcttattaacttgggttgtgtattatagaaggctggacactaactaaccacctgtatctccactacaatgaaattcttagtcacttaactagtaatagcgacgaagttgttatggactctgttatatgcccagtatctgctgcaccattttcattaatgcttttcacttaaatgaagggatgtcttttgtagtagctgttgctgctcatagcttataaatgttgctctgatggtaatgattcgtctggcaggtagagcttttctgtgtgaatcatttgataaattgctctctggaatccactgaggagtttatttgtatggaattccgctttacattgagagacaatggaatgcgtgctgccttccagttactacacatggttcttgaggtacttttgctcttttgctattcagaaaattcagattcatttgacttgctgcctgtttgaagcatgcttattctatgctgggagctattaacttttttttctttaatgtggaagacctggtctagattagttagagcaatgttgtatttatctagaactgtcaaggccttgttggcagaatcctcactcacatggtgctgggtgtataattgtattgtttctttcaaagaggctgttgttgttaatcacttggtatgttcagtccttttgtcttatgactagctattccaagtcttcttggagctgaaagtagggtggaacaattggatcatttaggatgcaacctgttctatcttaagattattgcgtttatgatccaacactttatagaagtgctcccacttcatactgctgaataaatgtgttgtagcatacgaagctcctctttggtctatgtcctgttgaacattttcttaagtaattctttgttatttgctataaatgttatgtttttaggaatggtagtacgtgaattgagcttaaattctgaagtgtaaaagttttgctattagcgtttaacaacaacaaaaagtccagtataccattaccgtgagactaaaacctgcggacatctcaatcaatgtgctgccattttgtttcttagttgctgcaatgtgtttgattttctatcatcgtttaagcttcttgttgacttgcagcatagcgtctggctggaagatgcatttgacagagcaagacagttatacttgtcttattatcgctcaattcctaaaagcttagagcgttcgactgcacacaagctcatgttagcaatgttgaatggagatgaacgctttgttgagcctacaccagaatcactgcaaaagttaacgctaaaatcagtgaaagaggctgtaatgaatcagtttgtgggtgataacatggaggtaaatgctcttctggtataaaattaaatacatcgtttttgaaatatcttttacgtaagtcctttggaaatctaaatgatcaggtcagtatcattggagacttctcagaagaagagattgaatcttgtattcttgattaccttggtacggtcagtgcttctcgtgacttgagaagaaggtctatgatgccattattttccgcccaccttcgaatttgcaatttcagcaggtaagatagttaaaatacatatattaaggattgtttgtttaaaagtttttttctcctttgttacaaaatttggcatggctattggtcttttcataaagtggcaggactggatatctggtgactggtctgattaaaactggatcagacctccaattctttgggatactaatattcacaatctagtcctgatttggcttaacgggaaagcccactttagactggattgaaaaggataatttggatttagtatgccacaagatttagtatacaatagtaaaaaa

SEQ ID NO: 964 - DNA, 700 bp, Amaranthus rudis
tggttaatgcttactgttttgacattcttgttttttctatagtgggaaaatttaccttattcctctaatttatcgttcttttttccttccatgtgctcaccagtcatcattgctctattgtaggttcccgtgaataaagttcggacatatggaggcttaaggaatgtactaatgaagaggattgttctttctgccttgcatttcaggattaacacccgatacaaggtgctttaattgacaattagtaggctgtatgatgccccttttggcgttctcaactcctgtggttctgttacataaatttgaaatcatatatttttttctttgagttatacattgctatacaatagccagaggcatgtagatcttttttgcaaattgttggtgcatttacaacgtcgtttgatcattgcatagtactttgaattgaacgacaaatagagcatattttgtggttaagttggttgctcatggaaatgttgtaaagtaaaatgcttcatttctttatgttatgagaatgatcataatttataagtcaagttgcttgctcatggaataaatgccaatttagaaagacttgatttctcgagctgagggattcattggccgcaacctcctttcaagggtaaggttagccgtcttctttccctcctcaaagcctgatcacaacttctataggtggaatacactgggtatgatg

SEQ ID NO: 965 - DNA, 6806 bp, Amaranthus rudis
gatgatgatgatgatgatagaaagacttgttttgttcatgtttgagaatgagagatttagctattgcttatgcattgtgtatacctaggtattttgcctgtcttttacttcgttttatgtgattgtatctcattaaggtccttaaaatccatatatatgtatgatatttatgcatgagcttgagtacattgctttaacaagctgtttccccctttatacatctccatgtgtacctctaaatcacagctatttactgaatatgtagagttcaaacccccctttcactgcaattgagttggaccacagtgattctggaagagaaggttgcactgtaaccactcttacagttacagcagaacctaaaaattggcagaatgctatcaaagttgcagttcaagaggtttgtgtgatgttaaactagttaaattgtgccacaatctttgctattcgctgctgaaatgaatatcaagatgtgggttgatactatttgctttggttgcaggtcagaaggctgaaggagtttggtgtgacaaatggtgaattagctcgttatagggatgccttgttgaaagacagtgaacatttggctgcgatgattgacaatgttccatctgtggataaccttgattttattatggaaagtgacgcattaggacacaaagtcatggaccagctacaaggtcatgagagtttgctcaatgttgctggaacaattactcgtgaagaggtatttctcatatttttctagtctcagattaaagttctgtgttaaatgtttatacaaatagaccaagggttatttgagactttggagattcctattgatgagactaaaacaacaattttaaactgagggaaaactcattagcgcgctgttaatctcagatgtgatgcgtatgggtgtccaacttggtattagtccaagtgttggacttgtcaagtttgaatttttaggacatggggactcatttttgaaggttctgagggactcagttgtttaggagaagtgtagttgtaaattgtaatttgtaaagtcatctttattatagttaatagaattaccaaaaaagtataaataaaatagtttttgtgttataaaaccaacaaaggcataagaaagatgccatcttatgaaaaattacactggtactactaaaagacaaattttttagaaaaattctggatgtgaagctaaatcttgactttttcttcacccttccaagtctcaacatattgtattaattatttttttttgaatttgtatttttgataaagaaaaatttatggatgtgaaatataatcttgagtcttgacttttccttcatccttccaagtctcaacataatgcgttaatgcatccactttggctccttccttccttctataaaaactttatcgttctcccaacaccatgttggggtactgactattgagatccattcatgccgatggtggctaataggactcctcctcaatttggtccctgattttaagatctaggagtttctttgagttattgaagggtcagctttctctcctccatattcaacctgtagtttgttttgacacccgggttattttgtatggacaccatacagctgggaggggagccaagtcccagcatcacagaatgtcagaacggagtcattcatagtattctgtatctattatgcttctgaatgttataattattgcgtttttactaatttgcatcgtgttcattgatttattcgcatgttcttgataacattgatactcgcatgtctataaaaaaaacttcagttatgagttaagattaggcacacagtttaaaaagtttaagtagggggtgaaggttcttttgctattagtgtaatagtaagaaaataagctgactgagagtgaagttggtggacaactccatcacttgggatggagagagaaagacagagagtgtgtgtagaggatccatatcttataggatgagttatgtaatcaggagttcatttgctattctggagaaaggaaaacagggaatttatttgatacccatgggttgaaagtgtttgagaattgtgcaccacatatcatacttcttcctttgccatatgcccatatatcatgttgcctatgatagtattaacactatcattcttgggctgtctagaattttctttgttctgtgtgttaaacactacatttcaaagttcaaacaatgtttcaaaaattttttctttcagttttctatttcttagatttttcttgcttttgtcatgtctattctccaattccaattcttttattctacttttatttgttcatgtctagggatcaccccacatctgaaatttgggatggaaagtaggtttttgagtctttgacattggtaggaggaaatcgtggagtctaggtttgcgatgtggatcgtgttattgatctcacaatgaccaaatgtccaatcctagtcgctcatggattcgacgaagtgtaaaatcactctggagtagggatgacaatggatcctggacccgccccgtattatccgtccttcgtgacggatcggggtccttttttttggacccgtcggatccggtttgggttctgatccatataaaagtgacgaatccggatctaggagacctgttttatatatatatatacatgtatatatatatatatagcgacaagtgcgacaagtttagtttattaatttagtagcattattttggatgttaaattatgttatgaagaaacttttggaactcggttgatatttaaggacatttatagtttgtataatattatcggatgttattagattataattgatagtttatgtattattatcattaattaaagtctaaaactctatcgctattgctatgcgaagcataattcaatcaaaatgtgcgaaaaataagcttggaccgattttggactcagagtctgggacctgatcctgaataatgtatggatattcatgttactaaatggctagctttatgttctatttaagcatcgttcacttttatacttgtttctttcttcaagaaaaatgtatggatattcatgttactaaatgtaagtaaataaataattatcaagttgtctttactagtcaatgttttattaattttaaaactatcttgtaaagtattatttggttgacttgttaattcatgtgtacgtaacgtatcattgtcaaatgcaccaccatataatttttagcatttttaatgggcaattgctctttaaggattcttattctcaaaatgttatattattctcaacaagtcaacccaacaatccaatactatggaacaccaagtgcaattcaaagtaggatcttgtttttgataaccttgaaactaagggaacccttccccgacatcaggtactatcatgtaatttgtgcaaaggaattggatcttagtttaaaaacagcacctccaagataggctctaaaatcgcttcttttagtcttggctaagcgagatatgcaaggtttgcgcttttgtgtgcattttgcgtgttgtgctttttttttttgttcgttttttgagcttttggtctctttaggcataagcctttttagtaatctagaacaattagataaaaatagcagtctgattcgaagagagaaaaagaaaaggaaaagtaagtggatcctccactactactaggttgcttcttttagactcttggatggatatgtttgtctttcatacctgttttttaaagttatactttgtagtctaggtcataaggacttgtgtcaactggtaacttggagccaacttttggcgcaaacctttaaaacctctgggctcagacctcagtcctttggaatctcttaactatggttgtaggtatcgtgaagcagtaatttactaggttgtagccttttaagcaggcttggctatagcttcctcacacatctttcactttgacattgaaattcatctttctatcattcgactttaaacataataatatcttatagcttttaaaatgggcttgcaattcagcttctttttgtgggtcgccgttgtgggaagcattctcaatagttatcctttgacctccagatagtaaaagagtttctgacattgtccttatcatgagctatagctgtttggtgggtcgtcagtttttttttggaactaatacatacttaaatcataaatgccacctttcggtcttgtcaatggttttcatagacctacccctataaaaatgattctgcagatgcctttcagctatgagctatattgcttatgatgctcttgtcaatggttttcgtgggcctaccctcataaaaggagctcgaggaacatctatgatctatttccttaaatatgggtttaaagtgcttcaaaactttcgagctatggcttttactctaggcttgtgttaggttccttaccctgattattttatggactgatcacatttctagtatattttacaccttatcagagaaaaatagaaatgctttcagtattttttttcgatgtgaatggggctgtcttctatattcaaagaaatctttgggatcaaaggtttttattggttaaaaatcatcctgtacttgaaagaaaaatattggtggcagaactctgttctcaaggtccaatcgagttttcaacttaatttgtctaaatctatccttcctactctttgttcttgtgtgagttttgtgttccatgagaacatgcaaatatctttaatattttacaatatgttgtgaattaatgggtggaaagtggtcgtgattttctagtgtaacttttctttaccaaaattgaagggcttttggagtgggattaatttggtactttggctgcttgttaattttattacttcacttttgataagattgggtcattacatggctttgagtctactattctatcctttaatattgcatttgtatattgaagtataagtttcaaaagctattatagactaaaattggctattccttaaaggtcaattccattggtgctgaagtactggagtttattgctgattttggcaaaacaactgctcctgctcctgcagcaattgttgcttgtgttcccaaaaaagtgcacattgatggaattggcgaaactgatttcaagatatcacctattgaggtttctgaagctataatatcaggattgaaggaacccattgaggctgaaccagaggtgcagttcttaaaagaatttttaaatgcttcttgaatttatatttatttttgtcttcttgattccattattgttctgtattaatttttccagcttgaggtgccaaaagatctcataaccaccgctcaactacaagaattaaggttgatgcgcaatccatcttttacaccactggactcggaacaaaatggcactaaaatctatgacaaagagacaggaatcacccagcgtcgtctttcaaatggtattccagtaaattacaaggtaggacagccatttcatgtgtatttgttggttatatttattttgtgggattgtcatgcattttatcttgcattttggtctattgccattattgaaggtcattcaaatctgtgataaggtctagaatcacataggagattttgatgctggcttgtcatcgatatctggctcctgtatgacaatgcttttgcacattgtctttgtttgttgtgtacttgtgtattcttctgaactaccccaaatgctcgacatcccaatgaataggtataaggtattagtctagagaaaagcaaaccttttcaactagaatggctgtttttatatgctgcttgtacgaggtttcctcatcacctcctgtatatttggcaaagagtatgttttttcataaagtaccttataaaacctttattgtataagaaactactgacctcaatataattttggtctgagaatatactttacaagacaagtttgtgaagtagcactgtagcactttctgcctatttctttaaaaaagtcaacattcctgctgtagtgctgtgtaactcctttttcccccaactgcccacagtattatgttcttcaggaaacacaactttatgccggttcagttgatataaaaaaaagacagggaatgtgaaggtgagaaggcataagcataaggtggttaaaatggctagaatagatggtacaagtacaatacctggaaattcgatttccttgtcagaaaatggcttttatcctgtaagcttgtttggttctataaggaattcctcgccttcaaaaaaactgtaaaatgtatttccttcttgaactgaaggttttaaaaagtttttttttcgtaaaaaatagaaatacccaagtataaattattgaattgaagaaagagaaaactgaaaaaagaagcaatttagggaccagaaagtagatttgtttggtaacattgattttctatgatgtaattcccttttcatatctttagtttttaattatttctttcagctttcagtgctctgccttttctttgtttgcctaactgctgtttgccttagttcatgcaattttattcatgctccatttatatttttgtagatttcaagacatgaaagccagagtggtgtcatgcgtctcatagttggtggtgggcgagctgtggaaagtttgcatgagaaaggatctgttgttgttggcgttcggactctcagtgagggtggtcgtgtcggaaacttttccagagagcaggtaggtagagttcatttagtattttgactgattgcaagtcagatgaatacctgatggattttgattaattctgtgcataccatgatttattgaggcttttgaatctgtttatacagtgccagtgaa

SEQ ID NO: 966 - DNA, 2451 bp, Amaranthus rudis
tcatttatacgctcaccaactacatatttgtggtattttccaggactctgatggtgacttgctcccttttgtactggatgctctaaatgaggtattactgtacactgctcgatttccagaattatcctattttcctttacttcctagcaacttattggagtaccaagaatatattaagtgaaggtagtttttccgtgttccatgcagatagcttttcatcctaagtttctctcgtcaagggttgaaaaggaaaggcgggcaatattgtctgaacttcaaatgatgaatactatagagtatcgtgttgattgccaggtttgtggaggtttgagggtggccacacctcatctatgtcaatgttatctgcttgctgtactggtggtttcttttgatgaaaataacaactttcaagcgttaattttttcatttcattgcttcttgcagctgttacaacatttgcattcagagaacaaattgagtaaaaggtttccgataggattagaggagcagatcaagaagtgggatgttgataaaataaaaaaatttcatgagcgctggtactttccagcaaactctactttgtatattgttggggatatagacgacatcactaagactatttaccaaattgaggtgagaggcatatatctctattgctcccccttcttctctcttgtctagctgtgggtttcatctttcatgttatgctttaatgaaaatgcaggctttatttagtcagactggcttggagaatgagacagaggcttccccacctccaacaccaaatgcctttggtgcaatggctagttttttagtgcctaagcttccagttggacttggaggtagttctcaagacaaagcaacaagtcctgagcaatcaaaaacttcaaaaaaggaaagacatgcagtgcgtcctcctgtccagcataattggtctctaccaggaagtggtcgtatatctgatcctcctcagatatttcagcatgagttacttcagaatttttcgtttaatatgttctgtaaggtaatgaaattctttttgctctcaattttttaggtttaatttgaaattctttgtgcgttatttctttggttttttaatgctttcttgttctgtgtcttgaacggtcaagcttttttcttccagaagtctgctgaactaatgcctcttgctattctatcatactgttccacttatttagcccccaattcgtagcagtttatatgagaaatgttttactgttgcatcttttcacggtccactctgggcacaaagtgaagttgaacgagctattgtttatatctgtggcacgaggggtgtttgggggttagatgtacgtacccttgtaacaacaaagatgtttgtgatttacctttgagtggaaaaatcatctacaagttcacgtaattcaaaagtacaaatgatctaataagctattatactgtagtccattacaaacatataatcataaaatcttgttatgaatgtaattacctatcttcatcatctctagagatgaagaggctatttaattgaagttaaaataaacctgaaatcttgttatgaatgtaaccgaaatcaaatgttgacttgtaatcccacatgcccaactagtgtggattacaatcctacatgtctcccacccgagaggcaaagatgacattcaaaagtgtggtcgacttggattcaaggcgttcttacagtctttggggttgtttgacaaatgattatacttggattcaaggcgttcatgcagtcttttgggttgtttgacaaatgattgtacttggattcaaggtgttcatacagtctttggggttgtttgacaaatgattgttggttgttagctttttgaataggcctgtttttgttggtgtttaagcttgctagctaaatgtttagggagatgtttgataaaattatttatgaaataggaaaagtgggtcaacaagtaaaaaactattggaaaaaattaacagaattagcgttttcattttagctttaagggacaaagttgggtgaaaagtcatataccaaacattttaaagctaaaagtaaaaatcaaaaaccaaccaaaaaagctaacccaaaagccatttactaaacaaaccctttgagttgacccgactttaatttgattcctcgaggtaaaccaagatgacataggttcaatctttagtttagcctacattataagactcgaaacctaactagtcacttttgagtgctctcgacttcttcgtttcaaaattgactttttgattgagaatgacccacactcggatcaattaaaaaatttggattctcaaacttgtgaaccacccaaacccacacccgagatgaactcaaaaatttgggatatcaaacttgatgtgcaccaaacatgttattggcatagcccaaaccctataaatatatgacaaagcccgactctagatgcaatttcacta

SEQ ID NO: 967 - DNA, 479 bp, Amaranthus spinosus
gaacgtcttctctccttcaccaatcacaattatatcctatttctctcctccggtggaaaaggaggagattttgatgatatagtgttgagttgagtgcttgaagattgtaattgaaggttaacaatggcggcggcttcaccttcagcttctgctttacttggtggtgtttcaaatcttcaaattcgtaaaaaattcaataggaattgggatgataattgttcgaagaatgttgtggctacttctgggttttctaggtctttttcttcgtattctagctctaattgtcctcggtcaagtcttcgccgacctcctaagtgcaggtggtcgaatgttggtcgaactattgcatctagatcacttactatgaggaacaatctccggaggcagaaaggctaccttcaaatggatgaacttcccttgacagcttttttcaatctaaagggcacttgtgctgcaaccacatccatcggagaagaggg

SEQ ID NO: 968 - DNA, 1656 bp, Amaranthus spinosus
aagtatccaatttctgacgccatcagggaaccaattcgtcacttgtatgttactaaagatgtgagacgaacacttgatatactgatcttggggatggtttgcttttcatcaacttaaggaattacacatcttcaatagaatactgctgctcattgttccaataatttgatttgtgcaattgtggatgtcagagcatagagcaacacgattttcactctgattccggtcaggtcagtatcattggagatttctcagaagaagagattgaatcttgtattcttgattaccttggtacggtcggtgcttctcgtgatgttgagaagaaggtctatgatcccattattttccgccgaccttcgaatttgcagtttcagcaggttttcattaaagacactgatgaaagagcctgtgcctatattgctgggcctgctcctaatcgatggggcatcacaattgatggtgttgatctttttgagtctgttcagaattctagtggtgagcaattaaattctgagacttcgccatctgagagctccaatgatgtaaagagctgcagagtaaaattcggagccatccactgttctttgggatcacaatgggtttattagcagaggttataaattccagacttttcacaacagttagggattccttgggtttgacatacgatgtgtctttcgagctgaacttatttgataggcttaattttggatggtatgtgatttctgtgacatcaactcctggaaaggtacataaagctgtcgatgcttgtaaaaatgtgctcaggggcttgcacagcaacagaattgctccaagggagttggacagggcaaagaggaccttgctaatgaaacatgaagctgaaatcaagtcaaacgcttactggcttgggttgttggctcatttgcaagcggattctataccaaggaaggatttgtcatgcataaaagacctgaccttcctttatgaagctgccactatagaggatgtatatgttgcatatgaacaactgagggtggatgaaaattccctgtattcctgcattggtattgctggagcgcaggctgaggaagaaatttcagatgctgattctttgttggatgatcaagattcattcggaatgcatcaaggaggattgcctgcggggcgtggactatcaacaatgacacgaccaactacatgaaaattagtacgtgagtaacagatctgagcaaaggcttttggctaaataaggtaacaaggttatgctttcaagccagtaacagtgcacctattgaatatcagaagaccgatacttttactcgtgacttgaatggaaatcattctttatgtggtagacggtcaatattgtttggattttggaatatggctccatgttaacgtccctcaaaacagcaaaaaactgcaactttaacagaaaattagtgaattctaagtttatagggttcactttataggccttttcatttatttgaatacacaatagttcatagtatagtcttgtaatgtttgatactcctatttcagtattcatttccaaagttgtcatttttctttgtgttgtacactggtacttctagccttcaggaaatgggtcaaatgaataattgtaactaaaatccttttcttgatttttccaatgtaaaatcataatta

SEQ ID NO: 969 - DNA, 2863 bp, Amaranthus spinosus
ccaggaagtggtcgtatatctgatcctcctcagatatttcagcatgagttacttcagaatttttcgtttaacatgttctgtaaggttcccgtgaataaagttcggacatatggagacttaaggaatgtactaatgaagaggattgttctttctgccttgcatttcaggattaacacccgatacaagagttccaacccccctttcactgcaattgagttggaccacagtgattctggaagagaaggttgcactgtaaccactcttacagttacagcagaacctaaaaattggcagaatgctatcaaagttgcagttcaagaggtcagaaggctgaaggagtttggtgtgacaaatggtgaattagctcgttatagggatgccttgttgaaagacagtgaacatttggctgcgatgattgacaatgttccatctgtggataatcttgattttattatggaaagtgacgcattaggacacaaagtcatggaccagctacaaggtcatgagagtttgctaaatgttgctggaacaattactcgtgaagaggtcaattccattggtgcggaagtactggagtttattgctgattttggcaaaccaactgctcctgctcctgcagcaattgttgcttgtgttcccaaaaaagtgcacattgatggaattggcgaaactgatttcaagatatcacctattgaggtttctgaagctataatatcaggattgaaggaacccattgaagctgaaccagagcttgaggtgccaaaagatctcataaccacagctcaactacaagaattaaggttgatgcgcaatccatcttttacaccactggacttggaacaaaatggcactaaaatctatgacaaagagacaggaatcacccagcgtcgtctttcaaatggtattccagtaaattacaagatttcaagacatgaaagccagagtggtgtcatgcgtctcatagttggtggtgggcgagctgtggaaagtttacatgagaaaggatctgttgttgttggcgttcggactctcagtgagggtggtcgtgtcggaaacttttccagagagcaggtagagcttttctgtgtgaatcatttaataaattgctctctggaatccactgaggagtttatttgtatggaattccgctttacattgagagacaatggaatgcgtgctgccttccagttactacacatggttcttgagcatagcgtctggctggaagatgcatttgacagagcaagacagttatacttgtcttattatcgctcaattcctaaaagcttagagcgttcgaccgcacacaagctcatgttagcaatgttgaatggagatgaacgctttgttgagcctacaccagagtcactgcaaaagttaacgctaaaatcagtgaaagaggctgtaatgaatcagtttgtgggtgataacatggaggtcagtatcattggagatttctcagaagaagagattgaatcttgtattcttgattaccttggtacggtcggtgcttctcgtgatgttgagaagaaggtctatgatcccattattttccgccgaccttcgaatttgcagtttcagcaggttttcattaaagacactgatgaaagagcctgtgcctatattgctgggcctgctcctaatcgatggggcatcacaattgatggtgttgatctttttgagtctgttcagaattctagtggtgagcaattaaattctgagacttcgccatctgagagctccaatgatgtaaagagctgcagagtaaaattcggagccatccactgttctttgggatcacaatgggtttattagcagaggttataaattccagacttttcacaacagttagggattccttgggtttgacatacgatgtgtctttcgagctgaacttatttgataggcttaattttggatggtatgtgatttctgtgacatcaactcctggaaaggtacataaagctgtcgatgcttgtaaaaatgtgctcaggggcttgcacagcaacagaattgctccaagggagttggacagggcaaagaggaccttgctaatgaaacatgaagctgaaatcaagtcaaacgcttactggcttgggttgttggctcatttgcaagcggattctataccaaggaaggatttgtcatgcataaaagacctgaccttcctttatgaagctgccactatagaggatgtatatgttgcatatgaacaactgagggtggatgaaaattccctgtattcctgcattggtattgctggagcgcaggctgaggaagaaatttcagatgctgattctttgttggatgatcaagattcattcggaatgcatcaaggaggattgcctgcggggcgtggactatcaacaatgacacgaccaactacatgaaaattagtacgtgagtaacagatctgagcaaaggcttttggctaaataaggtaacaaggttatgctttcaagccagtaacagtgcacctattgaatatcagaagaccgatacttttactcgtgacttgaatggaaatcattctttatgtggtagacggtcaatattgtttggattttggaatatggctccatgttaacgtccctcaaaacagcaaaaaactgcaactttaacagaaaattagtgaattctaagtttatagggttcactttataggccttttcatttatttgaatacacaatagttcatagtatagtcttgtaatgtttgatactcctatttcagtattcatttccaaagttgtcatttttctttgtgttgtacactggtacttctagccttcaggaaatgggtcaaatgaataattgtaactaaaatccttttcttgatttttccaatgtaaaatcataatta

SEQ ID NO: 970 - DNA, 1009 bp, Amaranthus thunbergii
gaatgtgcctgacgctctatgtgtgaaacaaaatcatgttagatgctctgctgttggtcctgatgaaccacatgcagtcagcacaagttcaccagagggaacattagagaaacctgaaatggactttttcgatcctgaagtaagaagagtagaggtagaggagtttttaaatgctgaacttccttctcatcccaagctatatagaggacagttgaaaaatggattgcgttacataattttgcccaacaaagttccaccaaacaggtttgaagcacatatggaggttcatgttgggtctattgatgaggaggatgatgagcaaggaattgcacatatgatagaacatgttgcatttcttggtagtaaaaagcgtgagaagttacttggtacaggagcaaggtctaatgcatatacagattttcatcacacagtttttcatattcattctccaactcgtgcgaaggactctgatggtgacttgctcccttttgtactggatgctctaaatgagatagcttttcatcctaagtttctctcgtcaagggttgaaaaggaaaggcgggcaatattgtctgaacttcaaatgatgaatactatagagtatcgtgttgattgccagctgttacaacatttgcattcagagaacaaattaagtaaaaggtttccgataggattagaagagcagatcaagaagtgggatgttgataaaataaaaaaatttcatgagcgctggtactttcctgcaaactctactttgtatattgttggggatatagacgacatcactaagactgtttaccaaattgaggctttatttagtcagactggcttggagaatgagacagaggcttccccacctccaacaccaaatgcctttggtgcaatggctagttttttagtgcctaagcttccagttggacttggaggtagttctcaagacaaagcatcaagttctgagcaatcaaaaacttcaaaaaaggaaagacatgcaatgcgtcctcctgtccag

SEQ ID NO: 971 - DNA, 679 bp, Amaranthus thunbergii
tgaagctgccactatagaggatgtatatgttgcatatgaacaactgagggtggacgaaaattccctgtattcctgcattggtattgctggagcccaggctgaggaagaaatttcagatgctgattctttgttggatgatcaagagtcattcggaatgcatcaaggaggattgcctgcagggcgtggactatcgacaatgacacgaccaactacatgaaaattgttacgtgagtaacagatctgagcaaaggtttttgcctaaataagtgtatttcaggtaacaaggttatgctttcaagccagtaacagtgcaactcttgaatatcagaagaccgatgcttttactcgagacttgaatggaaatcattcttctttatgtggaagacggtcaatattgtgtggattttggaatatggctccatgttaacgtccctcaaaacagcttagttttacagaaaattagtgaattccaagtttatagggttcactttataggctttttcattcatttgaatacacaatagttcatagtatagtcttgtaatgtttgttactcctatttcagtattcatttccaaagttgtgatttttctgtgttgtacacttgtacttctacccttcaggaaatgggtcaaatgaatagttgtaactaaaattcttttacttgatttttccaatg

SEQ ID NO: 972 - DNA, 1853 bp, Amaranthus thunbergii
gttgcagttcgagaggtcagaaggctgaaggagtttggtgtgacaaatggtgaattagctcgttatagggatgccttgttgaaagacagtgaacatttggctgcgatgattgacaatgttccatctgttgataaccttgattttattatggaaagtgacgcattaggacacaaagtcatggaccagctacaaggtcatgagagtttgctcaatgttgctggaacaattactcgtgaagaggtcaattccattggtgctgaagtactggagtttattgctgattttggcaaaccaactgctcctgctcctgcagcaattgttgcttgtgttcccaagaaagtgcacattgatggaattggcgaaactgatttcaagatatcacctattgaggtttctgaagctataatatcaggattgaaggaacccatagaggctgaaccagagcttgaggtgccaaaagatctcataaccacaggtcaactacaagaattaaggttgatgcgcaatccatcttttacaccactggactcagaacaaaatggcactaaaaatctatgacaaagagacaggaatcacccagcgtcgtctttcaaatggtattccagtaaattacaagatttcaaggcatgaaagccagagtggtgtcatgcgtctcatagttggtggtgggcgagctgtggaaagtttacatgagaaaggatctgttgttgttggagttcggactctcagtgagggtggtcgtgtcggaaacttttccagagagcaggtagagcttttctgtgtgaatcatttgataaattgctctctggaatccactgaggagtttatttgcatggaattccgctttacattgagagacaatggaatgcgtgctgccttccagttactacacatggttcttgagcatagcgtctggctggaagatgcatttgacagagcaagacagttatacttgtcttattatcgctcaattcctaaaagcttagagcgttcgaccgcacacaagctcatgttagcaatgttgaatggagatgaacgctttgttgagcctacaccggaatcactgcaaaagttaacgctaaaatcagtgaaagaggctgtaatgaatcagtttgtgggtgataacatggaggtcagtatcattggagatttctcagaagaacagattgaatcttgtatccttgattaccttggtacggtcagtgcttctcgtgatgttgagaagaaggtctatgatcccattattttccggccaccttcgaatttgcagtttcagcaggttttcattaaagacactgatgaaagagcttgtgcctatattgctgggcctgctcctaatcgatggggcatcacaattgatggtgttgatctttttgagtctgttcagaatggtagtggtgagctattaaattctgagacttcgccatctgagagctccaatgatgtaaagaagctgcagagtaaaattcggagccatccactgttctttgggatcacaatgggtttattagcagaggttataaattccagacttttcacaacagttagggattccttgggtttgacatacgatgtgtctttcgagctgaacttatttgataggcttaattttggttggtatgtgatttctgtgacatcaactcctggaaaggtacataaagctgtcgatgcttgtaaaaatgtgctcaggggcttgcacagcaacagaattgctccaagggagttggacagggcaaagaggaccttgctaatgaaacatgaagctgaaatcaagtcaaacgcttactggcttggtttgttggctcatttgcaagcggattctataccaaggaaggatttgtcatgcataaaag

SEQ ID NO: 973 - DNA, 566 bp, Amaranthus thunbergii
caattatatcctttttctctcctccgggtgattcactttctctctcttattcttcctccgaaatttcactgtaattcagttgatgattatctttgttcttcgattgattgatttatcaggtggaaaaggaggagattttgatgatatagtgttgagttgagtgtttgaggattgtaattgaggttaacaatggcggcggcttcaccttcagcttctgctttacttggtggtgtttcaaatcttcaaattcgtaaaaaattcaataggaattgggatgataattgttcgaagaatattgtggctacttctgggttttctaggtctttttattcgtattctagctctaattgtcctcggttaagtcttcgccgaactcctaattgcaggtggtcaaatgttggtcgaactattgcatctagatcacttactgtgaggaacaatccccggaggcagaaaggctaccttcaaatggatgagcttcccttgacagctttatcccaatctaaagggcacttgtgctgcaaccacatccatcggagaagagggtcatttatcaaatatgttgg

SEQ ID NO: 974 - DNA, 533 bp, Amaranthus viridis
ggatgagcttcccttgacagctttatccccaatctaaagggcacttgtgctgcaaccacatccatcggagaagagggtcatttatcaaatatgttggttcaagatttcctgcagacaaatcaacatttccattgtcaaagaatgtgcctgacgctctatgtgtgaaacaaaatcatgttagatgctctgctgttggtcctgatgaaccacatgcagtcagcacaagttcaccagagggaacattagagaaacctgaaatggactttttcgatcctgaagtaagaagagtagaggtagaggagtttttaaatgctgaacttccttctcatcccaagctatatagaggacagttgaaaaatggattgcgttacataattttgcccaacaaagttccaccaaacaggtttgaagcacatatggaggttcatgttgggtctattgatgaggaggatgatgagcaaggaattgcacatatgatagaacatgttgctatttcttggtaagtaaaaagcgtagagtaagttacttggtac

SEQ ID NO: 975 - DNA, 2293 bp, Amaranthus viridis
gctggaacaattactcgtgaagaggtcaattccattggtgctgaagtactggagtttattgctgattttggcaaaccaactgctcctgctcctgcagcaattgttgcttgtgttcccaagaaagtgcacattgatggaattggcgaaactgatttcaagatatcacctattgaggtttctgaagctataatatcaggattgaaggaacccatagaggctgaaccagagcttgaggtgccaaaagatctcataaccacaggtcaactacaagaattaaggttgatgcgcaatccatcttttacaccactggactcagaacaaaatggcactaaaatctatgacaaagagacaggaatcacccagcgtcgtctttcaaatggtattccagtaaattacaagatttcaaggcatgaaagccagagtggtgtcatgcgtctcatagttggtggtgggcgagctgtggaaagtttacatgagaaaggatctgttgttgttggagttcggactctcagtgagggtggtcgtgtcggaaacttttccagagagcaggtagagcttttctgtgtgaatcatttgataaattgctctctggaatccactgaggagtttatttgcatggaattccgctttacattgagagacaatggaatgcgtgctgccttccagttactacacatggttcttgagcatagcgtctggctggaagatgcatttgacagagcaagacagttatacttgtcttattatcgctcaattcctaaaagcttagagcgttcgaccgcacacaagctcatgttagcaatgttgaatggagatgaacgctttgttgagcctacaccggaatcactgcaaaagttaacgctaaaatcagtgaaagaggctgtaatgaatcagtttgtgggtgataacatggaggtcagtatcattggagatttctcagaagaacagattgaatcttgtatccttgattaccttggtacggtcagtgcttctcgtgatgttgagaagaaggtctatgatcccattattttccggccaccttcgaatttgcagtttcagcaggttttcattaaagacactgatgaaagagcttgtgcctatattgctgggcctgctcctaatcgatggggcatcacaattgatggtgttgatctttttgagtctgttcagaatggtagtggtgagctattaaattctgagacttcgccatctgagagctccaatgatgtaaagaagctgcagagtaaaattcggagccatccactgttctttgggatcacaatgggtttattagcagaggttataaattccagacttttcacaacagttagggattccttgggtttgacatacgatgtgtctttcgagctgaacttatttgataggcttaattttggttggtatgtgatttctgtgacatcaactcctggaaaggtacataaagctgtcgatgcttgtaaaaatgtgctcaggggcttgcacagcaacagaattgctccaagggagttggacagggcaaagaggaccttgctaatgaaacatgaagctgaaatcaagtcaaacgcttactggcttggtttgttggctcatttgcaagcggattctataccaaggaaggatttgtcatgcataaaagacctgaccttcctttatgaagctgccactatagaggatgtatatgttgcatatgaacaactgagggtggacgaaaattccctgtattcctgcattggtattgctggagcccaggctgaggaagaaatttcagatgctgattctttgttggatgatcaagagtcattcggaatgcatcaaggaggattgcctgcagggcgtggactatcgacaatgacacgaccaactacatgaaaattgttacgtgagtaacagatctgagcaaaggtttttgcctaaataaggtaacaaggttatgctttcaagccagtaacagtgcaactcttgaatatcagaagaccgatgcttttactcgagacttgaatggaaatcattcttctttatgtggaagacggtcaatattgtgtggattttggaatatggctccatgttaacgtccctcaaaacagcttagttttacagaaaattagtgaattccaagtttatagggttcactttataggctttttcattcatttgaatacacaatagttcatagtatagtcttgtaatgtttgttactcctatttcagtattcatttccaaagttgtgatttttctgtgttgtacacttgtacttctacccttcaggaaatgggtcaaatgaatagttgtaact

SEQ ID NO: 976 - DNA, 595 bp, Amaranthus viridis
agcaaggtctaatgcatatacagattttcatcacacagtttttcatattcattctccaactcgtgcgaaggactctgatggtgacttgctcccttttgtactggatgctctaaatgagatagcttttcatcctaagtttctctcgtcaagggttgaaaaggaaaggcgggcaatattgtctgaacttcaaatgatgaatactatagagtatcgtgttgattgccagctgttacaacatttgcattcagagaacaaattaagtaaaaggtttccgataggattagaagagcagatcaagaagtgggatgttgataaaataaaaaaatttcatgagcgctggtactttcctgcaaactctactttgtatattgttggggatatagacgacatcactaagactgtttaccaaattgaggctttatttagtcagactggcttggagaatgagacagaggcttccccacctccaacaccaaatgcctttggtgcaatggctagtttttagtgcctaagcttccagttggacttggaggtagttctcaagacaaagcatcaagttctgagcaatcaaaaacttcaaaaaggaaagacatgc

SEQ ID NO: 977 - DNA, 598 bp, Ambrosia artemisiifolia
tcaactgctcacaagctcatgacaactatgttggatgtagacgagctgtttgtggagcccacaccacattcattacaaaatttaacattacagaccgtaaaagatgcagttatgaataagtttgtcagtgataacatggaggtgagcattgttggggatttttcagaagaggttatcgagtcttgtgtaattgattacctaggcacagttagaccaaccaaaggtgctgacaaggctttgagttacaatccagtcctctttagaccgtcttttcatgatctgcactttaaacaggtgagcaaacaatttttatccgccttttatgtgattgttttttcttatttttttataaattatgtgtgctctcatgacttgtttcctattttacaggtgttccttgaaggacactgatgagagagcatgttcttacattgcgggccctgcacctaaccgctggggatatacggtcgatggaaccgactttcttgagtccataagaaacatgtcagtcagtaaaggtaaacatttatattatataaatttaccttgaagaatttgtttgtttatcatctaccaagtatacaaatatattaaattt

SEQ ID NO: 978 - DNA, 278 bp, Ambrosia artemisiifolia
ccaaaatgggttgttttggtgaaagcctctttttaagtatagatttgcatgttgacaggccaaacgaaccctgttaatgaaacatgatgctgaaagcaagtcaaatgcgtactggctcgggttgatagcccatttgcaggctgcttcagtccataggaaggtaaactgttagacttggtaattggtacctggtcttacaactttgctgtataaactattttacccttcaaaaatcaattagtatcttttttcttctcaattgctctatgcacgtattt

SEQ ID NO: 979 - DNA, 275 bp, Ambrosia artemisiifolia
ttttatcatttttatacgcagtttgaggtaccaaaagaattgataacctcaacagagctggatgatttgaagttgcaacttaaaccgtctttcatatctacgggtttagattcaaatgctactaaagtttatgacaaagaaacaggtatcacgcaatgtcgtctctcaaatgggatttctattaactacaaggtatattgttttttacttatttttttttatttcaacttttctttacgtttattttgtctacgtgacatgagtaatttgttttt

SEQ ID NO: 980 - DNA, 285 bp, Ambrosia artemisiifolia
aagctgagtaaaagattcccaattggacttgaagaacaaattaagaagtgggatgcagaaaaaataggaaattccatgaatgatggtaattcccagcaaatgcaactctgtatatcgtgggagatatatataatagtccatcgattgttcaccacattgaagtacgttattttctgcgtataaatattgcacgacattaattaagagaattacattaaattaaagaatttgtgtgcaggctgtttttggacagaagcaagttgacaacgaggctcctgtagcgcc

SEQ ID NO: 981 - DNA, 867 bp, Ambrosia artemisiifolia
actatatatgatctttttttttttttcaaattcacccagtgttgtctctgcttgaatcatttgattaattgttctttagagtcgacaaaagaatttctttgtatggaattccgttttaccacatgagataatggaatgcgtgcgccttttcagttgcttcatatggttcttgaggtaaatactgtctgtcaatcaattttgcattttagtatttacataacatgttaatattctgctagaatatttaagttctttaccttatgttttacacttataaattgacatcttcactcaaatctgttgttggatataacgttcattttcaatatttagagacagtaatctgggtctgttcccgcgtctttgttgtttaatgatgttgggtcgttgaagatggtaattaatttgcacacgctaatgagtttggctatgatgtttgcgtaaacgaggtggaagccgaacgtgatggcactaatattgtgcaaccgaactgcttcacattatgcgcctaagcctgttactatctaattgctgcgtgttagtgctgttttacgccaaaacttcaaaaatattctacttactaatataatattggtgactgaggtatgcgatggaattatatctttttgaagttaatgtttatggccagtttattccgcctttagcggtataattacgggttttggcgtttggctatgatgtgtgcgtagacgaggtgggagccaaacgtgatggcactatccgcctgagcccgtaaatattagatcctaggaaagaatgagaaattgacttaaattaaccttatatatgtgtgacagttactattaattgatgtgaatacttgaaaagagttgggtttaaaaaaaa

SEQ ID NO: 982 - DNA, 292 bp, Ambrosia artemisiifolia
aataaagttccacaaaacaggtttaattttttatttaccaacacgtgattctaaagtttttactttacttattttatttacctaacattttttttatgtgaagatttgaagcccacatggagatacatgcggggtcgattgacgaggaagatgatgagcaaggcattgcacatatgattgagcatgttgcatttcttggaagtaagaagcgtgaaaagcttttaagaaccggtgcacgctcaaatgcttatacggattttcatcatacggtttttcatatccattcaccaac

SEQ ID NO: 983 - DNA, 595 bp, Ambrosia artemisiifolia
ttttttcaaagttgcttaatggaccattttaccccttttgagtcgaaacatgcggaatagtttgtttttttgttgctttcttactgtttatggcatgtatttttcaggatatttcatgcatcaaagatttgacaatgctatatgaaactgccactattgaggatgtctatctggcatatgaacaattgaaaatcgatgatcaatcgctgtactgttgcatcggcattgctggtgctcaggctaatgatgaagtttcaggtgaaagcaataaaataatttaagaaaatagtgcagcttaattagcggtgtgaatttgtgacatgacatgcaattcacgggtttgggcttagtctaagtaaacaagtttgagtctaacccacaaccacgtttaggtaaaagggtcatgtttcggcaagttcacaagttaacccgtttgattttatatttatttttaaaaatgttatctttatgtgataaatcatatatgaggtttcaaacacattactatattaatcttttgttttgcagattctttacaagaggacgaatatgttggaggtctgcatggtgttcttcctgtgggtcgtggatccca

SEQ ID NO: 984 - DNA, 557 bp, Ambrosia artemisiifolia
cttgcaggtttgcaactgcagattccatttactttctctaattattgtatttcgatattgtacatacctagctatcactaatgatgatgaacctttataggctttctatccatcttaacacaatctcttttgcatctttttaataggattctgatgaggatctccttccatctgttttggatgctttaaatgaggtaagagccagtttagaaatataattatttaccattttcatgtctgtttttcaatgcaatccttttgtcttttcgtcctaatggttgctattttcttcaattggtaaattaatataacgcctccaattttttaatgttgtagatagctttttacccaaagttccttacttctcgggttgagaaagaaaggcgtgcaatattatcagagctgcaaatgatgaacactattgagtaccgtgttgattgccaggtatatcgttatttgaaacttttttcttatcttttttcctttagcttctggcaatttgaaaataatgcacgtgccatcttaccgttgtcagtatgtgtaattcgtctttcttt

SEQ ID NO: 985 - DNA, 622 bp, Ambrosia artemisiifolia
tgttttgtctatgtggcatgagtaatttatattttatgtcattaagatatccaaaaccgaaaaatgcggtggggtaatgcggctaatagtaggcggtggacgggcgacaaaaaaaccggaacaaagggagcaattgttttgggtgttagaactttgagtgaagggggacgtgttggtaactatacaagggaacatgtaaaatacatcacttatctaccaacattttggtacttaatattttgatatattataaaaatgcatgcattatgtgtgtacatacaagtaattgtgtttaatgttgttaatttttttccaggttgagctgttgaggtcaaaacacctcacgctttttaaatccatgctcattcggcatttgaagtcagcttaaggaaatgttttgtatagcaaactaggttcatgtatgtatggctcaaaagtccacgagtcttattggacagtggggaataattggtgggtttgtacatacacaggccatttatatataaactatgaaattttctaagaaactttgagtcatctatcatccactattaacgacctttaggattattccaaatagataaaattaaatatgtttaattaggactaacaatcttataac

SEQ ID NO: 986 - DNA, 718 bp, Ambrosia artemisiifolia
tgttttataaggctttgtaaggatcaggttaaagattttgatttagatcatgtgttggtatacctttgttggcttgagtctttgatttcttgaattttaaagctgattagcaagtggtaaaaatgatattattatatataaaaatgcctttaatcatgacttttatcttgaaatttgcagggttgttgtaacttcacaggctaaaaggcatgttgatggttcattgacagattgaatcttggttggtatgttatctcagtaacatctacaccgggcaaggtgcgtcagtttagtttttttatgtgttttcttttattggaaacggtttatgttttaaccagttggtttctggttcaggtacatagagctgttgatgcttgcaagagtgttttaagaggcttgcatagtaaaaaagtttcgattttacgttggaaatgaatggtaagaagtgtaaataatcatgtttacttacaacttgatgattgttgaatatgttagacctcgattgtaggttgaagagagtattatatgtaaaacgtccgtgtcaagttttggtagtttgtctcagttagtgaatggccattagtatgcttgtcttcttaataatcgtcctaattaataatataaatgagtaagcctacaaagtatattctttggatttattagttcatattcatttcagtttatgttgtgcatatgatcatatattgatgacctt

SEQ ID NO: 987 - DNA, 225 bp, Ambrosia artemisiifolia
aatatttgaagtaacttttacttagtcaccttcatattatatttcataaccatcttaatatcctatttcttataatattgataaaattttattacataagaggcttttcactgaagtcagagactcacaaggattaacatacgatgtatctttcgagataaacctatttgacatattgaatcttggttggtatgttatcttagtaacatctacaccgggcaaggt

SEQ ID NO: 988 - DNA, 615 bp, Ambrosia artemisiifolia
aaaacggtttcctatatgcaaatctaccccaagtgccttctctgacaaatccgtgtttcatctgtcaaagcatggcgtggacaatgtatttgtaagttctctaatttaggtttgtcatattggtttatgaaacctttcgatagattctttttatctcatatgcatgtttatgatgtatactatatctcttcttatcttaataacataaaacttctattatgttatataatggtttataagcatatgaatagaaggtttttgttagttgaaaaggttttgtatgcttatattacaattaagtgaaaattttcaatacaccttgtagtgtgcgtatctaatttttatcttgtaaactgttaggggaaacgggttcgtgttccatgtgcagctgtgggtcctgacgagccgcatgcagcaagtacagcctggccagagggtgctttggagcagcaatcttctgataattttgtggttgactcagaaaatagtgaatggcaggagttacaggggtttttaggtgctcaacttccatcccacccaaagttgtttaggggacagctagaaaatggtcttcgttacctcatattgcccaataaagttccacaaaacaggttt

SEQ ID NO: 989 - DNA, 276 bp, Ambrosia artemisiifolia
cgagtcttgtgtaatggattaccttggcacagttagaccaaccaaaggtgctgacaaggctttgagttacaatccaatcctctttagaccgtctcctcatgatctgcactttcaacaagtgagccaacagtttttatccgacttttacgtgattattttttttataaattctgtgtggtctcgtgacgtgtttcctattttacaggtgttcctgaaggacactgatgagagagcatgtgcttacattgcgggccctgcacctaaccgctggggata

SEQ ID NO: 990 - DNA, 1013 bp, Ambrosia artemisiifolia
acgttattttctgcttataaatactgcacgacgttaattaagagaattaaattaaattaaattaaagaatttgtgtgcaggctgtttttggacagaagcaagttgacaacgaggctcctgtagcgcctaaaactagtgcatttggtgcaatggctaattttcttgttcctaagttcacaggagggatatctgctgactcatcacatgacagatcactttcatcgaaccaatcgaagcttcctaaaaaagaaagacatgcaattcgccctcctgttgagcataattggtcccttcctgggacacacggaaatctgaagtctcctcagatatttcagcatgaactgcttcaaaacttttcagtcaacatgttctgtaaggtggaaaatgatccatctagatgcttctaacgatacttgtaatttatacacacaaatatacgtagtcaaaagtttaaacatgatcatcttaaattgtagattcctgtgaacaaggtccaaacgtacggtgatttgcgtaatgttctcatgaaaagaatattcctttcggctttgcattttcgcattaactcaagatataaggtgatgtgcttctcaagcattttgatttgttttttattacttgtataaatattttgctaactaaaggtgaatttgcagagttctagccctccgtttacatcgattgagttggatcatagtgactcaggaagagagggatgcacagtcactactcttacagtaaccgctgaacctaagagctggcaaagtgcgattaaagtggctacacaagaggtatagaatcatgaccatgagacggtccagatttttatcgtcatatgatctcgttcttatttcatgatattcaatctgattcaggttcgcaggcttaaggaatttggtgttaccaaaggagaattagcgcgttatcttgatgcactgttaaaagatagtgaacagttggctgcaatgtgtgataatatatcatcagttgataatttggattttgttatggag

SEQ ID NO: 991 - DNA, 663 bp, Ambrosia artemisiifolia
  unsure (1)..(663): unsure at all n locations
ccagatgtcaagtgcttgtgtactcaccccggacttttgctactgcggaatcactctcgaagaagtaagctcattttataaataaactttattaatatacttacctcgttcgattattgaacagatcttcaaactatcatattgttacttgtattaagtaaatctagaaactttatcggtattatgctttctcttatgcttaggacgtgaagtgagtgtgttatcgtcattgtgggatgaatctttttaacatttattgtatccaggtgaatttcattggtgcacaantattagagtacatatcagattttggaaaaccatatgcgcctgttcctgcaaccattgttgcatgtgttccaaaaaaagtacatgttgatggagtaggtgaaattgatttcaagatatccccaattgagatatctgcttcaattgaagaagatctgaagcaatccatagagcctgaggcaaaggtttatattcttctctttaaaagactccatttgggacaattataactcaagattttttaccgaattcttttatcatgttttatatgcagtttgaggtaccaaaggaattgataacctcaacagagctggatgatttgaagttacaacttaaaccgtcctttaaatctactggtttagattaaaatgctactaa

SEQ ID NO: 992 - DNA, 818 bp, Ambrosia trifida
taagaagcgtgaaaagcttttaagaaccggtgcacgctcaaatgcttatacgattttcatcatacggtttttcatatccattcaccaacttccttgcaggattctgacgaggatctacttccatccgttttggatgctttaaatgagatagctttttacccaaagttccttacttctcgggttgagaaagaaaggcgtgcaatattatcagagctgcaaatgatgaacactattgagtaccgtgttgattgccagttgttgcaacatttacattctgagaataagttgagtaaaagattcccaattggacttgaagaacaaatcaagaaatgggatgcagaaaaaattaggaaattccatgaacgatggtacttcccagcaaatgcaactctgtatatcgtgggagatatagataacattccatcgattgttcaccacattgaagctgtttttggacagaagcaagttgacaacgaggctcctgtagcacctaaaactagtgcatttggtgcaatggctaattttcttgttcctaagttcacaggagggatatctgctgactcatcacatgacagatcactttcatcgaatggttcgaagcttcctaaaaaagaaagacatgcaattcgccctcctgttgagcataattggtcccttcctgggacacacggaaatctgaagtctcctcagatatttcagcatgaactgcttcaaaacttttcagtcaacatgttctgtaagattcctgtgaacaaggtccaaacgtatgttgatttgcgtaatgttctcatgaaaagaatattcctttcggctttgca

SEQ ID NO: 993 - DNA, 748 bp, Ambrosia trifida
ttcttgatttcttccttcaatcacaaacacaaacacaaaacaatggaatctgtttcttgttcatcaatgatacgtgtttctcccccattacacctcaactccaacacaccctcttcctttaacagacccaattatgtctcctctcgtcgatacttaccatccaagaacaagattcttactttacgccgttttaatacactcagccatcgttacttcactaccaagattgctggggatagatgtgttttccggtggataagccagtgattcaaaggccagtgctagatcaatgtacacggttctcttgctttcatcatgggcggagaaaacggtttcctatatgcaaatctaccccaagtgccttctctgacaaatccgtgtttcatctgtcaaagcatggagtagacaatgtatttgggaaacgggtccgtgttccatgtgcagctgtgggtcctgacgagccgcatgcagcaagtacagcctggccagagggtgctttggagcagcaatcttctgataattttatggttgactcagaaaacagtgagtggcaggagttacaggggtttttaactgctcaacttccatcccacccaaagttgtttaggggacaactagaaaatggtcttcgttacctcatcttgcccaataaagttccacaaaacagatttgaagcccacatggagatacatgcggggtcaattgacgaggaagatgatgagcaaggcattgcacatatgatcgagca

SEQ ID NO: 994 - DNA, 1491 bp, Ambrosia trifida
aattagcgcgttatcttgacgcactgttaaaagatagtgagcagttggctgcaatgtgtgataatatatcgtcagttgataatttggattttgttatggagagtgatgcacttggccatatggttatggatcataaacaaagttatgaaagtttaattaatgttgccgggacaatcactcttgaagaagtgaacttcattggggcacaagtattggaatacatatcagatttcggaaaagagtctgcacctgtacctgcagccatcgttgcttgtgttccaagaaaagtacatgttgatggagtgggtgaagtcgatttcaagatatccccaagtgagataactgcggcaattgaagaaggtttgatggaacccatagagcctgaggctgagtttgaggtaccaaaggacttgataacctcggcagaggtggatgatttgaagttacaacttcaaccgtcttttgtacctactggttcatcacattcgaatgctcttagatttcatgacatagaaacaggaatcacccagtgtcgtctctcgaatgggattgctattaactacaagatatccaaaaccgaaaaatgtggtggggtgatgaggcttatagtaggtggtggacgggcggcagaaacaccagaaacaaagggagcggttgttttgggtgttagaactttgagtgaaggggggcgtgttggtaatttcacaagggaacaggtagagctgttctgcgtgaatcatttgattaattgttccctagagtcaacagaagaatttctttgtatggaattccgttttaccacacgagataatggaatgcgtgcggcttttcagttgcttcatatggttcttgagcatagtgtttggcttgaagatgcatttgatagagcaagacaactatatttatcatattatcgctctattccgaaaagcttggagcgatcaactgctcacaagctcatgacagctatgttggatgaagacgagcggtttgtggagcccacaccacattcattacaaaatttaacattacagacgtaaaagatgcagttatgagtcagtttgtcagtgataacatggaggtgagcattgttggggatttttcagaagaggacatcgagtcttgtgtcatggattacctaggcacagttagaccaaccaaaggtgctgacaaggctttgagttacaatccaatcctctttagaccgtctcctcatgatctgcactttcaacaagtgttcctgaaggacactgatgagagagcatgtgcttacattgcgggccctgcacctaaccgctggggatatacagtcgatggaaccgactttctcgagtccataagaaacatgtcagtcagtaaagatggacattcagaaaccgagggacaggttgtgaaggcagagaacatcaattttgacctgcaaagaagatctaggaatcactcgcttttctttgctattgcagttgggttgttggcggagaacctgcgcgg

SEQ ID NO: 995 - DNA, 626 bp, Ambrosia trifida
gatgagagagcatgggcttacattgcaggccctgcatcgaaccgactggggatatgtcagttgatggaacagactttcttgagtccataaatttataaccagaaactgaaggacagcttgtgaagtcagataacatcaacttcatatgcaaagatctaggaatcatccacttttctttgcaattgcagtgggattgttggcagagataattaattcgaggcttttcactgaagttagagactcccaaggattaacatatgatgtgtcatgtgagttgaacctatttgacaggttaaatcttgggtggtatgttatttctgtaacatctacaccgagcaagatacatagggctgttgatgcttgcaagaatgtcttaagaggcttgcatagtaaaaagatagccgaccatgaactggatcgggccaaacggaccctgctgatgaaacacgaaacggaaaccaaatcaaatgcttactggcttgggttgatagcccatttgcaggctgcttctgtccataggaaggatatttcatgcatcaaagatttgacaatgctatatgaaaccgccactattgaggacgtgtacctggcatatgaacaattgaaaatcgatgatcaatcgctgt

SEQ ID NO: 996 - DNA, 1037 bp, Ambrosia trifida
gtcgatggaacgacttcttgagtccatagaaacatgtcatgtcagtaaagatggacattcagaaaccgagggacaggttgtgaaggcagagaacatcaattttgacctgcaaagaagatctaggaatcacccgcttttctttgctattgcagttgggttgttggcggagattattaattcgaggctattcactgaagtcagagactctcaagggttaacatacgatgtatcttttgagataaacctttttgacagattgaatcttggttggtatgttatctcggtaacatctacaccgggcaaggtacatagggctgttgatgcttgcaagagtgttctaagaggcttgcatagtaaaaagatagccgaacatgaacttgaccgggcaaacgaaccctgttaatgaaacatgatgctgaaagcaagtcaaatgcgtactggctcgggttgatagcccatttgcaggctgcttcagtccataggaaggatatttcatgcattaacgacatgacaatgctatacggagctgccactattgaggatgtttacctagcatatgaacagttgaaaattgacgagcaatcattgtactgttgcattggcattgccggtgctcaggctggtgatgatgacgattcaggttcttcacaagaggaggaagaatatggaggtcttcctggtgttattcccgtcggtcgagggtcccacactatgactatgccaaccacataatcattctagatcacaatattttacctagtgcctggatgaagactgaccatgagatacagaatggtgatgattcaaacgatttataatcaaacgcaatgaagatttacagcaggaaaaatcccaaacagcttaattgcaagaaccaccaataaatttatgtattctagtcaattcgtagagcgatgtacatgctatataaagacatcactgatatttattgaactcgttccgttttttctttaggtatttgaataatttgcatggtaatgtagatattcattcaataagcataaccgcaaaccctt

SEQ ID NO: 997 - DNA, 640 bp, Ambrosia trifida
gattattaattcgaggtatttttagtgaatatatgtttgtaaataatatttgaagtaacttttacttagtcaccttcatctcatatttcatcaccatcttaatatcctatttcttataatattgataaaattttattacataacaggcttttcactgaagtcggagactcacaaggattaacatactatgtatctttcgagataaacctatttgacagattgaatcttggttggtatgttatctaagtaacatctacaccgggcaaggtgcgttagtttagtttttttatgtgttttcttttattggaaacagtttatgttttaaccagttggtttctgctccaggtacatagggctgttgatgcttgcaagagtgttttaagaggcttgcatagtaaaaagatagccgaacatgaactggaccgggtccgttctctattaatttggtgaaataaaaaaatagctaaaaaggaaacggccaaaatgggctgttttggtgaaagcctcgttttaagtatagatttaaatgttgacaggccaaacgaaccctattaatgaaacatgatgctgaaagcaagtcaaatgcgtactggctcgggtagataacctattagagtgctaggagtggggcgtggaggcc

SEQ ID NO: 998 - DNA, 253 bp, Ambrosia trifida
gggtgaaagtggctcgaactttattttgaacgctttaaaccttccaaatcatttatttcaacaattaaaacaatgtagtttctgtagccatattttacacactaattatatattaaactatattattgatcagattattgaggtattattttgtatgttgacaggccaaacggaccctgctgatgaaacacgaaacggaaaccaaatcaaatgcttactggcttgggttgatagcccatttgcaggctgcttc

SEQ ID NO: 999 - DNA, 399 bp, Ambrosia trifida
atgtatacctggcatatgaacaattgaaaatcgatgatcaatcgctgttttgctgcatcggcattgctggtgctcaggctaatgatgaaatttcaggtgaaagcaataaaataatttaagaaaacggtgcagtttaattagcggtgtgaatttgtgacatgacatgcaattcacgggtttgggcttggtctaagtaaacaagtgtgagcttggttttaaaaagcgcgaggcaacatgaggcgcaaagctgcgcgccttgtgtgacataagccgcacagtgtacaaaaagcgcaattttttgggaaaaagcccactgaagcgtacgctatttgtacactgggtttttttgtgcctcaaagtgttatacatgtagctagaaaggttgtacatttaagttaa

SEQ ID NO: 1000 - DNA, 412 bp, Ambrosia trifida
ggccaaacgaaccctattaatgaaacatgatgctgaaagcaagtcaaatgcgtactggctcgggtagatagcccatttgcaggcaacttctgtctataggaaggtaacctgttagactttgtaattggtacctggtctttcaactttgctgtatagactattttacccttcaaaatcaattagtatcttttttcttctcaattgttgtatgcacgtatcatttcaggatatttcatgcattaacgacatgacaatgctatacggagctgccactattgaggatgtttacctagcatatgaacagttgaaaattgatgagcaatccttgtactgttgcattggcattgccggtgctcaggctggtgatgatgacgattcaggttaaaccaaatttccacttaatattaaaagt

SEQ ID NO: 1001 - DNA, 657 bp, Ambrosia trifida
gaatgcagccattgactttcagaaactaatctctcttctaagcaaagcgaaaggaaatatgagaatgatttaacggttgctcatcgacatctttcttctatgaataaaaacatgaaaaaaggattaacttcggatctatatctcatcttgtaggttttcattatgtatgtattagttcgtattaacttatatcaacatttattctcatttattttgcgatgatagggggtaaaagggccagaatctggttaagaaataaaaaaaaaaaacataccataaagctgcacttaagcatcatacggataaggttgttattttttttccggtattgataaaagtaagagatttaaaactcttgaaccaagtcatccgaaaaatactacgctgaaacaacgttgttaacagcgctgaaacagagttgttaacagagatgaaacagcgttgaagctcttgaaccaaatcatccgaaaaatacctcgctgaaatagtggtgaaacaacgttgtattaaccagttggtttctactccaggtacataaggatgttgatgcttgcaagagtgttctaagaggcttgcatagtaaaaagatagccgaacatgaacttgatcgggtccgttcttcattaaatcccttcacttaatatgtttttgatatta

SEQ ID NO: 1002 - DNA, 386 bp, Ambrosia trifida
cttttcagttgcttcatatggttcttgaggtaaatactgtcctaatcacttttgcattttagtatttacataacatgttaatattgtatggtcaaccaaggtttgacttttgtgaccatattgcagcatagtgtttggcttgaagatgcatttgatagagcaagacaactatatttatcatattatcgctctattccgaaaagcttggagcgatcaactgctcacaagctcatgacagctatgttggatgaagacgagcggtttgtggagcccacaccacattcattacaaaatttaacattacagaccgtaaaagatgcagttatgagtcagtttgtcagtgataacatggaggtgagcattgttggggatttttcagaagagga

SEQ ID NO: 1003 - DNA, 1296 bp, Ambrosia trifida
tccatcttaacgcaatctcttttgcatctttttaataggattctgatgaggatctacttccgtctgttttggatgctttaaatgaggtaagggccagtttagaaacataatttaccattttcatgtttttcaatgcaatccttttgtcttttcgtcctaatagttgctattttcttcaatttggtaacttaatataacgcctccatttttttaatgttgtagatagctttttacccgaagttccttacttctcgggttgagaaagaaaggcgtgcaatattatcagagctgcaaatgatgaacactattgagtaccgtgttgattgccaggtatatcgttatttgaaactttttcttattttttttcctttagcttctggcaatttgaaaatatcgcacgtgtcttattaccgttgtcagtattagtaattcatcttcattttcattttcgatttacagttgttgcaacatttacattctgagaataagttgagtaaaagattcccaattggacttgaagaacaaatcaagaaatgggatgcagaaagaattaggaaattccatgaacgatggtacttcccagcaaatgcaactctgtatatcgtgggagatatagataacattccatcgattgttcaccacatcgaagtacgttatttcctgcttataaatactgcacgacgttaattaagagaattacattaaattaaagaatttgtgtgcaggctgtttttggacagaagcaagttgacaacgaggctcctgtagcacctaaaactagtgcatttggtgcaatggctaattttcttgttcctaagttcacaggagggatatctgctgactcatcacatgacagatcactttcatcgaatggttcgaagcttcctaaaaaagaaagacatgcaattcgccctcctgttgagcataattggtcccttcctgggacacacggaaatctgaagtctcctcagatatttcagcatgaactgcttcaaaacttttcagtcaacatgttctgtaaggtggaaaatgatccatctagatgcttctaacgatacttgtaatttatacgcacagacatacatagtcaaaagttttaacatgatcatcttgaattgtagattcctgtgaacaaggtccaaacgtatggtgatttgcgtaatgttctcatgaaaagaatattcctttcggctttgcattttcgcattaactcgagatataaggtggtgtacatgcgtacctcaacaattttgtttttgtgcgcaaatattatgctaattgaatgtaaatttgcag

SEQ ID NO: 1004 - DNA, 291 bp, Ambrosia trifida
cgatatattatctagtgcctggacgaagactgaccatgaggtaagagttgaacgcgtccttatacacacaaaaacttatgcacatgcataaatttagacttgatttaatatttttgtcatgcagatacatagtggtgatgattcaaacgatttataatcaaacgcaatgaagatttacagcaggaaaaatcccaaacagcttaattgcaagaaccaccaataaatttatgtattctagtcaattcgtagagcgatgtacatgctatataaaagacatcacaaatatttgtt

SEQ ID NO: 1005 - DNA, 200 bp, Ambrosia trifida
atgtattcgtgctttaattgttacagattgctgcggatagatgtgtttttccgtcggataagccagtgattcaaaggccagtgctagatcaatgtacacggttctcttgctttcatcatgggcgaagaaaacggtttcctatatgcaaatctacaccaagtgccttctctgacaaatccgtgtttcatctgtcaaagcat

SEQ ID NO: 1006 - DNA, 297 bp, Ambrosia trifida
taattttatggttgacgcagaaaacagtgagtggcaggagttacaggggtttttaactgctcaacttccatcccacccaaagttgtttaggggacaactagaaaatggtcttcgttacctcatcttgcccaataaagttccacaaaacaggtttaattttttatttaccaacacgtgattctaaagtttttattttacttattttatttacatacttaacattttttttatgtgaagatttgaagcccacatggagatacatgcggggtcgattgacgaggaagatgatgagcaagg

SEQ ID NO: 1007 - DNA, 207 bp, Ambrosia trifida
cttggccatatggttatggatcataaacaaagttatgaaagtttaattaacgttgccgggacaatcactcttgaagaagtaagctcgtttaataataaaagttgttgggatttcgttatgattttgctttttacattgcggaatgaggctttaaacataatttacgcaggtgaacttcattggggcacaagtattggagtacatatc

SEQ ID NO: 1008 - DNA, 229 bp, Ambrosia trifida
taggaatcacccacttttctttggaattacagtgggattgttggcagagataattaattcgaggtactttttatatgttggcagataatatttgaaataattttcatttaaacttacgccatgctgctgatcatctgtttagggcgcggtactgccgtgccggtcctcctccagccatgaccttcctttttattaactccaaaaccttcacccttggtttctacaaaat

SEQ ID NO: 1009 - DNA, 391 bp, Ambrosia trifida
ccttaatcccttaaatactaaaaacccaaaacccaagtttttataaataaaatcaaatgaaaagaaaactaaaaccacaaaaaaaaaataaataaataaataaataaaatcaaactttgggtgcaaataatgaaaataataatagaaacaatatttggtgtgtgaggataaaagtcacccactcccttaatttatatctctctccttcttgatttcttccttcaatcacaaacacaaacacaaaacaatggaatctgtttcttgttcatcaatgatacgtgtttctcccccattacacctcaactctaacacaccctcttcctttaacagacccaattatgtctcctctcgtcgatacttaccgtccaagaacaagattcttactttacgc

SEQ ID NO: 1010 - DNA, 256 bp, Ambrosia trifida
atgttttttaattttacgtttattttgtctatgtgacatgagtaatttctattttatgtcattaagatatccaaaaccgaaaaatgtggtggggtgatgaggcttatagtaggtggtggacgggcggcagaaaccccagaaacaaagggagcggttgttttgggtgttagaactttgagtgaaggggggcgtgttggtaatttcacaagggaacaggtaatatgtctgccacttaactaccgacattttggtactt

SEQ ID NO: 1011 - DNA, 275 bp, Ambrosia trifida
attatatattttatgttttgtataaattacattttgtttcatgacctgttacctatttgcaggtgttcttgaaggaaattgatgagagagcatgggcttacattgcaggccctgcatcgaaccgctggggatatgcagttgatggaacagactttcttgagtccataagtaaagcgttagataataatggcacattcctaatatataatttagcaccaagtgtgtgtgtatatatagtagtattattaataatgataaacataataatgtaatca

SEQ ID NO: 1012 - DNA, 235 bp, Ambrosia trifida
ttgcaggctgcttctgtccataggaaggtaatattagactaaatagacaaaaaaattttttttgctgattggaccattgtacccctttagagtcgaaacatgcggagtagttctgtttttcgttgctttcttactgtttatggcatgtatttttcaggatatttcatgcatcaaagatttgacaatgctatatgaaaccgccactatcgaggatgtatacctggcatatgaacaa

SEQ ID NO: 1013 - DNA, 440 bp, Ambrosia trifida
cctgtacctgcagccatcgttgcttgtgttccaagaaaagtgcatgttgatggagtgggtgaagtcgatttcaagatatccccaagtgagataactgcggcaattgaagaaggtttgatggaacccatagagcctgaggctgaggtatgttgtcggcttctttaaggtttgtgacaattataactgtatatatttaccgagttcttttatttttttaaatgcagtttgaggtaccaaaggacttgataacctcggcagaggtggatgatttgaagttacaacttcaaccgtcttttgtacctactggttcatcacattcgaatgctcttagatttcatgacatagaaacaggaatcacccagtgtcgtctctcgaatgggattgctattaactacaaggtatatataatctttcttttttcttttttttttggatttttt

SEQ ID NO: 1014 - DNA, 249 bp, Ambrosia trifida
tcttggaagtaagaagcgtgaaaagcttttaagaaccggtgcacgctcaaatgcttatacagattttcatcatacggtttttcatatccattcaccaacttccttgcaggtttgcaactgcagatatgttaaacgtacctagctatcactaatgatgatgaacctttatagggtttctatccatcttaacgcaatctcttttgcatctttttaataggattctgatgaggatctacttccgtctgtttt

SEQ ID NO: 1015 - DNA, 216 bp, Ambrosia trifida
ggtaatatgtctgccacttaactaccgacattttggtacttaatttgattttattaaaattatgcatacatttttttaatgcaggtagagctgttctgcgtgaatcatttgattaattgttccctagagtcaacagaagaatttctttgtatggaattccgttttaccacacgagataatggaatgcgtgcggcttttcagttgcttcatatggtt

SEQ ID NO: 1016 - DNA, 201 bp, Ambrosia trifida
gcaggaaaaatcccaaacagcttaattgcaagaaccaccaataaatttatgtattctagtcaattcgtagagcgatgtacatgctatataaagacatcactgatatttattgaactcgttccgttttttctttaggtatttgaataattgcatggtaatgtagatattcattcgaaactttagcaagcataaccacaaacc

SEQ ID NO: 1017 - DNA, 273 bp, Ambrosia trifida
ttgcaaaagagagttagagatgagagacatgcagcttttaataaataaataaaagacaatcgcctctcgtacatgaagctctcgccttggctgttgggacttaaagcctcagagcgcctaacgctttcatattaacttcttctatcataaagcaggttcttcacaagaggaggaagaatatggaggtcttcctggtgttattcccgtcggtcgagggtcccacactatgactatgccaaccacataatcattctagatcacaatattttatct

SEQ ID NO: 1018 - DNA, 603 bp, Ambrosia trifida
tgacaaggctttgagttacaatccagtcctctttagaccgccttttcatgatctgcactttcaacaggtgagcaaacaatttttatccgccttttatatgattattttttcttattttttttttataaattctgtgtgctctcatgacttgtttcctattttacaggtgttcctgaaggactctgatgagagagcatgtgcttacattgcaggccctggcacctaaccactgcggatatatagtcgatggaaccgactttcttgagtccataagaaacatgtcagttagtaaaggtaaacatttatgttatataaatttaccttgaagaatttgtatttgtttattatctaccaagtatacaaatatattaaatttcttttacaaatggacattcagaaactgagggacaggttgtgaaaggcagagaacatcaattttgacctgcaaagaagatccaggaatcacccacttttctttgctattgcagttgggttgttggcggagattattaattcgaggtatttttagtgaataactgaatatatgtttgtaaataatattgatttgattttacatgaaattgccgtttgacttttacaggc

SEQ ID NO: 1019 - DNA, 519 bp, Avena fatua
agcccctatgtcgactgcaagtccatttggtgccatggcaagcctttttgcgccaaaactgccaggcggcttggctgcaagcctaactggtgaaaaatcacctgccacagataaactaaaacctataaaaagggaaagacaggcagttagaccccccgtagagcataaatggtctcttcctgatgttcatcaggatgccaagcctccagtgatttttcaacatgagttgattcagagtttctctatcaacatgttctgtaagatacctgtcaaccgagttcagacatacaaagacctgcgcagtgtactgatgaaacggatatttttatctgctctgcattttagaatcaatacaagatacaagagctcaaatcctccctttacatcagttgagctggatcacagtgactctggaagggaagggtgcacggtcactactctaacagtaacagctgaaccccaaaattggaggagtgccatcaaagttgctgttcatgaggttcggagactcaaagagtt

SEQ ID NO: 1020 - DNA, 994 bp, Chenopodium album
atgaatactatagaatatcgtgttgattgccagcttctacaacatttgcattccgagaacaaattgagcggaaggtttcctataggtttagaggagcagatcaagaagtgggatgttgataaaattaaaaaattccatgagcgctggtattttccagcaaatgctactttgtatattgttggggatatcgataacatctcgaaaacaatttaccaaattgaggctgtatttagccagactggcttggagaatgaaacagaggcttccccacctccaacgcctaacgcatttggtgcgatggctagtttcctagtgcctaagctctcagttggccttggaggagcttctcaagataagtcatcaagttctgatcagccaataattactaaaaaggaaagacatgcagtacgtcctcctgtccagcacaattggtctctacctggaagcggttgcgtatctgatcctcctcagatatttcaacacgagttacttcagaatttttcatttaatatgttttgcaaggttcccgtgaataaagttcagacgtatggtgatttacgaaatgtactgatgaagaggattgttctttctgccttgcatttcaggattaacactcgatacaagagttcaaatcctcctttcaccgcgattgaattggaccacagtgattctggaagagaaggttgcactgtaactactcttacagttactgcagaacctaaaaattggcaaaatgcaatcaaagttgcagttcaggaggtccgaaggcttaaggaatttggtgtgactaagggtgaattagttcgctatagggatgctttgttgaaagatagtgaacatttggctgcaatgattgataatgtgccatctgtggacaatctggattttattatggaaagtgatgcattaggacacaaagtgatggaccagctacaaggtcatgagtgtttggttggtgttgctggaacaattacccttgaagaggtcaattcaa

SEQ ID NO: 1021 - DNA, 1314 bp, Chenopodium album
caacccatcattcgcaccattggacgcagcaaatggcactaaattatatgacagagagacaggaatcactcagcgccgtcttttaaacggtattcctgtgaattacaagatctcaagacatgaaagccagagtggtgtcatgcggctcatagttggtggtggacgggccatggaaagctcagatgaaaaggggtctgttgttgttggtgttcggacgctcagtgagggtggccgtgttggcaacttctctagagagcaggtagagcttttctgtgtgaatcatctgataaattgctctctggaatctactgaggagtttatatgcatggaattccgttttacattgagagacaatggaatgcgtgctgccttccagttgctacacatggttcttgagcatagcgtctggctggatgatgcgtttgatagagcaagacagttatacatgtcttattatcggtcaattcctaaaagtttggagcgttcaacagcacataagcttatgatagcaatgttgaatggagatgaacggtttgttgagcctacaccagaatcattgcagaatttaacattacagtcagtgaaagaggctgtaatgaatcagtttgttggtgataatatggaggtcagtattgttggagacttctcagaagaagagattgaatcttgtattcttgattaccttggtacggttaaagcaactcgtgaatttgagaagaagatttgtgatgctattatatttcgtccaccatccgatatgcaatttcagcaggtttacataaaagacacagatgaaagagcttgtgcctatattgctggtcccgcaccaaatagatggggcatcacagttgataatgttgacctttttgaaaacctgggcgagctatcaaaatctgagacattgccatctaacaactccaatgatgtaaaggagctgcagagcaaaattcggggccatccactcttctttggcataacaatggggctgctagcagagattgtaaattccaggcttttcacaacagtaagggattctctgggtttgacatacgacgtgtctttcgaattgaatttatttgataggctaaatttcgggtggtatgtgatctctgtgacatcaactcctggaaaggtacataaagctgttgacgcttgcaagaatgtgctcagggggttgcatagcaacagaatagctccaagggagctggacagggcaaagaggaccttattgatgaaacatgaagctgagatcaaatcaaatgcgtactggcttgggttgttggctcatttgcaagcatcgtctgtcccaaggaa

SEQ ID NO: 1022 - DNA, 4253 bp, Convolvulus arvensis
ttgagaggaaaacaattcggatatgcaagcctcgtcagttatattcaacaccaagcctcttttggctcccgtccaagtcaagtctctacacagcgatccgtcgttaccgtcatgttgctcttcttctcgggtgctctcacctcgtcccaattgggctcagctcaggaggagtgtgaatcttcgttccaatcggcatctgcagcatcgagcttatctcttaaaaataagaattcagtgagaagatatctatctcagtccgaggaactgtcaccacaagaaaatttgctaaatagatgtcaacatgtgtcatgtttccgtcacctgcgaagaaagcatactggtatcaacagattggcgactagagcctttcttgataaatcgatctgtcatttgtcaaagctgaagcctaataatgtatctgtgaaacaacctcatgtaccacgtgcatccgttggcccagatgagccacatgctgcaagtactgcctggccggatggtgtactagaaaaacagtctttggaattgttggatcctgaggtggaaagagctgcgtttgagcgctttttatgttctgaacttccatctcacccgaaattatatcgaggacaactgaaaaatggacttcgatacctcattctacctaataaggtccctccaaatagatttgaagcacacatggaagttcatgttggatccattgacgaggaaggtgatgagcaaggaattgcacatatgattgaacacgttgcatttcttggaagcaagaagcgagagaaacttcttggaacaggggcgcgctcaaatgcatatacagattttcatcatacagtgttccatatccattcacctacaagtacaaaggattctgaaggtgatttactaccagttgtcctggatgctctgaatgagatagctttccaccctaaatttcttgcttcacgggttgagaaagaaagacgagcaatattgtcagagctgcaaatgatgaatacaattgagtatcgtgttgattgccagttgttacaacacttgcattctgagaacaagctgagtgaaaggttcccaattggattggaagagcagattaagagatgggatgccgataaaatcagaaaattccatgagcgttggtattttcctgcaaatgccacattgtacattgtgggagatatagataacatttccaagacagttgaccatatcgaagctgttttgggcagagtggtgggcagagtggcatggaaaatggggcaggtgctgcacctacacaaagtgcatttggtgcaatggcaagtttccttgccccgaaattgtcagtaggtttggttggaaatacatctcatgaaaggtcctctgtctccatcgagcaatctaaaacttttaggaaggagagacatgcagttcggcctcctgtacagcataattggtgccttcctggtagcaatgaatatgtaaagcctccacagatatttcaacatgaattgcttcagaatttctctatcaatatgttctgtaagattccagtgaacaaggtccgaacctattctgatctgcggaatgtgttgatgaagagaatatttctttctgctttgcattttcgtattaacacaagatacaagagctcaaatcccccattcacatcagttgaactggatcatagtgattctggaagggaaggatgcactgtgactactcttacagtgacttctgaacccaaaaattggcggagtgcaattaaagttgctgtgcaggaggtccggaggctcaaagaatttggtgtcacaaaaggtgaattagctcggtatttggaagcactaattaaagatagtgaacagttagcggctatgattgataatgtttcatctgtggataatctggattttgtgatggagagtgatgcacttggccatactgtgatggatcaaaggcaaggtcatgagagtctacttgagattgctggaacagtttctcttgaggaggttaattctgctggtgcagaagtattggaattcatatctgattttggaaaaccatctgcaccccctcctgctgcaattgttgcttgtgtcccaaagaaggtgcacattgatggagcaggagaaatggaattccagataacagcagatgagataatagctgctattgaagacggtctgaaggaacacatagacccagaaccagagcttgaggtgccaaaggaattgattgcctcagcacagctccaagaacttaaattgaattcaaaaccatcatttgtaaccataagcccagatgtaaatgatacaaaactgtatgacaaggaaacaggtatcgttcagcgacgcctttcaaatggaattcctgtaaattacaagatatccaaaaatgaagccaattgtggagttatgaggctcattgttggtggtggccgtgcagctgaaactcctgatgcaaagggagctgttattgtgggtgtgcggactctaagcgagggtggtcgcgttggtaacttctcacgtgaacaggtggaacttttctgtgtaaatcacctgataaattgttccctggagtcaacagaagaatttatctgcatggagtttcggttcactttgagagatgatgggatgcgtgctgccttccagttacttcatatggtacttgagcacagcgtttggctagatgatgcatttgatagagcacgacagttatatttgtcatattatcggtctattccaaaaagtctagaacgtgcgactgcacataagctcatgctagctatgttgaatggagatgagcgctttgtcgagccaacaccacattcattacaaaacttgaatttggaaagtgtaaaggatgctgtgatgaatcagtttgtctgtgacaatatggaggtgtctattgttggggacttctcggaggaggatattgagtcatgtatccttgactatctgggaacagttagagaaacaagaggtttcgagagagcacagaaatacaacccaatcatatttagaccaactcccgatttgcagcaccaacaagtattcttgaaggacacagatgagagagcgtgtgcttatatcgcaggtcctgccccaaatcgttggggatttacttttgaggggaagatctttttgactctgtcaataatgtttccacttataatggtgagcaactaaactctggggaacaacccaacaaactggaaaatggcctgcaaggaagatttcacactcatccattgttctttgccatcacaatgggtttattggctgaagtaataaactccaggctttttacaacagtcagggattctcttggattgacatacgatgtttcatttgaactaaacctgtttgatcgcctgaagcttgggtggtatgtgatttcagtgacatcaacccccagtaaggtacataaagctgttgacgcttgcaaaaatgtcctaagaggtttgcatagcaacaggattacactgagggagctggatcgggcaaagcgaacactgctcatgagacatgaagctgagataaaatcaaatgcttattggcttggtttgttagctcatctgcaagctgcatcagtacccaggaaggacatctcgtgtattaaagagctgatttcactatatgaagctgccactgttgaagacatatatcttgcctatgaacagttgaagatagatgaaaattccttgttctcttgcattggaattgctggggtaaatgctggagaagacatttcagtacctatagaagaggaagattcaatcgagggccttcctaatgttattcccatgggaggacgtggttcatctacaatgacacggccaacaacttgagggtgatagaaattctttgaaagactatgattgtatgagtgacctataggacacaacacttggcggtggttttgctgggtagaagctgtatgtccactcgaagaatctgttatttatgcccttgaaaaggttgtgctgtcatttccaactggtccatagaccatggcaaaagagaaggtgcaggatagcaagctgccaatcattattatactacggtttacagaatgtctcggattatcgggtctgactcgacgctagggcttcatgagattactaggtccccattgattatggcattgaagtatagtcagtcattataggtgcagctaacttagtgacaactatgatttcatatgtacccaagtcaataggattatatttattactaattctttgatcatgaagccaatatttaacttcagttatacatcag

SEQ ID NO: 1023 - DNA, 3741 bp, Conyza canadensis
cctcgacactgagagcagcgaatggaggagttacagggtttaggtgctgaacttccatctcatccgaagttgtatagaggacaactagaaaatggtcttcgctacctcatcttgcccaacaaagttccacaaaataggtttgaagcccacatggaggttcatgtcgggtcgatagatgaggaagatgatgaacaaggaattgcacatatgattgagcatgttgcatttcttggaagtaagaagcgggaaaaacttctaagaactggtgcacgctcgaatgcttatacagattttcatcatacggtgtttcacatccattcaccaacttctttgcaggattctgatgaagatctacttccatctgttttggatgctttgcatgagatagctttttacccaaagtttcttacttcccgagttgaaaaagaaagacgtgctatattatcagagctgcaaatgatgaacaccatcgagtaccgtgttgattgccagttgctgcaacatttgcattctgagaataagctgagtaaaagattcccgattggcctagaagatcagataaagaagtgggatgcagaaaaaatcagaaaattccatgagcggtggtactttccagctaatgcaactttgtatcttgtgggggatattgacaacattccaaagacagttcaccacatcgaagctgtttttggacagaagaatgttgacaacgaggttcctgtagcacctaaaactagtgcatttggagcaatggctaattttcttgttcctaagctaacaggagggatctctgctgactcatcacatgacagatcatctcttttagttgatcaatcaaaacttcccaagaaagaaaggcatgcagttcggcctcctgttgagcataattggtcacttcctgggagacatgaggatctgaagtcaccacagatatttcagcatgagctgcttcagaatttttcgatcaacatgttttgcaagattcctgtgaacaaggtccagacgtatggtgatttgcgtaatgttcttatgaagaggatattcctttcggctttgcattttcgcattaactcaagatataagagttctagccctccatttacatctattgagttggatcatagtgactcaggaagagagggatgcactgtcactactcttacagtaaccgctgaacccaagagttggcaaagtgcaattaaagtggctgcacaagaggttcgaaggcttaaggagtttggtgttacaaaaggagaattggcgcgttatcttgatgcgctactgaaagacagtgaacagttagctgctatgagtgataatatttcatcagtggataacctggattttgttatggagagtgatgcgcttggtcatatggttatggatcataaacaaagtcatgaaagtttgattggtgttgctggaacaatcactcttgaagaagtaaatttcattggtgcacaagttttggagtacatttcagattttggaaaagcatctgcacctgttcctgcagccattgttgcatgcgttccaaaaaaagtacatgttgatggagtaggggaaattgatttcaagataaccccaagtgagattacagctgcaattgaagaaggtttgaaagaacctatagagccggaggcagagtttgaggtaccaaaggaattgataacctcggcacaccttgatgatctaaagctacaacttcaaccatcttttgtatctactggtttagattcgacttctactaaagttcatgataaagaaactggaatcacccagtgtcgtctctcaaatgggattactgtaaactacaagatatccaaaaccgaaacttgtgggggggtgatgcggcttatagtaggcggtggacgggcagcagaaacaccagaatcaaggggagcagttgttttgggtgttcgaactttgagtgaagggggacgtgttggtaacttttcaagggaacaggtagagctcttttgtgtgaatcatctgataaattgttcactggagtccaccgaagaatttctttgtatggagttccgttttactacacgaggcaatgggatgcgtgctgctttccagttgcttcatatggtacttgagcatagcgtgtggcttgaagatgcatttgatagagcaaggcaattatatttatcgtattatcgctctattcctaaaagcttggaaaggtcaactgctcacaagctcatgatagctatgttggatgaggatgaacggtttgtggaacccacaccacattctttacaaaatttaacattgcagactgtaaaagatgcagtgatgaatcagtttgttagtgataacatggaggtaagcattgttggtgacttttcagaagaggatatcgagtcttgtgtaatggattacctaggcactgttagagcaacaaaaggggctgatagggcactgagctatacccctattaactatcggccgtctcctaatgatttgaactttcaacaagtgttcttaaaggacaccgatgaacgagcatgtgcatacattgcaggccctgcgccaaaccgctggggatatacagctgatggtacagaccttctcgagtccgtaaataatctgtcagtcaataatgatgtacaaccagaagctgaaggacagctcgtgaaggcaggtgatagtagtactattgatctccaaagaaaatctcggaatcacccactatactttgcaattgcagtggggctgttggcagagataattaattccaggcttttcaccgaagtcagagactcccagggattaacttatgacgtatcgttcgagttaaacctatttgacaggttaaagcttggttggtatgttatatcagtaacatctacaccagccaaggtacatagagctgttgatgcatgcaagggtgtgctaagaggcttgcatagtaaaagaatagctgaacatgaattagaccgggctaagcggactctattgatgaaacacgaagctgaaaccaagtcaaatgcctactggctagggttgatagctcatttgcaggctgcttctgtccataggaaggatatatcatgcatcaaagatttgacaatgctatatgaagcggccaccattgaggatgtgtacctggcatatgaacagttaaaaatcgatgaacaatccttgtactgctgcattggcattgctggtgctcaggctggtgacgaagtttcaggctctttaccagaggaggagtatgttggaggacttcagggtgttattcctgtaggccgaggttcccacacgatgacaatgccaacgacataattattctagatcaagatatatatatatatctagtgttcggaggaagattgactatgtggtacacggtactgacaatttgaactgcatattgatcggctaaaactctgggtaaaacgtgagagatttgtagttgaagtatacgtgacttcatggtgtgattaatctcaaatagattgattacagtaagtcactggctcatgtagtggtttacaataaattgtgtattctaggttagtcataaatcgagcaatgtacatgtagtaactttatatagacatggccattatttttgttaaacttattcgattacttcctgtgtgtaattggattattacatggtaatgcagaaatatagctgattttttttacagataatttagttcagaaagtttaagcaaaaaaaaaagaaaaaaaaacaaaacatgtcggccgcctcggtctcta

SEQ ID NO: 1024 - DNA, 20825 bp, Conyza canadensis
  unsure (1)..(20825): unsure at all n locations
aatgaaaatctattagtgtgaaaaaaatatggaggtgtcacgtagaataaatcctatgtgacatgtttagagataattttaatttgaggtggatggctttaaaaagtcatgataactattgttttattatgtatatagatatagatatttatatctatataatattttaaagcaaaaagcctctatattttcaatattgaatttaaattttcaatattgattttaaatactttcccaaaacgtctctcctatctattctatatttatctaaaataactattgtatattaccattagtctattctcaaatctcaaccaatcattttttttctatcacctccataaatcatttattcctnnnnnnnnntcaaaatcttttatctcaaatactgtaaatcgataaattataaaannnntatgggtgttcttaaaatttcttgctctttcatnnnnnnnnnnnnnnnnnnnnnnnnnnnnnnnnntttaaatccgatggcggaacccatacagttaaggcatttggctatcacactctatgacccatcacactttatgacctatcaccccaccatctcaccgctgcaacgtgcggttatttactctcgtacatatttaaccaagaaggaatttatatatgtgtttagtatatttatctatgtctatttttgtcattttacatactttattaaaaactatattaagctgtcaaacacttaaataagtctacaaactatcgtttttaattttcagttatcagtcaccagctttcagctattagtcactagctagtttaatcaaaaatacaaacgaataatatatacacatatatatatatattttgtaggagacccttattttgagaacctaatttttgttaatatccgtgagaactcctaaattttatattggatcacatatattttttttttaattcacatgtgaaacgttatatgttacacaagattttttttttcaaaaccttatatatagtcgtttgtcatatgtgaatataaaatgttaacaaatttattcacaagttcataaaaggctactttgaaggttttttaaaaaggttttttctataacatatatttttatatcatttcaataaaaaaaaatcttaacaaatataatatataatttaaaagtttttatggttttaaaaaaataaataatttttaaaataaggaaacttttttccgtatacaaaatggacagcgataaccacacaaaaaaatggataaccatattcggtcccgaaaccatcctagaaccgacatgaacatacagaaacaaaatatcttcggtctttcgaaaccataccaaaccgacccaaacccaatcacaaaatacatttaaatttaaaccaatagaattaaaaatgaaatactcgtaaataaaatatagatatacaaaaattattaattgccacaaaaaatcaaaactgggcttctgcttcttcaatcaacaaaactttttttttttttccttcttgtgtttgtgtgaggataaaagtctccccctccatttttgcaccactcttccttccttccttccttctgcctgcgacacacacaacacaaatatggatgcagcagcagcagctgcagcttcatcaataatacgtatttcaccaccagcagcgttacaattaaatcccaattattcttcaagaaaacctaattctatctcttctcatcgcttcttcttatctcatcataaaaccaataataaagctcttgcttccctacgctctttcaatcgccgcaccgccgttcctccgccgcgttatttccccaccactaaggtcgtttttttcactttcatacatacatatacatacattttcaatcatcacaaacattaaagtttaaaacgttttgtttaatagtatcaatactatgaataacttgtaaccctatcctgatacaagttgaatatacaactaaattccaaacgtatgttcatatcttatatctatatgtgtgtgtatatatatatatttggaatctagttcagaatttggaatttcatttcatacttttgtctattgataaagggaggttaatattattctgtttggtgtatggaagttggttatgtgaataagttaatgttgtgcatttctgagtgtagattgctggtgatagaagtggttatttgttggagaaaccgttgactgaaaggccgttgcttgatcaatgtacaaggttatcttgctttcatcatgggcggagaaaacggttccctatttgcaaatccactccgagtgcgttttctgacaagtctgcgtttcgtctgtctaagcatggagtagataatgtatttgtaagttcattgattgcggttcattacataggttctttaatactttttgaatgtttgtttgtgtgtgtgtttatgctccagttctatattttggttcatatgtatgttttttgtatctaatttacatgcaagtttttgtcttttttgatctgaaccatggttattggaagactagcctgaaggaaactattaaaccattgtttatgtaaaagaatcacttttatacattagtatgaatactttgatttgatgcgatattctttatttttgtggcgttgaaaagataattccatactaaacaatgtcaataagtagatccggcaatttgttaaaccccaagattacaagttataaggaaagaacgagaaaaataagatatagaagatgttaaatatttgaataatctagatcaccaggtattagggtagaacattatccgctcaagtaaaccctagattaaacttgaattgtacactgtacgtttttgttgcacacagtagcgtacatatctgatttataccctctaaatttttagcaaaaacaggttcgagctccatgtgcggctgtgggtcctgatgagccacatgcagcaagtacagcctggcctgatggtgccttggagcagcagtcgcccgataattttctcctcgacactgagagcagcgaatggagggagttacaggggtttttaggtgctgaacttccatctcatccgaagttgtatagaggacaactagaaaatggtcttcgctacctcatcttgcccaacaaagttccacaaaataggtgtaatatgtgatctgaaacctatgtcaatttattttttgttttgcggtgggcgggaaatacatagaaattctagcttgcttacctattttattgttgttttctattacatgaacatttttaaactttgattatgtgaaggtttgaagcccacatggaggttcatgtcgggtcgatagatgaggaagatgatgaacaaggaattgcacatatgattgagcatgttgcatttcttggaagtaagaagcgggaaaaacttctaagaactggtgcacgctcgaatgcttatacagattttcatcatacggtgtttcacatccattcaccaacttctttgcaggtttagaactgcatatttatgctttatttgaattttttttgttctataattcattctattagtcttacacatctaccaatatataataaataggagagcttttttttgtttagtttttaatatgcaaacattttctcagatgaatgcaaatcggatgaacataaacatttgaatctttctgttaatgagtctaaacagacctttatatactttctgtcttcttttacgctatcatttttgtatttttattgttaggattctgatgaagatctacttccatctgttttggatgctttgcatgaggtaagagccaaattcgattcattgttttcatctttattgcataatgtggcttataacagttgttttttgttttttcgcatttacaaaataatatctgtaacaatatgtagctataatggttattatcttttatgatgtagatagctttttacccaaagtttcttacttcccgagttgaaaaagaaagacgtgctatattatcagagctgcaaatgatgaacaccatcgagtaccgtgttgattgccaggtatttaactgctgttttttatgtataattctgtcgtatttttactgttgtcagtattagtaatcattttgttgtttgctaaacatagttgctgcaacatttgcattctgagaataagctgagtaaaagattcccgattggcctagaagatcagataaagaagtgggatgcagaaaaaatcagaaaattccatgagcggtggtactttccagctaatgcaactttgtatcttgtgggggatattgacaacattccaaagacagttcaccacatcgaagtacgtaatttttctgcttacatggtgttttacaataatttgaagtacattaatttaaggaatatatttgcaggctgtttttggacagaagaatgttgacaacgaggttcctgtagcacctaaaactagtgcatttggagcaatggctaattttcttgttcctaagctaacaggagggatctctgctgactcatcacatgacagatcatctcttttagttgatcaatcaaaacttcccaagaaagaaaggcatgcagttcggcctcctgttgagcataattggtcacttcctgggagacatgaggatctgaagtcaccacagatatttcagcatgagctgcttcagaatttttcgatcaacatgttttgcaaggtaggaaatgatttagaagctttcaatagtatttatactcgcatgatcaaatgctgaaacatgatttgattatcatttggtgtagattcctgtgaacaaggtccagacgtatggtgatttgcgtaatgttcttatgaagaggatattcctttcggctttgcattttcgcattaactcaagatataaggtggggtgaatgtgaaaaatttgacaaaccctttctatgtagcatatctcatatattttgatttgttatgttgctcacaattgattatatgtgcaaattgtttgctaattaaaggtaaatttgcagagttctagccctccatttacatctattgagttggatcatagtgactcaggaagagagggatgcactgtcactactcttacagtaaccgctgaacccaagagttggcaaagtgcaattaaagtggctgcacaagaggtagcacctgtgtttttttttttttttttggattttttaaccattagtaatattgaattattcacatgttatagttcttgttttttgacattgaatctgattcaggttcgaaggcttaaggagtttggtgttacaaaaggagaattggcgcgttatcttgatgcgctactgaaagacagtgaacagttagctgctatgagtgataatatttcatcagtggataacctggattttgttatggagagtgatgcgcttggtcatatggttatggatcataaacaaagtcatgaaagtttgattggtgttgctggaacaatcactcttgaagaagtaagctcattatatgattgtactccacctgccttttactaaatgacgacttcagtctaatacctcatacaaacaaagtctccaaagcatcatgtttctttgatgattgtgaaatggatcttttaacatatttgtttgcaggtaaatttcattggtgcacaagttttggagtacatttcagattttggaaaagcatctgcacctgttcctgcagccattgttgcatgcgttccaaaaaaagtacatgttgatggagtaggggaaattgatttcaagataaccccaagtgagattacagctgcaattgaagaaggtttgaaagaacctatagagccggaggcagaggtatgttttctgctttttgaggaactgagattgattttggaacttctatttgggatacttagaggtgacagcttgagcattcacttgtgaatgggttgattcaggctatgctctatgtttaatgggtcaaatgggtgaaacttaaaccgattatcataggaggaaatgggtcaaacatggagagtcacccaaagtcagcttttaacttataaaacctcccaagtcataattttatattgctaaatatacttataaacatatttgactcccttgttattattggaacacatgtattactttcgacttgaaacgtgctgccatcatgcccgtttagttacctctctagggatgatataactctgcattattaccgacatttactatcttacgtttgcagtttgaggtaccaaaggaattgataacctcggcacaccttgatgatctaaagctacaacttcaaccatcttttgtatctactggtttagattcgacttctactaaagttcatgataaagaaactggaatcacccagtgtcgtctctcaaatgggattactgtaaactacaaggtatataatgcttctgatatatttatattttcgtattctaattttattatccttgtgacatgaatatctgtttccgtgttaataagatatccaaaaccgaaacttgtgggggggtgatgcggcttatagtaggcggtggacgggcagcagaaacaccagaatcaaggggagcagttgttttgggtgttcgaactttgagtgaagggggacgtgttggtaacttttcaagggaacaggtaacttgtcacatatttaccaacatttggtgctttttattgttaatgatcataagtatgtatgcattatatttgtacatacaagtatctatgttcatattacgtaatcatctttcaggtagagctcttttgtgtgaatcatctgataaattgttcactggagtccaccgaagaatttctttgtatggagttccgttttactacacgaggcaatgggatgcgtgctgctttccagttgcttcatatggtacttgaggtaaatacttggtatcatttctcaaccaatgttacatgatattatcacacatagtcacatgatttcaatttgctatgttcaattaacgtttgattattgtgagctttttgcagcatagcgtgtggcttgaagatgcatttgatagagcaaggcaattatatttatcgtattatcgctctattcctaaaagcttggaaaggtcaactgctcacaagctcatgatagctatgttggatgaggatgaacggtttgtggaacccacaccacattctttacaaaatttaacattgcagactgtaaaagatgcagtgatgaatcagtttgttagtgataacatggaggtgcgtatcattgttttgttatatattattaatacaaattcatgtacatatatatatatatatatttaacgttgataataattttatctatcacattaggtaagcattgttggtgacttttcagaagaggatatcgagtcttgtgtaatggattacctaggcactgttagagcaacaaaaggggctgatagggcactgagctatacccctattaactatcggccgtctcctaatgatttgaactttcaacaagtgagcatatttatttgtagtatttggttactcttttagatatttgtatatgaaaaacatttggtctgatagtttgtgacctgccctacaggtgttcttaaaggacaccgatgaacgagcatgtgcatacattgcaggccctgcgccaaaccgctggggatatacagctgatggtacagaccttctcgagtccgtaaataatctgtcagtcaataatggtaagcatcctcaagatatatatatatatatatatattattttgcgtcttgaagtcaagtttttaaggatgagtaattttcatcttcaagccagtgtgtgcaaatacaatgctctgaccagtgacagacctaacaacaagtatttaaaagctatttactatggttgtgaaaacaacatccagaagattgttaggctccaaggaccaaactttttgatatcaaactccaatagcccaagtagatatgtgttagtctataagggtcctttcgatgattcctccaagcctagctgcctctgttgccttagcattcacaatgctgtgaaccaaaccctagatcagcaagtgtaaccatatattattagtcccattgtcgggtgactacaaattcacatagaaaggaggttcagattaaacttatgctataaaccttgacggtttggagactttatctttaaaagtgcaaatgtagaataaatttgaagtgaaaatccatgtgtggtacgttattactaaacttaagtatgttcttacttgttcataaataaacctggcttaaaaaagtttccgatcaactgctatggctacgttttcttcctcttagatgggttgtatttaccttagcttgtaaaattcctattcatctctttagaatacaaatatctgaagttttctctacagatgtacaaccagaagctgaaggacagctcgtgaaggcaggtgatagtagtactattgatctccaaagaaaatctcggaatcacccactatactttgcaattgcagtggggctgttggcagagataattaattccaggtagatttagtgtactgctaatctatctcttccttgttagatcctggtaaactaatatttgaagcaatttgcatttaatggctttcctttcaatatttataagtctattgtaatcacatagcaaaaggtgggtgcctattagaaattcttatgtgaaactgataggtgttatgtgaaataagttttatttatgatttattgctaattggataggtgtgttcgtgctttgcaggcttttcaccgaagtcagagactcccagggattaacttatgacgtatcgttcgagttaaacctatttgacaggttaaagcttggttggtatgttatatcagtaacatctacaccagccaaggtgagtaattcagttgtcagcaattttacctctcatatgtagtaggatttctttttcattgttcaaccagttatggtgctcattcaggtacatagagctgttgatgcatgcaagggtgtgctaagaggcttgcatagtaaaagaatagctgaacatgaattagaccgggtacgttcgtaactaaattcctacacatcacttgtttaatgttggctacgcacaaaagaaatgctatcaggagtttaatgacgagttattcccttctggtagaggtggacatttccggtcattcacttataaatggtttgattttggtgatgccctaaaactaattatatatgaaaacattatttagtctgaaaaaggtattttgggttgcacattatgccacctttacgtcctggtctcgatatggaacatgacatctccatcccattgttttttttgtttctctttggtgtttgcggggtgattagaaatttatttatcacatgtgcctcaaaatcattatggatctgatccttgaggattattttgtatgttgacaggctaagcggactctattgatgaaacacgaagctgaaaccaagtcaaatgcctactggctagggttgatagctcatttgcaggctgcttctgtccataggaaggtataaactacaacaaaagagttcttctctatattgcttcacctgactgggtagatctctatataaccttgctgaactgacctttttactgtttaaagtcgaaaccttacaaaatcccatcactcttgtaatattagttttacccggctgagtaccgactaccgagtaggctatttttacctgactgagttacgtggactatttaacctttacaaagtcttttcctaatgcattgtttacctgactcgatagaatgtccttaacatggctctttagtaaaaaaaaggtatggctctttagtataaaaacattatttagattaataaccgtatcattttcttaactgcaaaataattccactttctgcagggtgtgttgtgttaagtttgttactgttttttatttgtactcttcaggatatatcatgcatcaaagatttgacaatgctatatgaagcggccaccattgaggatgtgtacctggcatatgaacagttaaaaatcgatgaacaatccttgtactgctgcattggcattgctggtgctcaggctggtgacgaagtttcaggtgaaagcacactgctgcttaattttgaatgtttttctgtttatgtttttcatgaggattcattacaaagttcttagacagtcctgtatttaataatttatgatcttaacatcggattataaatgaacaagatttttcatgttagcatagtttttcatgcaggctctttaccagaggaggagtatgttggaggacttcagggtgttattcctgtaggccgaggttcccacacgatgacaatgccaacgacataattattctagatcaagatatatatatatatctagtgttcggaggaagattgactatgtggtatgtttcttggctaatagtttataataatacccagctatttttatcctattaatgctgatgccaacgttcaattggttttagatgcaagtttagttcctagattatttttgtaaagcacttcaacatgctttatgcaggtacacggtactgacaatttgaactgcatattgatcggctaaaactctgggtaaaacgtgagagatttgtagttgaagtatacgtgacttcatggtgtgattaatctcaaatagattgattacagtaagtcactggctcatgtagtggtttacaataaattgtgtattctaggttagtcataaatcgagcaatgtacatgtagtaactttatatagacatggccattatttttgttaaacttattcgattacttcctgtgtgtaattggattattacatggtaatgcagaaatatagctgattttttttacagataatttagttcagaaagtttaagcatcaagagaaatgatacatctcttcattgttgattgctgtagttaatacgattgtttggggtgcagctatcaagtccaagcgtcaattgttaaatcattattgagcccaatacatattgaataagttttagaatcaggaatacatgacagtgatccgggctgttgacgcctcagcgcctgagcgacatgtatctaatctttttacatgctttggtatgtaatagcataatatggcagtttgatgtgttttgaaacctaatattaaaagttactcgtattaaactaaaagatggtttttgtttgtaatccttagaaatcacttgttttcatgccattttttatgacattttgatatgatcatataaatgtaaccatatgcaatgcttctacttattgggtgaaactgacaccggaaagaagtaaatgagtagagtttgagatgtatcaacacataaacagtcatataaagggatagtaagctatcgtaatccacatgacaattgtagttacaaactcgtaggcacaaattctatgtaaggtaatgaccatgtactcgctcaaagtcaatcatagcacccttgtcgctcagatgaagaaagcgtcaattccctaaatccttctaaattgctcaaatccgtaagctcattgatctcaatttgtggaaaaatggattcctaaaaagatcaacctttttgtttggagattaatccggaacggccaccaatgttagtttggacgtggtgttgatgtcaacactgttggttgtttggtgtgtaatcaggaattgatgattttgattactctcatattgattacttattgggtattgagattaaaatattaaatgtttcccaaggttccatatatctaaagcatctactttcctaatatcattgtattgcttcgtgaacaagtttatgttagcctatcgtatatgccatctgtagaaggaaaatgaatgtccaaaaaccctttgaaagtcatgcaaactgtacgaaatgtggaaaattcagaaaactctcacaaaacattccatcttttaaggctggaattaaatataaaaactgttttaagtatcaaaaacacaatagaaagaagagaatcaaataagatgagatcttacacaacactataaacattccggtttatctagctactggcaagcacctattttgtgcatccaaaagtttatattgtctatgatttgaaagatgtttcaaaattgtttaaaaaatgaaggcgtcatgagaatggttttaagaacccgctctattacttagttggagagtcattcgtatgttcatggccgccagttctgctgccaaatatctaaagacgtaaggcatagcaactgtttccatgcctttactcgtctgacaagaaacacatgtcacttttttcgggattctaccaggtggcagcccagcaatctccctcattacttttttctggtgttggatgagggaagttgtaaggatgcttccacaaatagagcagatgtcagctatgtgatgatcagaactcgtgtgaagcctatcatgcaataaatatgctgccccatgcgcaagaagcgagtcacgttccatctcaccaaatcggataccacctcctttctttcttccttttataggctgacgtgtaacttgatcaacggttccagttgacctaacctgaacccagagtcattttatattaggcaagcagattcaaaaatctttttttttttaaaaaacgaagaccgataacgcacctgaaacttgtcagaaaccatatgtcgaagtctttgataatatacaggaccaatgaagatctcacatgtcaattctgtcccataaaatccactgtataaaacttctacaccataatgattaaacccacgggcagttaacattgaaccaagttcattgacaagtgaatcactttcattttctaaggttccgtctggtttcttaaccgagctagaaaaaggtgttgcatccacaaaatttccatgtaatgcacctccctataacaatacaaaccttaagaatttgccgtatataattttacaaaagtaacaggtgatgattactgggtattacaatatacctttgcagcaatagattctaaaagcattgcaattgtcattcttgaaggaaatgcatgaggattaatgataagatcaggccgcattccagtaactcctgaaaagggcatatcaacatcgggccatagttgagagcatacacctttctgtccgtgtctactactaaatttatcaccaattacaggatttctactacgacgtaaacgtatgtttgcctgtaatcaaaaagaaatatgacgttttcacaaacttaagtccattaaattatatgaataatttagaactaagtaccaccttttgtagttgtccttgttttctagcatccacagcaacataatcaactacgacaggttctgaacccttcaacttttgattgaatgaagtacttgtgacttcattatacacactataatacggttcgcctggttttatcctctgaaagtcggtagacagttaacaatataacaaaaaataacacaccaagtacagagaaaaaaaaggtgaaaaaagaacctgcccaacatacgggagcccttctatatcaatgaattcatgtgtcttcttatctaggttgctccttctaaatactttatttgaacgatcagacttgctcctctcatcagccaaatcaatagattcagtctgcaaataacattcataattaagcttcttctgtatttatggttcttttaaatactacaagaatacttacctggtaaatgtgaccatgagcaaagccacgatcaacagatgacttatttaaaaccatggcatcttccatatcatatctgcataatacaagatcaaattaaacaaaactaaaattaacatgaataaaaattcaagttcatatattctacaaaacacttgccctgaataagccaacactgccacaatggcatttgtccctaacggagagtcgtcaatcctatatttttcatatgtagcagtgcgcacaattggggtttgaggggtctgcaaaaccaatttcgaaaaaagaaacatgagcatgtacataaatacagctaaaatttataacaataaatacatttaatcaaaatgatttttggcaaaagcacaattaatcgagaatataataaactgaagaaacctgaaggtggtatagcttttgatctgcacgacaattgattccttgtgaagagaaacccattgtttgttttgccatctacaagttgtaacataagtaaaaaaaaataaaaattgggacagctttgtaaagctgtaaaacaatacaccaactttactctgtaataaagaattacaagataatgacctgacactggtacatatttcttgggctctgattatgatcagaccaaggagtaagattgccaacaacactaagtattcctgttggatgaatttcttcatgagtggcaggaaaatcacttaatctcccaccattgcctccatctggacactctatttccatatagacctacgaatacacattcaaggcaagtattcactattttttgaaacatgatatcaaagcacagggctatattaataagattctttttgtattatgtaaaagtggaaaatcaggtaccaggtcaaaatgggttcaggccaaagggaaaaaataggtgtggggcagaagaagtcgggttgggtcatgctgtgccggcccgccaacactttctggcccatttgttggaaattattgatacattagatagctgatttattagatattattgatatttattatactatttctctaaaaaaaacaatgtacaaatctgtaagcatttatatattgaaataaaatttaacacgttcaatgtgtatcattattatttactttttagtacttaacccaaattcttttcatttaaatgggcaatgccacctccagctgtatgtaaactaaaatattgatagaattacctgttcaaagggaccaatcagttcaatattgttcttctcttcagcaggtaacaacttctgtctaacgggccggacaaatcttgcaggacttgtgaataggtagagaccaggaaacgctccgcccatgctaataggtacatatcccacctccagatcttcaggtatctgtttattatacatagtaagccactgacatcaatatatggaaaggaatgttgaaactgcaaggaagcaaaccgctgaagttgcagatagttttaacttccgtaagtggctgactgctttctcaactctatcattgggcattgcaccaacaactcgcccatcaagtaaaacatgaagaaactcaggagggccagctttcacaagtttcggcaaggaagggatcatggatgcagcaaccaaaacatcaaaaatagacttctgtattcttgaaaaatctctaatttttccttctgaatcataataagaggtaatacctatatttgtttacaaaatcagtaaaaggttatccaaaagcagtaacattttaaataactagaggtggcaaaacaagacagataaggatgattggttaactagtcataacaggttctttagagtgtgggtcgaaaagagtcgggtttggttgaccaaaaacacttctttgttccctaatctcacccgctaagatggcgtaattggcataaatttccatatacatatctatcaatctttccattccaagaaacggtacaaaaagatttgttttttaacttgtgccctcaaggcacatattggtatgcaatcaattaagagatatcattgataatacataaatatgattacaaaatttatatcaatgttttagtacttaaagcataagttaggaaaatccttttctaaataaacaatgtgtcagatatgattgtcaaatttatgattattattgcgctacgatacaacaatgatctattattttacagcaatttaacatattgtatgcaaatacacttacggcatgaggcagtcatatgatttagcagtccacacggagagccatcaggtgtgtggacagggcatacaaaaccccatgacctgtaaacaggtcaaggataaacaaagtaagggagagaaaaacagaatcataaaataatacagagtgtaaagctaacgaatacattcagaaaatataaagcttatacatactctggtaacagcttacgcacacttgtggtgcgaagccctgcaagagatgaacctctatgaacggctctaaaatgtgacaagaaacggagaaagttgagtctttctgcttggactgtcataccagctttctagcaaacaaaatcgccacctcaagttaactcaacaaattaacactttctacatatgacttttaattaaaaccgatgtatatgaatacctcttttaaatcaagagtcgactgtgtaactaatcttccagtttttaacatattttcaaccgctgaaccaacttgttttgccggatttttatccagtgctttcttaatgtcagctactgcaatagttcaaccccaaaagacataaaatgttaggaaataattgtccaccttttaatatgaagaactactaataaagttcgcttctaaatagatgggcaaataacatacagctaccaaactcaaagtttttctttctgttatcagcttcatcttgaagcagtcgtttagctttcagtagccattcttgtaacttttcctgaaaatgagcagaaaacacaaataacacagacactttcattcaactgaatctataaccctcctttttaagcattaatctccagatataaaaggaagataatagaaactgccaaatttgccaagggaatacctttacatatatcgtaaccaagtgacctggcagcaaaacttcctgtgtttgcaatgcatcagggttgtctgggatagaggtttgatcaatgaacgagaaaagcttttggaccatgaagctacataaaaaacatgtcagtacttacaaagacaagaaccaaattatgaaaagatcatattcatatacgtgccaaacaaaattaattgcttacattagaagattaaacttatcatgattgttatcaagatgaactaatataaattctctcaaaacagcatcagcaacctacaaaaataaagatgttgaggtaatgctatatataaacgtgtaatcacaaacaagagaaataaatcaataacagagttgtaactcaaaataacagggagataaatcaatatacaaacacatagaacttacagcatagtgactttccctttccataccatccataaacggcttgaagtactctcctgaataaggtacggatattatgcatctgaattgaaattgactatcagtaaaaagatgaacagatgtggtgacagaataacatataccaatgtactccaaacattgtctgcgggtaaatagagaaaggtctttgacttcattaagaataattttagccctttcacccaaaatctgagtaccaactgaaccttttgcattttcgtatttatcattgtacaccgatgtcaaactcatgaaaatttcatgatcagtagtatctataagggcctgttggaatgaaaaaagaaaaggataacccacacagtaaggatattgttatattagtataactatactttctgcaaaaaaacatgtgcgttgaaataccttcaaaacgaggcctacaggtaacaggttttccctccctcggatcctacacgtgttacaaagtaagaaactaagattagactgctttacttaatacaatagaaaactccactagctcagaatcattactaaccgaaatcccacccttgcactcccattattaatataatacaagttgactgttacagctgattgatcttctctaacacatctgagaaaaaatccaaaaataaccaatcagcaacttttttaatatattcattgctgaatgtaaaaaaccatgagcattgaagtaaaccttatcaccacagctttatctgtgaacccttctcttcgattgcgaaaagcacttctgaccatactagtcggctgcaaatatggacattaatgggtgagaaagtgatcaataggaaaagaagagaaataacaagaagtgggtagcgatttttttggcaaactggaataagtgataggagtaaagaataacctacatagtttctttttggcactactaatagccggacaactctctcaagcccgtttagtatgaagtacctatagcataatgtaaagaaaccacatatggtcatacacgtagcacactgttagctagtgaagtacagagggaaaacaaatatactaattcataatatgaaaataatttgagtgttgtaaagtcaaaacgtcgaaccatcctttagttcagcaaccagctaactaaatacatacatatgaatatatgatatagacaggtaaaattacatacccgcccatttctgatggttcttctttacaagccacgagtctatcgggatcagcacctcttaggtgacaaagttttgactgcaagaggtttcagtaaacccttataatgtcagatgataacgaaacctgagtgccttgaggtatctgaccaatcgattttaataacataataataaaaaagtattcaatgatgacacacttactataccttcaacataataggcaactgcccaaaattgaacttttctctaattacagctccattaggcccatcaccatatttgaagcagacattcactaaaaacttaccagtatacgatgttttagcatgtctacactgtagtttaaaaatacagataaccaataagttcacatgttttcactttttagcaaatgacattgcttaaagatatctattattacacaaattttacctcgacgggataaatatattgttgagtcttagaatttcgttcctttagaggaggatacagctccggtttctcaaaccaaagtataatgtaggtcaagaatcaaacataatataacaagaattcaggcagcatataaaattgcagtataattcaagaaaaagcaagaaacttatacaaaacgtaataaattcaagaaacctcttcatataacaataaattcacaaacttaaaattaacttaagccgattaatctgtaataaaaaaacacaggaaaacgatttcactcagtaaacccataagataattatttagatataaaaacaaaatatgtacatgtcaaaattaaagaattttttttttcttgtttaactaaaaaaaatcaaagattcccgatttcacccgaatctttttcattaaaaaaaatatgttaacatgtcataaagaacaaaactttatagtttaacaaacctaaaaaccctgaaatgtaaaagaatataaccaattttgtacaagaaacaaaacccatgaagcaagttcgaggtaagactgtctacaatgggtatcgtcaaaattaaaaactaatcagcccttaatacaaaaactaaaataaaataaaatacacacatatatataaaataagaaaaggaaggatatttctaaggttcaattgggtgttggaatcaagaacatcaatgggtttgatagacataagtgctttctctaaaccatattcaataaaatgatcaaatgactgaatgtgatgactaaaaagctccctcaaaggctcgtaatccggattgttgggaagatgtggtgtcgttctatgccgccctgaaaccaccgtgcccgaaccacctgatgtttcttgtttcatggttctgaattcaactgcgaaaaagatggggttttttttctatatcttgttcggtggggtttttagggggctggctagggttttaagtaagaaggaaagaaagtacagggtttagtgtttttggactatatatatcgttttgatacatgagtttaatgtattggtattttgactgttaaaaaaaataataatatttgtattggtaatttaggtcccttgattagggctgtaaacgaaccgaatacgaatgaaaccctgttcgtgttcgttcgtttaacttaacgaacggttcaaaaacagattaacaaatataacgacttgttcatgttcattcgtttgtgttcgtgagtatttataaatcatgtacttttatttatacttttttttaaataactaggtattaataatatatattatataaaggtatatatttatatttaaactattttttacaatatagttgattatgtatatatatatatatgtaaacgaacacgaggaactattgttcacgaacgatggttcataaatgaacaaacattcacgaacagattatcgaacgttcactaatgtaaatgaacgaacgagagctttgttcatgttcgttcnnntaactaaacgaacgaacacgaacgaacttcccaccgaacggttcatgaactgttcagttcatttacaaccctacccttgagttgaaacttcgatatctatactcctatatatagtttataataattatcaatccttatttttaaaaagtgttaaaaatagttagatgcaaaagtactaaattactcttaataaatcatcactatagaaagagtttttataaattaccaaatttgactttaactaattaatttacactttgaacatttattataataattaacactttaagctctaaatttctaaaatatttcactctcacctttccatcaacttacaccacttgacggcattgggagttacttttttgtgttggtaacaactagattaatacccgcaaaatatgcagaaaacatatataattaatgacataaatttttataacattataagttgacaaatatataaccatgtaagaattaaaccactaaaaaaacatgaagttacattagtagtcgtttagattttggttaacagtgaccagatagttgaaaaatggatatatcatatatcagaggtctcgctaagtaaggttttcgtttatttggatgtctttcgttcatctaaat

SEQ ID NO: 1025 - DNA, 10009 bp, Cyperus esculentus
aaaattaatctaaaaaatttgttattttccattctttcccatcgttttcaagcatatcaaacaggctctttatagaaatgaagcagtaaagagaaattgaaagcctaaccattaatttgttaatttcaattagggaactgatacatcaaagcaaatacctgatgttattaattatatatgttatatgagttttattgaaaataaatggctttattacccaattcattttgtaatatattattgttgttattatatgtattaacgatatcgatattgaataatcaaaaatagtacaaaataaattatataacataatcattaacatgataactcatttaacaagcaaaaaataaaaaatagcctgtattatttttatttttattttttgtttccctgtcaattagttatatacaatctcacaaaccaagtgcaaagtgcaaaccgccaataaccaatgaggaggatgtattgacaatgcctatcttaacaattttgacaatgagatttttcaaaaattcataaaaaatcattaaaaattcttaaaattaggaaaaaattacaaaagtattgtttaacttatagattaattatgattccgattatattcaatttcagtgacgattagtagctctccaaatacttgttaaattgcaaccgttaaaaaatatatgaaattttgataagtcatcaaacgatgttcaaattgattgagacttgaaacactgttaatatataaattaagcaatgcatccattatttttttatttttaaaattttttatgaatttttttttataaatttttatgagattttccaaaaaaaagttatattatcaaaattgtcaagataaacactctcaattgatcctcgtcataaccaaaatgcttatacaaatggaaacacacaacataccacataagacatcccgtgccataaacatggcttgtttatggtccacaatcccccccttcctacacaaacagatatttcattcctttctttctttctttctttcccttctcttctattaaaaaccagcactgaaccctgtccatacgcaaaacaaactccatcccaccgcaccgagctcatatcctctactgcgcagtaaactactactgcgcagcactcaaccattggatctgctttaagattcgtgcacctcaatcttgaaaaaatccatcctaaatctacatcgttgattctcagcagaggataagcactccaccctctctctatctatctcttccctttctttttttccttttccattttcatttccttttttcatttttttcctccttcctaaaaccctcgtcttctcttcttcgtttctcccatggcgacttcctctctggcgaccaccacactcccgcagttctacactccgtcgtcagggggggagcaggcgcaccggcggtcccaacggcggcggtcgttcgtgtccctccctgcctccgccgccttcactggcgccgcgccctgtctccggctcaatccctctcggcgctcctctaccgttctccagcacaggtccaaactgaaactataactgaaattgaagaggagaggaaaggattgtgttaattagtttactgtgttgttatagtaattgaccctgaatccaagtttcctttctaattaggtttgatcatgtttagtttcctgaaattgttattaagtagctcatatacgtgttatcttacttgtagctggtaatctggatcatgtaggatttcatgttctgttatcaggcacttctgatttgttcctgatttttacaccattttaattttaaattaattaggtttctgtcgaatgccggtagaagaaacagacccggttctataccggtctcaaggttgcatacttcaactggtacaaaaacaggctgtgtttcttgttttaagagccctgtaagagtttctggtgggttgtccaatcttagaaggttctcgcctggagcattctccgacaagtcgatgttccctctacgtagccgactttttggtggcaggctatctgtaagtgcccgcatgaaatagcttgaatttagtatattagttgtaactatatgaaagcagtaattgggtgtcttgtatgtttctaatttaaccactattacagtgctccaggattagtatcttctggtgattagtttggataagtcaattacagatgattgcagttcctatcttttgttcatatatatctatgaatctatcatattatttgaaaaaagaaaaggttgaatgatatcagccactatagcagggagactgctaatgatatttgtttgtctccaagtatctgaaatattctatgagttgtacaaattttctcatccaatacacaatttattctgtttgtttatcctgtacctcctctgaatatttttgaagcttttggcttgcattggtgattcattttgaggtcatttgggtccagccaaaaatgatacttgacaatgtgtattgtagcattacatgccaatctgtaggtggcattggataaaaggggactgtaagggtatgtgcttggttttacatttttgcagcagcatgcaagatatcctatatgttttaggacatgcaatttgacagctgcagctcttagacgaagttctcatttagttttattatttctaacatccttttttttgcaggggaggccttcttatctgacccgcgctagtgttgggcctaatgagcctcatgcagcaagtccggcactctctgacccgctacttgagaaaccaggtttgaattatcttgaccaggaagcagggagagcggagctggagaggttattgagtgctcggcttccaaccaatccaaagttgtacaggggccaattaaagaatggtcttcgttacatcattcttcctaataaaaatccggcaaataggtatgatttgtactggtttgatttagtagagattatataaaatctgttatcgcgaagatccagtgctatggacctgctatttgctatttaaacctttggttgtatggtagaagtccagttctgtagtgcaacttttagtttcaattttagttttccttagaaaattgtggcactttttgaaacatgaatggttaaattacaaaggttaaaattttgtgtgctgatggtgaaactcataaactaaaaattgttgcaaatcaacttgaaataaataattgtttttgagggacttttttcaattgttattcgcttgcaccataggatggtcaatcttttctaaaagaaattaggaatattatttgtgctaaatagatgaaaaatggtcctccatggttcatagtgcatatcctcattcacttctattggagagcgaccaaggctcccccccacccccttctctcgtttatgtaaaataagggggaaaaactgttaggcatgaatttggagccaagacatttcactttccacaaatttgaacatgacattctggccttttgtcggggactacccgtgataacaacaataacaacaacaacacagccttcagtcccaaacaagtttggttgggggatactcatgaaattctttgtataaaaggctgtaccaacttgaaaagaaatgctaaggttttagtaattatgcttaaggtttgaggcacacatggaggtgcatgtggggtcagttgatgaggaggaggacgagcagggaatagctcatatgatagagcatgttactttccttgggagcaaaaagagagagaagcttcttggcactggtgccaggtcaaatgcttatactgacttccaccataccgtttttcacatccactctcccacacattccaaggtactaattaagcgttcctagttacttatccttaatgatgaatactaaaatttcttgttttcgccaagacttcaaaatactggtgaatataattattgttctcttactttctcttgtattgaagaaaatctaacacttttttgttggtaggaatctggtgaatatttgcttccttctgtgcttgatgcattaaatgaggtgcgtctgactctctctctcacttgctgttacctctttggctttttaatttttctttttattttacctagtccctgttacagatgtcctagaattccattatgctgagtgaacattgttgaaccatttgcacaaatacaaggtttttggttaaaaaatatataggcaaggattgtaagattttataaagccttgttaaaacacctttcttatagcaaaattttcttgttataataatagaaggtttgttgtctgggttaatatgtcatcctaaggtatcatctttttgccatatctacaacttgatgaggtgtttagtggtcattactacaaaacaacaagaaagccttttaatcccatgtaaatggaggtaggctagaaatgatccaactagagccatatgaaccataataatattaacactagtattgtgtattgatcattgttttgcatttttggccacattattggcagattgcattccaccccaaatttctgccttctcgtgtggagaaggaaagaaaagctatactttctgaactccaaatgatgaacacaattgaatatcggattgattgtcaggcaagcacctttctcatattttaaatccttgtttttcttatcatgtcatttattaaaatgagaaactctttatagtatgttgtcaaatacataatgtaaccctgcatacctcactatactgtaatagttagtgactacctatggatgtatgctaggttactttctggtgccaaaatgagaagataattttttgttttaagatgtgatgcagcagaaggatgccatttctaatgtaccttggttgaaaaatgaccaatttaaaaaaagaaaataaatatcatcaaagcaattgcagaattcttaagcaggcaagaaacacaagagctcagaagcagctctctgtattccatttgattcaaggacagtgaatggaagaaattaataacatacactacaccagactatattttagccaactgactgtatacttagtattttttatgatagtttactctttagcaaccaaagttgttttgtataattgacttgtttgttttaccgggatacagttgttgcaacatttgcacgctgacaataagctaagtcagcggtttccaattgggctggaggagcagattaagaagtgggacccagagacaatccaacggttccatgagcgctggtattaccctgcaaatgccaccctctacctcgtcggtgacattcccagtgtccctgaagctgttcattacattgaggctgtctttgacagcgacccctcccctccccctccccctccatcttctcactcacccctccagaatcctgtggcaaagctttttggcaacaatttcgttcgtagtgccatggctcccagcttatccaaagagagctctgaaaaatctaaaccactcgaaaataagaatacagtgaagagggagagacagttggttaggccgccagtggaacatgagtggtctttacgtggcgcggctagcacgcctaaaccaccgcagatttttcagcatgagctgatcccgaacttttctctgaacatgtttgccaaggtatccggtaacatttgattttgtctagtgaattaaatgcttataatattttatgaaattgtgatcttttttataattggtgataggttccagtcactaagggatcaacatttcgggatctaagagagatgttgatgaagagaatttttgtttctgctcttcattttcgtatcaataccagatacaaggttattactctaaaaaatgtcatcatgtttgcttttaatattttgtttaagatgaagatttcattatttataatatgtatttacatgatgtagagctcgaatccacaattcacctcgatagacctggaccacagtgattcagcaagagaaggctgtgcagtaaccacccttacaataactgctgaacccaagaactggcgtgatgctattaaagttgctgttcatgaggttctttcttttttttatttgtcttaatattttcctggtatgcatttgtctcttcagaccatgctttctggaaagaaaaacagaatttggaactttttacagaacaagaacatgccccctttgaggtgtaaaaactaaaaaggtggaaataccaatttctttcagtttcaatttgttcaaatttaatctcaaagttgatacttttttacttcataatgttaggtaagaagactcaaagaatttggtgtgacccaaggagagatgacccggtacatggacgctttaatcaaagatagtgagcagctggcttccatgattgataacataccgtcgctggataatttggattttataatggagagtgatgcattaggccataccgtcatggatcaaacacagggttacgagtgcttgattgctgtggctgaaactgtaaccctagaggaggtatgttcctctcgcttttcttaccatggattatctttctgttcacttccttttagccgccttattacagcatatttgcagcattccaatatttgtcttcattatttcctattattaccaggtcaatatggtgggtaaacaactgttggagttcatctcagactatgaccaaccagcggcaccaccacctactgccattgttgcttgtgtcccaaaaaaggtccatgtggatggtgctggcgaaactgactttgtgattacttcagaagaaatcactgatgccatagaagaagggctgcgggaacctatttatccagagccagaggtatttaagaccaactgaactgaaattttagcaacatcaaatctccaaatatgagctgtcagttttttctcttatcgaccattctgtgtgcttgctggtggaacattatttacattgttaattcttttactgttaatgttatttgaatattccataacatttcttgactgacactatctggatgctaaatcaattttcatcatcagtgaagcttccttaatcctttgagactaccattattgatcttgcaaggatgttactattgtaaaccttgaaaatgttcagctccgtgaccaaaataaagctgagtttatgttctacagcattataagttattttctttgtggaattcatttgtgacagcttgaggtgccgacagagcttataaccactgaacagcttgaagagatgaaacttgaacgcaaaccatcgtttgtggcggtaaatgggaaagaaagttccacaaaattgtttgatcaggagactggtatagtgcagcgacgtcttgccaatgggatctccatcaactacaaggttatattgttcattaattaatcttattaaaaataaacaaattatacttcttgttatcttgggacatggtaaagaagtcccatcttgtcagaaaacaggagaagcatccccatatatttggcttttatataagtgttaatcttaactaacttcatgagtgtcggacatatcttgattcatacaatttcctttgattacttcctttcatttggaacctgcaggtactaaagaataatttgttttaaacataagatattcaataggacaagtcttttctcatttctatatgatatagctgcttgtttctatatgtccatcttcttttgaaaaaaaaaaaaaaaattgcaacaaattagtaaaattagtaaaattgagatttgatttcatcggcactaatttggcagtagaacctttggcatgtgatatatcttgttttttcttctttgtactcatgagtattgttgtactgcatttagatcacaccttttgagaagaatgttggtgtcatgcgactcattgtttgtggagggcgggcaactgaaacagctgactcaaaaggttcagttattgtaggagtgcgtgctttaagtgaaggaggctgtgttggcaatttctctagagaacaggtatttttttttgttatctccaactatataggcaaaacctaattttctttttatctcattgttgccctccttgtaaaattaaaatatgatgcatactttaataatgacaattattttatactgctcttaaaaaatgttcttaatctctgaatgtaaccacgtctttatttatttgaaagcatctgtcatatgcatattagtgactgccattttttatgatactgtaaaagaaaaggcaaaaatttgtgatgaaaaaaaagaagtgaatgatacgagtatagacgaagtttgaggaaagatttgtgatgctaatttattgatgggttgttatgggtgcaggtcgagctgttctgtgtgaacaatttgataaactgctcgctagagtgcacagaggagtgtatttatattgaatttaggttttctcttcgtgacaatggcatgcgtgctgcctttcaacttcttcatatggttcttgaggtacttaatttttgacaatgtcctggccaaaattttttgtaggatatgtgtaaagcacaaatagtacttttgcatatctgtaatgttttctatttcaaatgatagcacaatgtgtggttagaggatgcatttgatcgggcaaggcagctatatctgtcattctaccgttccattcctaagagtttagagcggtctacagcccataggctcatgaaggctatgctgaacggtgatgagcgctttgtggaacctactcctgaatctctccagcaactcactgttgaatctgtcaaggatgctgttatgaaccacttctttggggacaatatggaggtgcttatgcaaccatttatatcatttatatagtttaaattataattaattatctatattatctataagactgtataaaacatcgcatgatttatttttattatcgcacttaagttctattttgtctggtgtcactgagaatattataatgacatttggtatgtaaaagacacagtaattggctatctgatgagatcggattggaggatttggaaataaaagaaaatactacagtaaaaattgctttgaacataaatttattggtacatttgtattactaggtttacatttgtatacttcagatagtaatatattaatcatcatttttacaaaataatatacttagaattttcaaatatctctgttctctaattgctctgacctcttaagctataaaatgcagttgagcatagctggagatttctctgaagaggagttagagtcctgtattttggattatttgggtacagttcaagcaaccccaaaatccaacttgaagaacctagatgccattgatccctttgtgttccggcctttcccttctgatcttcactttcagcaagtatgtaccctcccatttactttttcactctctctagatgtgcacgccccttttatacatacatttgtcctaatttgactcttatacatcatccagatacggataaatgatacagatgagagggcctgtgcatatattgctggcccagctcctaatcgctggggatttacatatgatgggaaggacctttttcaagctatcaaggacacctcttcagatggtaattttaaggcttaattttttatgtacccctcaactcttactcaatttcttatttctccctctactctttaacatatcttatttatccttcaagtgttgaaatcaatttcttatttacccctccaatcaactatataaaggtaattttgattatcttataaaaaaaatcatataaacatataaatagacaaaaatatcctcaacattgttgttctaggcttctagccttcttccatgtcttctcttattgctacgcaataaaaaaaatgatccttgcactgactacatttttcgcaaaagaaatgactattttaattgaagtatttcttcatttcggccagcgtaacccgcaagagataatttccggatttttttttcttccaaaatttttttttaatagctccaaacctttaaagcacgttgaaacctctctaatccaaatcttcttggtatagtggcatttcact

SEQ ID NO: 1026 - DNA, 4719 bp, Cyperus esculentus
  unsure (1)..(4719): unsure at all n locations
gggcatataaaaaattaagcctaattttaaatgttgtatttggtgtcattactaatagtgattttatcatagttattacaagggtttgcaattagccaatggctgcaacccagaaaaatgctacttcatcaaaaagtttttgtgtgtgtggtcgttagtcattgccgaaatgcaatgatccatgtgtcaacagaaatagtatagtttccacagatgatgataccagatttgtacttgaaataaatgatgctgtgtagcagcagcagaattttactttaaataattttccgccacatcgataccagaagaacttttctatcttgccttttttttttttttctgctggataaatgatttcgccaacgccacaaaatgtttgtgctccattgttataattgtctctgtgcaattttgatgacacttttttctgatggatccatgcattccaggggaacaatcacaattagctggtggtaatattcgtaaccacccactctttttcggtgtcactttgggcttgcttgcagagatcatcaattctaggtaactggaacctaaaatgctctggttctttaaattcatgaaatttccctattgtttcgttattttgtttacatatttatgcaatattttattcgatgaacaggttgtttacaactgtgagggactctcttggattaacatacgacgtgtcattcgaagtgcacctttttgacaaattaggcctggggtggtatgttatctctgtaacctctactcctgagaaggttcaaaaggctgtagatgcatgcaagggtgtcctcagggggctcgaccacaataaaatttccccacgtgagctcgatcgggtaatgacacttgactaataatcatactcatgggtggattatgttggttatagactaagatattgtaagaatggtgttcattggttgactgttgtttctttcactttgctagaaatgggatcttgttctctgtattatgatgaaaaatatggtttatacattaacacttgagcaatgatccatgtgatattccaataggtcacttttgatgaagcttatataatatacaagaggacacttccataatgttgagtaatcatgcagtgtgttatataacaaaattttcatgatgtaggccaagaggacacttttgatgaagcatatacaagactgcgagtcaaataatgtatactggcttgctctgatggctcatttgcaggctaaatctgttcctcgcaaggtataaatcctccagttctttcttatacctcattgtcacaatggatcatactacaataactataaatttttggtaattccaacttccaagagttagtaactagtcagctgggccacagataaccttgtagtctgcaaggtcctgaattgttgggtctagctcggtgcgttacaaaaaaagatactaggtgctagaccttggcctcttgtatgagaatatcaaatgaatattgctatacagttctgacacaggttggtatgaactgctgacccggacccgatgtgataaacttgggacaagaaagtcctgaatctatccgggtgtctaaccaacatgtcagcccaaatctggcagcatgatagagttctttttggtccgggatcaacatcaaccacatttacatattccccctccatactttatcaatcaatggtggttttatctgactgaatgcgtcatgcaaaaaacaggatgtatcatgtataagggacttgagcactctatatgaaggggcaaccatagatgatgtctacttggcatacaagcatcttggaatagacgaatcctctttgtttgcatgcatcgggatctctggtgccaacgagccttactatgatgtagaagctggtacatttctcaacttgttatatttatctgtgttttaatgttaagttactttttggcacataaattccaaatatcatctactacccaaacagaacatatgatattttgtgcaaatccacgaaacttcgtttgggctacacgactgcatctctgaccaacataacaagtgataaaaaaattgtatcatgtttaactttgagaaagttgtcttcaactgctgagtcatatgatattttgtgcaaatccaaatgaaattagattcaagccaagtgtcatggccttatgggaagttgccatttatgttttagtcgaacatgtctatggagatttcttttatatatatatataggaaaataataaatttgattaggcattgacttaatagttggacgacacacaaatcaacataccaaaaaatgggtatttgtttcacatatgcaattagttatgatgttgcatgttaaaaccgaggtagtcagcatttgatactatgtttgtatttgtgtcctgctgctatgttatcttttcattaatttactgcaaatagtgccacgtcccttatgcacattaacctttttagttctgacttgaatttcatgactgcagaagatgaggtggatattgaacttcatggaacagtaccagctggccgaggtcgatccaccatgacaagacctacaacttaataacttattatgaggtataattttttattgatcatttaggaggatctttttttagcttgttactgaatacatgtaattcttcaaatattatttgtaggttttcattttctttcactaggcagttttgtatattctatttttcccatttaatgtactaaacaataaataatggtaatttattaccaaaaattaaacttgtaaccacttgtttcatgccttgtggccttaaaataatgttccatcccgcttcattaaccacttgaaccatttataaagctttgtaattatttatttattgatagtaggatggtattcttgcaaatatagattcactttgagagtgattattaactatgttggaaaattgtgaacaggaacgtatccttgaaataaacaataagctagctgtatgtttatttcttaattattggtcctcccttcgagtgttggttttattatcgttacttatttttggtgttcagtcatgtcaagctggattcacaaaattagatcataaatttgtatacggatcataataatgaacaagcaaccataggtaccttttaagtttttttttttaaaagaaagaatgaacacacgcacctgtaagttataaaccaattcatatcctctactgtgcaggaaaatactgtgtagcactttaactgttggatatgctnnnnnnntcgtgcaactcaatctcaaaaaggtccccctctaatccacatcgttgaatcgctgtgcagtaaaatactgcgcagcagaggataagcactcagttacaactgtaattactgaacaggcatgaaccataaataaagctcattaacataaatgaattctcattggtatcttggatggattgagatgaaagcactggagctagcaaaacgattcgttcattgattgattattgctgatgtaactttcaggtcctttataacgtgagatagtcccattcattatatcgataggacatactgtgacctccttttcaaatcacttatcaggagttagtttttaacaaggaaataaatgtcccaataacgagatataattcatcaatcgagacaactaaagcgtgtgagaataaattaatggaatgagaccgcgtctgaagactgaagttgaagcagatggttcgttcgtcaatgatgggctccccaagggccccccatctttgtactctgttgcagtagagctaaggatatgaattcagttcgaaattcgaatagtaccatttttgttttcctttcctaataattttaatcaggcgagtacctagattccaagatatattaatattttagcagcccctgcgttgacaattataaaggtacatagggggtgccaattagagttctaaaatatggcacgccatggccaattccgacacggaacggcattgatacgggtggtaacagcacgggtaaagcacgggcacggttacggcacgggtcatgaaccgtgtcgtgtctgagttttgaaaaatttggaactgcacggaatgacacgcatagtgttccagaaacgacacggaacggttgttagacatggcacggtaacggtacgagacacgacagacacggtagaaataacataggtggcacgggtaggaacggataggatacgagtaggcacggataggtcacgggtaggataaggataggacacaggtaataactccgcgtatgtttcaaacatagctggtcccaaagcctgaaaaaaagaggaggggttatttataaaacattatgtaattattaattagaacaattttcatagtacataatactttttaatatttttttatgtattttaaatttttttattctgaattttgaaaaaaaaacaatttaatgatttttttgggttaaattttaatttatttaaactctttatgtttttggaattttttcgagtgggcacgtttagcacggttaggacatgtagatacgacacggtagtcggtaggtcacgtatccgattggacacggcacgaataagtcacggcacgatagacatggtgtatcttacccgtaccatgcctcctccttccaatttttggcacggtacgaaaaaaatattaataaaaaaaaagatatgacacgaaggtaggcgtttctggacacggcacgacacgattttagaactctag

SEQ ID NO: 1027 - DNA, 1082 bp, Digitaria sanguinalis
gcaactcagttatatttgtcatactatcgctctatccccaaaagtttggaacgttctacagctcataagcttatgttagccatgctaaaccacgacgaaaggtttgtagagccgtcaccacattcattgcagaagttgagtcttcagtcagttaaagatgctgtgatgaaccagtttgtgggtggcaatatggaggtcagcattgtcggtgatttcactgaagaagaagtagaatcttgtgttcttgattatcttgggactgtgagggctgcaacttctccaaacacggaggagcgtattgaaaagatttctttccgaccatttccatcagaccttcatttccagcaagtatacataaaggacacagatgagcgggcctgcgcgtatattgcaggccccgcacctaatcgttggggatttgctactggaaatgacctatttaatgtcattcagagatctggtgctgatgaaatatcagaacaagtaaacttggatctaacagggaagaaacgcattgatgttcgcagccaccctcttttctttggcatcactttgagcctgcttgctgaaattatcaattctaggttatttacaacagttcgtgattccatgggattaacatatgatgtttcttttgaattaaacctttttgacaaattggatcttggttggtacgtgatcgcggtcacttcaactccaagcaaggtccataaagccgtagatgcgtgcaaaggtgttctgagaggattacatagtagccgaattgtggagagggaactcgaccgggcgaagaggacgctgttgatgaaacacgaggctgagacgaagacaaatgcctattggcttggtttgctagctcatttacagtcttcatctgtgccaagaaaggatgtatcatgtatcaaggaattaacgacgttatatgaaagcgccacaattgaggatttgtatgttgcatatgagcatctgaaagttgatgattcttctttgtttgcttgcattggaattgctggtgccgaatctggcgaagatatgaatgatgacggggctgatatggatcttgatggcttggctcctatggg

SEQ ID NO: 1028 - DNA, 1567 bp, Digitaria sanguinalis
ctttggagcagcaatctcctgataattttgtgatagactcagacaacagtgagtggcaggagttacaaggatttttaagtgctcaacttccatcccacccaaagttgtttaggggacagctagaaaatggtcttcgttacctcatcttgcccaataaagttccacaaaacagatttgaagctcacatggagatacatgcggggtcaattgacgaggaagaagatgagcaaggcattgcgacatatgattgagcatgttgcattcttggaagtaagaagcgtgaaaaagcttttaagaaccggtgcacgttcaaatgcttacacggattttcatcatacggtttttcatatccactcaccaacttccatgcaggattctgatgaggatctacttccatctgttttggatgctttaaatgagattgctttttacccaaagttcctgacttctcgggttgagaaagaaagacgtgcaatactatcagagctgcaaatgatgaacactattgagtaccgtgttgattgccagttgttgcaacatttacattctgagaataagctgagtaaaagattcccaattggacttgaagaacaaattaagaagtgggatgcagaaaaaattaggaaattccatgaacgatggtacttcccagcaaatgcaactctgtatatcgtgggagatatagataatattccatcgattgttcaccacattgaagctgtttttggacagaagcaagttgacaacgaagctcctgtagcacctaaaactagtgcatttggtgcaatggctaattttcttgttcctaagttcacaggagggatatctgctgactcatcacatgacagatcactttcatcgaaccaatcaaagcttcctaaaaaagaaaggcatgcaattcgccctcctgttgagcataattggtcccttcctgggacacacggaaatctgaagtctcctcagatatttcagcatgaactgcttcaaaacttttcagtcaacatgttctgtaagattccggtgaacaaggtccaaacatatggtgatttgcgtaatgttctcatgaaaagaatattcctttcggctttgcattttcgcatcaactcaagatataagagttccagccctccatttacatcaattgagttggatcatagtgactcaggaagggaaggctgcacagtcactactcttacgtaactgctgaaccccagaattggagaagtgcaatcaaagttgctgttcatgaggtgcggaggctgaaagaatttggtgttacaatgggagaaatgacccgttatatggatgcactaataaaagacagtgagcagctggctatgatgattgacagtgttccctcagtcgacaacttggacttcatcatggagagtgatgcacttggccatactgttatggatcagttgcagggacatgaaagtttgcttgcagttgctgaaactgttacccttgaagaggtcaacactgttggcgcggaagtactggaattcatttcagattttggaaaacccaatgctccccttcctgctgctattgtagcctgtgcccc

SEQ ID NO: 1029 - DNA, 608 bp, Digitaria sanguinalis
ttagtttcactgttttcttttggttcaacatcatcacagatcgttacattgacattatgtcattacaatgctgatgttagttgaaacattagtgtatcattacattgttgttacgttactgattagttgaagcgtcgatgaggcatgcaatatttttattgtcttctagttatgtatttgaaccatagctctcaaaaatcatttagggtttctaatggaatgtgctttcaagacatgttttgttgattgtgtgctgcttctccaggtatacataaaggacacagatgagagagcctgcgcgtatattgcaggccccgcacctaatcgttggggattagctactggaaatgacctatttaatgtcattcagagatctggtgctgatggtaatttcaatttgatatgtgccagacatgtacattgtctcttagttgattcaaatacctttcaagaatcaagttagacctggtttttgcttctattcaaggaacttcctactcatgctagtgattgcatgtatgtctcattagtatattggcttatatttatcgtgctattgctgcagaaatatccgaccaagtaagcttggatctaagagggaagaaaca

SEQ ID NO: 1030 - DNA, 4916 bp, Digitaria sanguinalis
taaggttcgttctcatcaactatcgtgtctcgagtggattgtcagattaggaatcagggtgcttcagggtgctactttagctactttctactttctactttcggattgcgtgagatgagtgctatgaaaaattctagcaccttacttcccttgttagcttttgttaatggtgtgtgagggatgcacggggtgtaccatcagtttggcacactaaatgcatggattggaaattcaactgtttttctgtcctcatcagtcattaatacaacttttgcatggcttttttcaaatggttagtgttccctaattccagaatctatcaaagaaggagtgatcacagttgttttttttcaatgtatggtatgctaatttttgaattattaacttcaaattttgaaccaagcgggaggtcttctgaatatcattgtaaagaagctgacattttgccatgatagtcttccatatctcacatcatcttgatggtacagctcaatcaagttgtactggaagcattatttcatcttgatttgttagaaagatgaatgcatttatcaataaaaaggaaagaaaaaggttgcattgctttgcacagtatagtctgaattatgaacagacatcctcatattgtgtccttttaatagtggtcctgtacaatgtgaaaagccttaatcaattcttctctaactttcaggtcaggtctaatcacatattgcgtgctgctggacctgatgagccacatgttgcaagtccaacatggtctgaaacttcccttgataaacctgatctggatcatggtattagtaaggaggagcttgaagatgttctaaacactccgcttcctgaacatccaaagctaattcggggccagttgaagaatggtcttcggtatcttattttaccaaacaaagttcctgcaaacaggttaggaaactattttttatctcgctcttatttttattattggtggtgacgtacttccataatgttctaccaccagcataaaagtatctttatgattccttcccttccctaacatgatatcatttagtaatgtgggtttcctttcaactggaattttattagatcatttgtatgatgccactttaatttcaatagtgattttagacatttacgattttctttattttttgaatctgtattttgaatatacttgaaagctgacaactataggtttgaatatctaagctagtctgaagtgtttatttgacttatttaaccatcggaacttcttattagtaataaatcgagcagcaaacattatcctgatgtctacttcatgctaaatttttgtgttaactgtgaatcaacctaacattactatgatatatgtggaggatatgtatattatggttttaactacttattttgcaggtttgaggctcacatggaagttcatgttgggtcaattgacgaggaggaggacgagcagggaattgcacatatgattgaacatgttgcatttcttggcagtaaaaagcgtgaaaaacttttaggaactggtgcaaggtctaatgcatatacagacttccaccatacagtgttccatatccactctccaacaaaaacaaaggtctttacttttcagtgttgatttttagttttctttggcaaagttctcaacacccaatctaaactggaagtaaacttatgccaattcgttgaagcccatttttgttttcttgtttagttgtccttccatgcaatatcacatgaaaatggacttaatttttttttgtctatgatatttgcattttttagaactggtgatcctagttagatgtatttccttctagtatttcatgtttacatattggtttgtcttatatttccaggaatatggtgaagacttgctcccttctgtgctagatgcattgaatgaggtaatttgttacttttggagttatcatctgccaaatattaattttggtaaattcttttaccaatatttgaaattggtagcatgtccaatcggtgcctgaaatttttaggtcaatgtttggttctttaacaaattctttttgttgtaatgcaaaacataacaattcttgcgaatttattttccagatagcttttcatccaaaattttcttcatctcgtgttgagaaggagagaagagcaattctttctgagctccagatgatgaacacaattgagtatcgtgttgattgtcaggtaagtgaacttcttcacatcaagaagggccatatccttattgctcctgaaactcatggaaatagattagcatatgacggtaccatcttggcatgctaactgtgatttcgtgtgttgcagttgttgcaacatctgcactcagaaaacaaactgagcaacagatttcctattgggcttgaagagcaaatacacaaatgggatcctgataagatccgcagatttcacgagcgctggtactaccctgctaatgccactttatatctggtgggagaaattgatgatattcccagagccgtgagggaaatagaggtaattagaaattgcataaactttttttttaagaattggcggcctgtaggatcatataacagattaatggtttgacttgttgcaatacaggctgtgtttgaacatactctttcagaaaatgaaggaaaccctgtaccgagtggtagtccatttggcgctatggcaagcctttttgcaccaaagctcccaggtggctttgctgcaaacctaaccggtgaaaaatcacctgtaacagataaaataaagcctataaagagagaaagacaagcagttagaccacctgtagagcataagtggtcccttcctggcgttgctcaggatgccaagcccccagcaatttttcagcatgagttgattcagagtttctcgatcaacatgttctgcaaggtacgcacaagtttcatgtatagaagtcttaagtgatgctcttgtagtcaaatgtattgacaatgtttttccgtagttcctgttaatatattttttgggtgaacaaatcagatcatcttttgtcataattcctgcaagtctgatggtttttgcaccttcattagctgtcatctgacatttaaagaatggtgcttgctgaaaatgaccattttatgacatttgaataggatattttcttaacaatacaataattgctatccctaacgttgttttgcatctgtacagatacctgttagcaaagttcagacctacaaggacctgcggagtgtactcatgaaaaggatatttttgtctgcactacattttcgaatcaatacaagatacaaggtttgtgattattcataagtttatttttttgcctattgcatccaaggtattagcaaaattctcctatttaaacagaagaaacaattcttttatcttggtacaatggaatgaattgtttcctttttggactttatacagagctccaaccctccttttacatctgttgagctggatcatagtgactcaggaagggaaggctgcacagtcactactcttacagtaaccgctgaaccccagaattggagaagtgcaatcaaagttgctgttcacgaggtttttttctaaatttgttacagtttgttgtgttgcgtgtcttgaaatgtgtataatccctctgtttcaaattataggttgttttgtcatatttagatacatagttagtagtatgtatttagacatagtgtatctccaaccttccaagtacatagtaaaatctatgcacctatgaaaactaaaacaacttacaatttgggatgggagggagtacaaagtatttgatggcaaaaacatctttaatggttttaagtctgaactagttcaatactagaataaccccatttgttccgagatcatatgatgcaagtcttggtacttgtacattttcttttgttcagtgcatggtttatgttctttctttgtttttctgcacaaatagtttgattaggaactacagcttttggaagtgaacagaaacaaggattaaaccaagattatgccagcgtgaaccatgcctgggtttacccagtcctagtttatgaacctatgtccaacttggcaccttgtagcctactaattcagcctagtgccagatgtgatacaaacccaatcgctaataataccacggtatgatgcaagcccgatctgggctgaaccccagcctttaccttaagaacatattaaacctgagcggccaagcccaactggtgctgaacctagtccaaaccagagttaaacccaatgacggctaaaccttgttcgaaccagatcaaatccagtcctagatctgtattttgctgaagtgatattaagtattctagagttacttcactgatgtatgtaaacggggtaatggctaccttcgagttttgtctttttgactaattgttgtgctggtcttacattcagattcagctttgcacaaaggaatgcgatttattctgcacaatatttcaccagtgaccacttcataaagtgctttgtccttttaagcaacatttctttgtgctatttcaggtgcggaggctgaaagaatttggtgttacaatgggagaaatgacccgttatatggatgcactaataaaagatagtgagcagctggctatgatgattgacagtgttccctcagtcgacaacttggacttcatcatggagagtgatgcacttggccatactgttatggatcagttgcagggacatgaaagtttgcttgcagttgctgaaactgttacccttgaagaggtacaattatttctttgtacaaactgcagtgggaattgatggcctcactccatttcacccccttctctgagaaaaaaaaaagaaccacttttttaatgagaatatatctgtttaccatttgtaggtcaacactgttggcgcagaagtactggaattcctttcagattttggaaaacccaatg

SEQ ID NO: 1031 - DNA, 2085 bp, Digitaria sanguinalis
aatattttctccaggtcagcattgtcggtgatttcactgaagaagaagtagaatcttgtgttcttgattatcttgggactgtgagggctgcaacttctccgaacacagaggagcgcattgaaaagatttccttccgaccatttccatcagatcttcatttccagcaagtatgaagtctcctgtgtcatctgttctcataattgtttctatttttaaactgaaaattgtttttagtttcactgttttcttttggtcgtcgtcatcatcttcatcatcatcatcatcattattattattattatactgatgttagttgaatcattaatgtatcactacattcattacgatactgattagttgaagcgttgatgaggcatgcaatatttttattgtcttctagttatgtgtttgaaccacagctctaaaaaatcatttagggtttttaatgcaatgtgcatttaagacatcttttgttgattatgcgctgcttctccaggtatacataaaggacacagatgagagagcctgcgcgtatattgcaggacccgcacctaatcgttggggattagctactggaaatgacctatttaatgtcattcagagatctggtgctgatggtaatttcaatttgatatgtgctagacttgtactttgtctcttatttgattcaatcaaataccttacaagttacacctggtttttgcttctcttcaaggaacttcctactcatgctagtgattgcatgtatttcttattagtatttgggcttatatttatcgtgctattgctgcagaaatatctgaacaagtaaacttggatctaacagggaagaaacacattgatgttcgcagccaccctcttttctttggcatcactttgagcctgcttgctgaaattatcaattctaggtaaatgctttctatatgatttttctgtgtagattattacaaagcttctagacatgacaaaggccatagtttgcacatcatcatgctgtggcttggtacgtaataaacctgaatttgtccctataaattgaatatgccagcctcacattataggtagtgttcatggtgatggatagttttgttgtttcttttagggaaagttttgttgggtatttagctggctggcctaacgtaatgtgctgcactgttatgttgccaggctatttacaacagttcgggattccatgggattaacatatgatgtttcttttgaattaaacctttttgacaaattggatcttggttggtatgtgatcgcggtcacttcaactccaagcaaggtattttacttaatcccatgcagttcaagtattctgtgtgcttcctttgatattatcttaccatctttaattccaggtccataaagctgtagatgcgtgcaaaggtgttttgagaggattacatagtagccgaattgtggagagggaactcgaccgggttagttgaactttgcaagtttctcattctgtagcccacatcacagagcctgtatgtgtaggataagctgcttatggatctatagtgtgaatcagtataatatgatcacattttggcatattaatttacatgtggctttctaaatactgttgggttgaatccaccccttttagctgaatgtatctcatcaataagatgcaccattttgctgtataatgtattgactttaaaaacacacttttgtgatccgaaatgcataattttcaggcgaagaggacactgttgatgaaacacgaggctgagacgaagaccaatgcctattggcttggtttgctagctcatctacagtcttcatctgtaccaagaaaggcaagtcatttattgtttacccttagctcaattttcgtgttttttgttttttggttgcttatgctggtttattgtcttagtatcattcatgcgctccaaatccatgcaggatgtatcatgtatcaaggaattaacgacgttatatgaaagcgccacaattgaggatttgtatcttgcatatgagcatctgaaagttgacgattcttctttgtttgcttgcattggaattgctggtgccgaatctggtgaagatatgaatggtaataagcta

SEQ ID NO: 1032 - DNA, 479 bp, Digitaria sanguinalis
aataatatgtgtttaccatttgtatctgtgaaaaaaagaaccactatttttatgataataatatgtgtttaccatttgtaggtcaacactgttggcgcggaagtactggaattcatttcagattttggaaaacccaatgctccccttcctgctgctattgtagcctgtgtccccaaaaaggtgcacattgatggtgtaggtgaaactgattttgaaatatatccagatgaaatcactgagtctatcaaggcaggtcttgacgaacctatctacccggagcctgaggtatgtggtttgttttcatttgtcttggttcctgttaaagcaatttattgggtcaactcagttcaaaagagttttagtttcttttagcacctctgtgaaaactggaaacttcaaagaagcacgtggtgtactggtgctctgtgctgttaattgactgcttttattcctgtcagcttgaggtgccaaaggaatta

SEQ ID NO: 1033 - DNA, 1773 bp, Echinochloa colona
ttttcttcatctcgtgttgagaaggagagaagagcaattctttctgagctccagatgatgaacacaattgagtatcgtgttgattgtcagttattgcaacatctgcactcagaaaacaaactgagcaacagatttcctattggacttgaagagcagatacataaatgggatcctgataagatccgcagatttcacgagcgctggtactaccctgctaatgccactttatatctggtgggagaaattgatgatattcccagagctgtgcgggaaatagaggctgtatttgaacataccctttcagaaaatgaaggaaaccctgtttcgagcggtagtccatttggcgctatggcaagcctttttgcaccaaagctcccaggtggatttgctgcaaacctaactggtgaaaaatcacctgtcatggataaaataaagcctgtaaagagggaaagacaagcagttagaccacctgtagagcataagtggtcccttcctggagttgctcaggatgccaagcccccagcaatttttcagcatgagttgattcagagtttctctatcaacatgttctgtaagatacctgtgagcaaagttcagacctacaaggacctgcgtagtgtcctcatgaaaaggatatttttgtctgccctacattttcgaatcaatacaagatacaagagttcaaaccccctttacagtccgttgagctggatcacagtgactctggaagggaagggtgcacagtcactactcttacagtaactgctgaaccccagaactggaaaagtgcaatcaaagttgctgttcacgaggtgcggaggctgaaagaatttggtgttacaatgggagaaatgacccgttacatggatgcactataaaagatagtgaacagctggctatgatgattgacagtgttccctcagtcgacaacttggacttcattatggagagtgatgcacttagccatactgttatggatcaattgcagggacatgaaagtttgcttgcagttgctgaaactgttacccttgaagaggtcaacactgttggtgcggaagtactggaattcatatcggattttggaaaacccaatgctccccttcctgctgctattgtggcctgtgtccccaaaaaggtgcatgttgatggcgtaggtgaaactgattttgagatatatccggacgaaatcactgaggctatcaaggcaggccttgatgaaccaatttacccagagcctgagcttgaggtgccaaaggaattgattactcaatcggagctcaatgaactgaaattgcaacacaaaccatcatttgttcctttaaccgatgaagagaatgtggtgaaagtatttgacactgaaactggtatagcacaacgccgtctttctaatggaatttccatcaactacaagatcacgcaaaatgaagcaagggttggtgtcatgcggctgatagtaggcggagggagagcaacagaagattctgaatcaaagggatctgtcattgttggtgttcgtaccctgagtgaaggcggttgtgttggcaacttttcaagggaacaggttgagcttttctgcgtgaataatcttatcaactgctctctggaatccaatgaggaattcatatttatggaatttagatttgctttgagagacaatggcatgcgtgctgctttccaactcctccatatggtccttgagcataatgtgtggctcgaagatgcatttgatagagcaactcagttatatctgtcttactaccgctctatcccaaa

SEQ ID NO: 1034 - DNA, 475 bp, Echinochloa colona
gtgagggctgagagttctccaaacacagaggagcgtattgaaaagatttccttccgaccatttccatcagatctgcatttccagcaagtatacataaaggacacagacgagagagcctgtgcatatatcgcaggccctgcacctaatcgttggggattcgctactgaaggaaatgacctatttaatgtcattcggagatctggtgatgatgcagaaatatctgtaccagtaaactcggatctaacagggaagaaatacattgatgttcgcagccaccctcttttcttcgggatcactttgagtctgcttgctgaaattatcaattctaggctatttacaacagttcgagattccatgggattaacatatgatgtttcttttgaattaaaccttttcgacaaattggatcttggttggtatgtgatcgcggtcacttcaactccgagcaaggtacataaagctgttgatgcatgcc

SEQ ID NO: 1035 - DNA, 3710 bp, Echinochloa crus-galli
gcaggcgtggccggtcggggctcgcgaggttcgcgccgtgcgcgctcccgcacgcgtcggggctttcgtttcgcagccgcttgaccggggctaaggtcaggcctagtcatatattacatgctgctggacctgatgagccacatgttgcaagtccaacatggtctgaaacttcacttgataaacctgatctggatcatgctattagtaaggaggagcttgaagatgttcttaacactccgctacctgaacacccaaagctaattcgaggccaattgaagaatggccttcgatatcttattttaccaaacaaagttcctgcagacaggtttgaggctcacatggaagttcatgttggatcaattgatgaggaggaagacgagcagggaattgcacatatgattgaacatgttgcatttctcggcagtaaaaaacgtgaaaaacttttgggaactggtgcaaggtctaatgcatatactgatttccatcatacagtgttccatatccactctccaactaaaacaaaggaatatggtgaagacttactcccatctgtgctggatgcattgaatgagatagcttttcatccaaagttttcttcatctcgtgttgagaaggagagaagagcaattctttctgagctccagatgatgaacacaattgagtatcgtgttgattgtcagttattgcaacatctgcactcagaaaacaaactgagcaacagatttcctattggacttgaagagcagatacataaatgggatcctgataagatccgcagatttcacgagcgctggtactaccctgctaatgccactttatatctggtgggagaaattgatgatattcccagagctgtgcgggaaatagaggctgtatttgaacataccctttcagaaaatgaaggaaaccctgtttcgagcggtagtccatttggcgctatggcaagcctttttgcaccaaagctcccaggtggatttgctgcaaacctaactggtgaaaaatcacctgtcatggataaaataaagcctgtaaagagggaaagacaagcagttagaccacctgtagagcataggtggtcccttcctggagttgctcaggatgccaagcccccagcaatttttcagcatgagttgattcagagtttctctatcaacatgttctgtaagatacctgttagcaaagttcagacctacaaggacctgcgtagtgtcctcatgaaaaggatatttttgtctgccctacattttcgaatcaatacaagatacaagagttcaaaccccccttttacgtccgttgagctggatcacagtgactctggaagggaagggtgcacagtcactactcttacagtaactgctgaaccccagaactggaagagtgcaatcaaagttgctgttcacgaggtgcggaggctgaaagaatttggtgttacaatgggagaaatgacccgttacatggatgcactgataaaagatagtgaacagctggctatgatgattgacagtgttccctcagtcgacaacttggatttcattatggagagtgatgcacttggccatactgttatggatcaattgcagggacatgaaagtttgcttgcagttgctgaaactgttaccctcgaagaggtcaacactgttggtgcggaagtactggaattcatatcggattttggaaaacccaatgctccccttcctgctgctattgtggcctgtgtccccaaaaaggtgcatgttgatggcgtaggtgaaactgattttgagatatatccggacgaaatcactgaggctatcaaggcaggccttgatgaacctatttaccccgagcctgagcttgaggtgccaaaggaattgattactcaatcggagctcaatgaactgaaattgcaacataaaccatcatttgttcctttaaccgatgaagagaatgtggtgaaagtatttgacactgaaactggtatagcacaacgccgtctttctaatggaatttccatcaactacaagatcacgcaaaatgaagcaagggttggtgtcatgcggctgatagtaggcggagggagagcaacagaagattctgaatcaaagggatctgtcattgttggcgttcgtaccctgagtgaaggtggttgtgttggcaacttttcaagggaacaggttgagcttttctgcgtgaataatcttatcaactgctctctggaatccaatgaggaattcatatttatggaatttagatttgctttgagagacaatggcatgcgtgctgctttccaactcctccatatggtccttgagcataatgtgtggctcgaagatgcatttgatagagcaactcagttatatctgtcttactaccgctctatcccaaaaagtttggaacgttctacagctcataagcttatgttagccatgctgaaccatgacgaaaggtttgtagagccgtcaccacattcattgcagaagttgactcttcagtcagttaaagatgctgtgatgaaccagtttgtgggtggcaacatggaggttagcattgttggtgatttcactgaagaagaagtagagtcttgtgttcttgattatcttggaactgtgagggctgagagttctccaaacacagaggagcgtattgaaaagatttccttccgaccatttccatcagatctgcatttccagcaagtatacataaaggacacagacgagagagcctgtgcatatatcgcaggccctgcacctaatcgttggggattcgctactgaaggaaatgacctatttaacgtcattcggagatctggtgatgatgcagaaatatctgtaccagtaaactcggatctaacagggaagaaacacattgatgttcgcagccaccctcttttcttcggcatcactttgagtctgcttgctgaaattatcaattctaggctatttacaacagttcgagattccatgggattaacatatgatgtttcttttgaattaaacctttttgacaaattggatcttggttggtatgtgatcgcggtcacttcaactccgagcaaggtacataaagctgttgatgcatgcaaaggtgttctgagaggattacatagtagccgaattgtggaaagggagctcgatcgggcaaagaggacactgttgatgaaacacgaggctgagacgaagacaaatgcctattggcttggtttgctagcccatctacagtcttcatctgtgccaagaaaggatgtatcatgcatcaaggaattgacgaccttgtatgaaagcgccacaattgaggatttatatcttgcatatgagcatctgaaagttgacgattcttctttgtttgcttgcattggaattgctggcgccgaatctggtgaagatacgaatgatgatgaggctgatatggatcttcctggcatggctcccatgggaggccggggtctttcaacaatgaccagaccgacgacatgatcaccgttggagcgccaacccttccaaggtgcgacttaatgctccatgttgctcagccagacaaaacttgacctaaccagaaatggctgttttgcttactacaggcatcaaccttgctcctgaagagaggagccacatggccctaggagactactccctcagtcccaaaataagtgttcttttagaaaatttaagacagattactagttatgaaaattgacctattgtttattcccttaattggaattagaaaagtag

SEQ ID NO: 1036 - DNA, 604 bp, Euphorbia heterophylla
gctgctcccttaatcgccgactggggaaccctaggatcagaagttctgtaccagtggccttctttgacaaatctagttttaattctccggggcgatcacttgttgcttattcggcgaagcacgtacatgttccttgtgcatctgtgggtccaaatgagccacatgctgctagtacagcttgcccagatggtattgtcgagaggcaggattccgatttattgtataccgaattagaaagaacaagaatagctgaatatttggacaatggacttccatctcacccgaggttgtacagagggcaattgaaaaatgggctgcgctatctgatattaccaaataaagttccaccaaacaggtttgaagcacacatggaagttcatgcagggtccatagacgaggaagaggatgaacaaggaattgcacacatgattgaacatgttgcatttcttggaagcaaaaaacgtgagaaacttcttggcactggggctagatcaaatgcatacactgattttcaccatactgtattccatatccattcaccaactacaacaaagggttctaatactgatctacttccatcggtattggatgctttgaatgagat

SEQ ID NO: 1037 - DNA, 1832 bp, Euphorbia heterophylla
tgaatctcgtggaggtgtaatgcgacttatagttggcggaggacgagctgctgaaagtgcagagtcaaagggagctgttattgtaggtgttcgaactcttagtgagggaggccgtgtgggtaacttttctagggagcaggtcgaacttttttgtgtgaatcacttgataaattgctctttggagtcaacagaggaatttatatgtatggagttccgttttactttaagagacaatggcatgcgagcagcatttgaactacttcatatggtgcttgagcatagtgtctggctggaagatgcatttgatagagcaaagcagttatatttgtcatactatcggtctattcccaaaagtttggaacgcgcaactgctcacaaactaatgacagctatgttgaatggagatgagcggtttgttgaaccaacaccacaatcattacaaaatttaacattgaaatctgtgaaagatgcagtgatgaatcagtttgtgagtggaaacatggaggttagcattgttggggacttctctgagcaggagatcgagtcttgcattattgactatcttggcactgttagtgcaagaaaagattccaaggaaaacgggaaatggttcctgtcttgtttagaccttccccatctgatttgcagtttcaacaagtctttttgaaagatacagatgaaagagcatgtgcatacattgctggtcctgcaccaaaccgttggggttttacggttgatgggaaagatctgttcaagtcaatttctgactttccaactacagatacacaaccaaatgaggaacagctgataaatgggagcgatactgtgaaagatgggcaaagaaaactacgcagtcatccgcttttcttcggagtaactatggggctgctggctgagattataaattcaagactgtttactaccgtcagagattctcttggattaacatatgatgtatcgttcgagttaagcctcttcgacagactaaaccttgggtggtatgtagtatctgtaacatcaactccagggaaggtttataaagctgttgatgcgtgcaaggcggttctaagagggctgcacagcaacaaaattgtccaaagggagttggacagggcaaaacgaactcttctgatgagacatgaggctgagattaaatcaaatgcttactggctcggattgcttgctcacttgcaagcatcttcggttcaaaggaaggatatttcttgcattaaagatcttacgtcactttacgatgctgccactattgaggacatataccttgcttatgaacaattaaaggtcgacgaaaattcgctgtattcatgcatcggggttgcaggcaatcatgctggcgatgagaacgttgtgcccatacaagcggaagcagaagaagaagaatcaaatgacggcttacaaggagttattcctacggggcgtggtttatccaccatgacaaggcctacatcttgatttttcgtgaccatctactccgtgtttgtagaacggagtactaaaagagcagaataatccaactttagaaatgaaacactattgaagcagaatggtttgattctcccattacaatatatatctgaaaggtatagtcgaatcatatatatatagatccttcaaataaggtcattttcattgctaacgttaaataagtgtatatgtaaccatttattttatccatgaaatcacaagcatttggttccatattgtatatcaaattttgtgtaccttgatatgtaatttactaatttattttactgtactcgaaatttattgataacaatcttgcttatttctttggtactttctatagattatat

SEQ ID NO: 1038 - DNA, 375 bp, Euphorbia heterophylla
tgccagttattacaacatctacattctgaaaataagttgagcaaaaggttccctattggattagaagaacaaattaagaagtgggatgcagataaaattaggaaattccatgaacggtggtacttcccagctaattcaaccttgtacattgttggtgacattgacgacatcgcaaagacggtccaccagattgaagctgtctttgggcaaactggcattgaaaatgagacatctcctccacctactcctagtgcatttggagcgatggctagctttttagttcctaagctctcagggctttctggaggttcctctgcagaaaaattatcgggttcagatcaatataaaatcttgaaaaaggagaggcatgcagtt

SEQ ID NO: 1039 - DNA, 1695 bp, Euphorbia heterophylla
gcaagttcaaggggttattaggatttttttttgcaagttcaaggggttatttggaacattaaaaagttcaggggataaatgggcgtttatggagaagttaagggggcattgatgtattaggctttattattataattataattttcttacaaactaaaaaaaactaaaaatgaaataaaaaaagcaaaaagtaatatttttaaaatggattcgtaaaatggaattttcccatttggggaatggttgaatgaagtgtggtgtggtgcagtgcccatacaagcggaagcagaagaagaagaatcaaatgacggcttacaaggagttattcctacggggcgtggtttatccaccatgacaaggcctacatcttgatttttcgtgaccatctactccgtgtttgtaggtacaaattttactttgttcttgatttttttttaacaaactatagtaaagtagaaaacactccatagaacgttatctgtgttaggattcttattgtgtgttgaagttagtcaataggtgatacttgtatctattgattggtcatagcagaatgccaacccagtacttcgagaatcggagcagaaccttatcttagtacctttttaaaaaggcgttacattcacgacctttttgtgccgttgctttcatatgattcttaaattcggtttattaggtgtgtcgaaaccactgcattttgcagtataagacattaagtttgcatattgattaaggctctgccctcattgcctaggcatatgccacgcatatgccttaatgcgctctaggctcgaggtactataggtgcgcctgacacctattttagtttttttaaataaatgtaatgatattggtaagtttagattttatgaaagagtataaattagaaaagaaaatatttaattctagaagtagagaagttgggaaatgaaatatagaaattaggaaatgaggaaattatgacaaaaataattgaaattaggaagaaaggaaagactgatattaatttcaaaacaattgattgttgataatcagctacttaactactaatgagactgttaaataaatatttaggtctctatattatttctaaatacaacacgtacatgtataacaaacttttggtactcgtaattaattattctagattgctaggcaaaatgcttatacattttatctatttttttttgagtgagattatatgttgacaaaagtcgaataattgtttttgtagaacggagtactaaaagagcagaataatccaactttagaaatgaaacactattgaagcagaatggtttggttctcccattacaatatatatctgaaaggtatagtcgaatcatatatatagatccttcaaataaggtcattttcattgctaacgttaaataagtgtatatgtaaccatttattttatccatgaaatcacaagcatttggttccatattgtatatcaaattttgtgtaccctgatatgtaatttactaatttattttactgtactaaaaaatttattgataacaatcttgcttatttctttggactttctatagaatatatgcctttcagaattttttcaagcaaaaccccccccttaacttggcttcaaaagttagatgccacccccaacttataaaaggtccaattaaccccctcaatttgacaaagtgaaccaattaaccctataaagct

SEQ ID NO: 1040 - DNA, 3236 bp, Euphorbia heterophylla
  unsure (1)..(3236): unsure at all n locations
tctaggatcacagtctcaaggctctgcnnntagaccaagcctttgccacattactacattactttctgtcttaatttgtcatgggttgaagacttactaaatactagaaagtaagtctagggagggagtcctaagattacacggggaaaccattttagaagacatgtgcttatttgacattgatgaacgaatgacgttgagtagagtttcatggcatcggatctgtatacataacttgtgagattagggcatagctgttgctgttggaaactacttctgttgcttctatatgttcgcaatgtttttatcaaaaattagtgctgtgtacacaaggtttctcttatagttatgaatactctaactatgtgtggtggaaatataatgattagtgacatcttggatgccttaactgttatttgaacttttttcagctacaagtcaataagctggaaatcatattgttctgctatttgaaactagtaatgagagaattaattgatgaaaaacttgtttcttatcctttgctggaacttggcggatctgaggaagtaatcctaatgagccttgctggtctaaaagacttgctgattgcagtgcatgatttcagggaaatataacttgtcaattaggcattattagggaaaattggttcgaagataattggtgttcccagagaactttttgaataaagaaaatgataaacataggatgatctcttagtggctgttgttttcaaattgttttaccctaattttaacctgaaatgattcccaatatagttaggaatgcaaaacagattcttgttaggctacgattcccggtaatcaatagatttacaaatgatttatatgtgaatggcatgcatcagaacggcagatttttcacagctggagcctgaaacagatttgctcctctgtgacatatcctttgaaatctttctaagttttgcaactacaaatatattttccaaagccaattgcaaccttcactttctatttttcaggcgaagcacgtacatgttccttgtgcatctgtgggtccaaatgaaccacatgctgctagtacagcttgcccagatggtattgtcgagaggcaggattccgatttattgtataccgaattagaaagaacaagaatagctgaatatttggacaatggacttccatctcacccgaggttgtacagagggcaattgaaaaatgggctgcgctatctgatattaccaaataaagttccaccaaacaggtgaacggaaccttatttgcttattgtaaagaatagaaaatggtgcatgcatttttaattggaattgttctaataaataggatcattttatggtgaaaactagatgctttatgcatgtgtcaattagtggaactgttaatagatgcaatctgttctcattgttcttgcatatacccaaagcctgattgatgctgttttaaagatcttacaatgacagtttagaatagtaactgtgaaacacttgataaaaccttggtaatgaatttagttattatcctctaaaatattccatagttctttgagcgtgcaaacagaatattagtttccaaaagaaaactgctctaaacagtgaagaaataggaagctggaaattttttttgaagacaaaatggaaaagggaaatctgtctcctttgatggactaaacaatcaaccagcaaccagcttcataagagctaaaaataagagaaaaagcacgaaacttgataggtaaaaagaaaataaatggaagagtgttcatttttagaaattgaaatttttatttcatgtcgttttaccctttttagtttcaaagtcgctttgggttagcatgaaggatggcgcttatcacctcagacaagttgatgtatcattgcctttagagtgcctagttcttttagcaacactgatgtattgtggtgtagactcttgactggcaatttttgaaatgtgacctgttattgcgatgcatctacttcacaaacaaggcattttaaaagagacatccttgtgtggctttaggtgtaagacgcaaaaggcatgggctgaggaaaaatgttttaaacttaattctactgcatccctgtgatatatttggaatatagcaataaaatattattctgctactgcatatcattatttaataggaattggaaattaagcagataaaattagaatgcagctttagtaaattatgaatttgttacactaggtataaaggaaaacatcgaactactgcatttaacttatcatatgaaatacaaactgcatgttgcagattttacatttaacagtcatgtaaaacggttttaaactcctaatgtttgtgagatttttcattgttgtatttgtacaagttcagacttttagcttgcgaaatgtcaatataaaaaaaggaaagaagagcaagtacttgacatgtttaagaccatgacgtgcagaatcttaattccaaattttctctctttttgccaagcatcatggataattgtgcgggatcactgatttagaagatgatggaagtaaaccaaatccttgngagggccttgaatttataactaatctgaagaaatgacaatcacattgttatgataccaaacgagtattgactgacttgcacttcagttcaccaaatgatattagcgtttctcatttttagtgtgcaactagtgagactcaatatgggaaaatgatacgttatttaatttggtggataagcaactattgaaatttttgccacttaaatttatcaagggggaacatagttgttacgggggcacctctggcgcacaacactcgaggctcaatgcctaaatgaaggcttgtttgtggtagcaactaagatttattgcactttttctctatgcgcctagagtccctcgggcgcgcgcctcaccttgtgccttgcgtcttggtgcgcctgaccctctgaagcctcagtgcgccttgcgcccgaaaaaactatgagttggaagcaatggattgatgtatacggttatctttttgaagaagatgcatattttagtgtcatgtggggtcctttggtctctatcttgatgattgttgcttatggacaataaaatgttctgtttttaggtttgaagcacacatggaagttcatgcagggtccatagacgaggaagaggatgaacaaggaattgcacacatgattgaacatgttgcatttcttggaagcaaaaaacgtgagaaacttcttggcactggggctagatc

SEQ ID NO: 1041 - DNA, 1526 bp, Euphorbia heterophylla
ataaaataataaaaattaatttccctaaaattagattttccatatttgaggaaccttgtcctaaaaatataacatttaaaaaatagttggaaataactattcttcaaatgtgtatcccattttggagaaatataattggaagagccgtaataagaagtatgtaatgagtacgagctctattagagcatctccaataaaatttctattcaattattcttcttgacacatgagtaaaattggacattgaaataaaaaacactctccaatagatcttttaattagtctttctagtatgaagtgtcatttaaattttagacattgtctatttgatcttccacaaatatacaatcaaatagaagattaaataataaattttaataattagaggttatctaatgagttatttaatttttgctattgtttttattttgaaaaaaatatcactactaattaaatagacaagctattgtaattaaaatttaaaatttctaatctattttgacatttcattaatttaaatttatattttacataatacatcaacttagaatccataatttattgtggatgcttatggcaaaagaagcacaatttccatccacgtcagacggggaggaaaaaaattaattccaccacaaaaaataaataaaaacaaaaaatataaataacgaaaacgctgaaggcggccaggcgatgcaggggcgttgatatttttctcttgctaaccagaaaacagagggcaacacaaagcgataactgcccgaaacagctcgaataaggtattatcttttcatcttcttcttccttttcttcgattctgctgctagtttttgttcctgttgaatctcaattgttttcttattaatcgattgtaatttggtagagtaatggctgccaatttaaacgccgcccctagttcttctttgttaatgagcctcccgcaaatccgttcttgtttaactccgagagacgatgctcatccaagaagctgccgactcagttctactcagccgcggcgttcttcaaggctttctactccttcagctcgattccatctagttcctcaaccgattttaatccagaacaagtatgtgtgtttactcgcttctgctgtttagtgtgattttcatggcctcttagttgttgttttgtgttgctttggtaattgactctctaggtggcctcatggaggatcgttctctggcaaaaagaagcaaaacgcttggaaacgtaggggttttctgtttgatgatcgagtggctggtggttctgtttcggtgcctaatttctgcatttcttgctgctcccttaatcgccgactggggaaccctaggatcagaagttctgtaccagtggccttctttgacaaatctagttttaattctccggggcgatcacttgttgcttattcggttagtattccccatcaattttcttgtcttgtttgcttaatttggaattttggggggctcattactttctgtcttttttttttcttttcttaaaaaacccttatcccaccccgc

SEQ ID NO: 1042 - DNA, 5208 bp, Euphorbia heterophylla
gggcctcacctatcagcttaagcttttgggagagttggttccatgacaaagataaattttagttatagcagcaacaatagtatttgagttatatttcaaaactataccttcaaagtttgtgaagaaaaaatattggatgggcatttcttatgttgttgcgtctgtacaggagactcaataagttttcaatgcaatatgggtaaaacacataatgaacacagaacaccatactattgtgcaactgcctctttgaatgacagaggtgaaaagttctaaaagaacttgccgatgtacattggaccatagttgttgcgtgcagacagaaaatagtgtattaaactattaattactaccattaacaaacctagagtgcaataaatagtaaaagaacatgctaaattacactcaaatctcactaattaaaatcacacttaatctaactaaccatattcaaacccttttatatgcaaaatccagataataagtccaatcaaattacaaaagtttccaaatagtacttttgattttgattgtggactccatagataagggaaaacatacaatcaaactcaattctctaattgctaatcactatcagcgcaaatttcatatcgaacatttcattctcttcgtctttataatcatccccttcgtcatcatttagagagaatgaaacaacattttcaacactagataatactactttatcatttccctttactccttcaccactagacgcaatgatgaaattgtgatttgagtgggttgatttctttacttatcgttaagaaatattgtatttgatgaaatagatattgcttctttagttttgtttttctttgtcttttactaatatgttcttctattatgatggtcaatagcatatgtgacacagtggtaaattagtttttaaaaaaatctctttttgcattgaggcttccccaaggtgctaaggcactaggcgcgaggtgcaactaggcgtatgcctgatgaaccacgcctcacctgaccctccatgaggcgctggcccttgtgcttcgagcatgcattggtcggatgtgaagtgtcttcattgaattcttgaagcattacaagaaaaactctttaaaaattagttgtgaaatttataattcaccattagcaaggaagaactcatttcttggtgagagacatgttctcacttctcagcataaagcatatctcacgatataaaactacaaaaggttctagttacttgtatatgccttcaaacatgtctcatgtggatagtgttgattttattactcaaatattatcaaaataccgtcaatcttgtgctgctaaccttctctgaattattttaaggttacagccggtcaaatgagttactactgtagtataaattgagaagtattagcaaggaagaactcatttcttcattgcttcatgcatataggtgctctgttaaaaaaaccaatactgtcatattcttcaaaataaaataaaataaaattttgagaaatgcagctttaagagtatatcttgtgtacggtgatatggaatatgcgcttgctttggttataaaattatagctacccctttctgtatgtagtataaataattatatgaagttgaatatttgtgacaattacatgtttaatgacattttcagtttgacatttctaatacaatataaaaaaagtattactctcttctgaaatatgtcggaatatctcctgctttacagatttcaaagagtgaatctcgtggaggtgtaatgcgacttatagttggcggaggacgagctgctgaaagtgcagagtcaaagggagctgttattgtaggtgttcgaactcttagtgagggaggccgtgtgggtaacttttctagggagcaggtaaagaaacactctttttcagctctattgttactgcctgtgttcatgattatgagcaaaataatagttgttggtgctatcttgtaagctaaaatagttcttttatcatcattatatgtgactgtattttaagaaggtaccttgcatgattgaccattgtacactgcctggccatcaagctgagttgcgaactgaagtgatatgaaaaaaatattgaaatgaattgttcagtcactcacaactcttttcctgcatgcaccatataaattgggttatagcatgataaaatataagatgattctttttctttctataaagcagctggatgattattctaataattgaatggattcaaaggatagcattaataagtcatggacaaatttccacccctaagaactcaatttccattgcacttcaatgggaaatttactttggatatgacatagaatttgccacattttactaatattagttgcaatcatgaaaaatgatgtgtagtatggttgtgctgtaagatagcttaacataagaacaccctaagtctatcttttccaagattctgcttgtgttttgcatgaagattatagaggactagataatggggattaactgtggaaagagaataaatggagatatgtgaatttaggcttgcatctgtagttacttattagagagagagagagagtacagcatggtgtatatcaaactctggaatgagagggaaggagcttttgagaatattggattactgcattggtgaacgatgaaactgtatatatatgattcactttatatagcaacagtgaatcgataggtggttgttctccttggagcagtgttatcaattgctattttctgttttttttatctttatgtttgccgacaatgccgagtttctgtaatcattcagtcatatattcacattagaatctcactgatattagtgctcttatttgttggattgttgtgagtaatgtgtttccttacaaaggattacaaatggttatgaaaaaattatatcttattgatagatgttggcttaaacaccgttttttcatgaatgctttattggctttaaggatgacataaacttgtttacaatatttattacttctatctttttcctcttaagtagtttcatattgttaataatgaatcttgtgtattttttataaaaatttatgaatagctgattgtgtcctatatgcgttttgctcttaggtcgaacttttttgtgtgaatcacttgataaattgctctttggagtcaacagaggaatttatatgtatggagttccgttttactttaagagacaatggcatgcgagcagcatttgaactacttcatatggtgcttgaggtaacctgcttatcaaccttttatgtgaatctttagaaatggtatcttgctttctatattattttgctttgagatccgcatttcaccattacatacatggtgctttaggattcatgaactaatatttggtatgtgtctcagcatagtgtctggctggaagatgcatttgatagagcaaagcagttatatttgtcatactatcggtctattcccaaaagtttggaacgcgcaactgctcacaaactaatgacagctatgttgaatggagatgagcggtttgttgaaccaacaccacaatcattacaaaatttaacattgaaatctgtgaaagatgcagtgatgaatcagtttgtgagtggaaacatggaggtatggtcatatatgttcaaactgaatatacacatcccaaagcaaggttttagaaaattgaaggtgtattattttcttcaggttagcattgttggggacttctctgagcaggagatcgagtcttgcattattgactatcttggcactgttagtgcaagaaaagattccaaggaaaagcgggaaatggttcctgtcttgtttagaccttccccatctgatttgcagtttcaacaagtaaggccatcacaaagttacctgtaattgcatttcatttttccgataaactgaataattgagattagatgaggaatggggttgactggtttatgtgtatctcttgtagagattataagaatgatataaatgaaaacaatgtgaacttatgactgaaagctcgactgatgttcactttctactctgtgattattttatttggtgattaaatatattaacctttaaaaattagtgaagattgaattaatgttatattctagtttttgtagtctttttctgttcagttagtagttgttcatagaaaatgttgaattttcctttgaagtatatatgtgtgtgtgtgtgtgtgtgcatttgaaccctttaatattttgtttcaaggattctcaaaaataatgttcgatatggcataagattgtgcctatatatagttttgttgaatagttaagtaaaatctagttaaccttgaaaaatgcatcgttgtggcaaagctagcatgatagaaggaaggtatgtggattgacttggctgcctgcagtgtgttctatgtagatattgtttattttcttcaaatgttgcaatagctattttcctgccaatctttaaactgagtttatgcttataatgttttctcatatgaccaggtctttttgaaagatacagatgaaagagcatgtgcatacattgctggtcctgcaccaaaccgttggggttttacggttgatgggaaagatctgttcaagtcaatttctgactttccaactccaggtgccactattttaaacaaaatgaatatattaaaaatgaatatattacttcagaattctttattagttaattatatgaactcaaaacttatgagtaagtagataatataacatctcatgagagattatttaagggaaggaaaagttcacagatttgtggttactggtttggccagccatgctacatgggagtgaatgttaggccacaaaacacaatatattcaagagatgaatgttacttaaatgaggatgcttaggtggatgagcggtcatataagaatgaatcgaattagaaataagtgcatccaccaaaagactgatgcgacacatgatataaattgagcgaaacatgtcaacatgtgttaaagatacgaacatattgctccagttaggaagtttgagaacttgaggatagaaaataagtgtagagggagagatagacttgagattatttggaggaaaactatctcgaaaatgtgttcattgggtattgaatctattgatgaacatatgacatttgatagaggtcatgacgttgcaggatccatacagccgacaccacctagtgtgggataaaggattgggttgattgattagttt

SEQ ID NO: 1043 - DNA, 4441 bp, Euphorbia heterophylla
aagaggcaacttgtgggagtttttttttttgggttttgcctttgcttgatatttgtttcttccccttctaatagaaggatgtagagttcatatcttaacttcaatttttatcaacaggaaaacaaataaaactaaaggaaccatttgtcactctctttgccccctccctttcttcctattacattcttgtctagtcaacttcttttgattttattataacatacatggttcatctttccaaaagtctcaagaattattttatctaggataattatattgttatatcagaattgtgtctcatgtgacgccaatcttgttttctggtagttgacttcctcctgtatatgcatgatcgtttgctaccaatgattcattgcagatattaaaaaaagttgaacacttcatttggggttagtttggaaagtgtcagtgtattgcatccaacttcgcgaaatgcaataatgttgtaactgtgttttggaagattgatgaaaactgatctagcattatgctttgttaagcaagctcagtatatttgctgttataattttgactaaaaaagtaggatttatatcaagttagagttatgatgcatacattaagtaatcttattttgtttgctgattattttcagggttctaatactgatctacttccatcggtattggatgctttgaatgaggtatgaacaagaattttgtttctgcttgtaatacatgccatacttttatttgaatcaattaatgatgcatcattttgtcataatctcattggtattgtttaactcattccattgcagtgtctgagcatttgttaatttctccttgtccatataaacattgtaacgtaaataacatcatttgatggaacttgaattaaggatgcgaaaattcgggtatataatatgatgtttcatgatgacagatagctttccacccaaagtttctttcctctcgagttgagaaagaaaggcgtgctattctttctgaactacagatgatgaacacaatagagtatcgtgtagattgccaggtactacattgatttgtttcaagattggagctaattgtattttaatattgctagcattggcacttcacagtactttaagatggttttattttgtgctgtagttattacaacatctacattctgaaaataagttgagcaaaaggttccctattggattagaagaacaaattaagaagtgggatgcagataaaattaggaaattccatgaacggtggtacttcccagctaattcaaccttgtacattgttggtgacattgacgacatcgcaaagacggtccaccagattgaagtaagtcaagaaagtagactagaatatgtgacatacttgtttctgatttgtttcttctaaatttagaaacaatagagtattaccgttattctttttatgcaggctgtctttgggcaaactggcattgaaaatgagacatctcctccacctactcctagtgcatttggagcgatggctagctttttagttcctaagctctcagggctttctggaggttcctctgcagaaaaattatcgggttcagatcaatataaaatcttgaaaaaggagaggcatgcagttcgtccacctgtgcagcataattggtctctccctggaagcaatgcacatatgaatccaccacagatatttcagcatgagttgcttcagaatttctcaattaatatgttctgcaaggtatgtgtgcttaagttttttggcctgtgtcttttgcatccaaagttcagagtattttttttccgatttttcttttgttttcttcagtttttttccggtaattttaacatcattttttcatattgtgctgcagatcccagtgagtaaggtccacacatatggtgatttgcgaaacgttttgatgaagaggatattcctatctgcattgcattttcgcatcaatacgcgatataaggtgtgttattgaatgtatttaatttactgactcgatttgtttaacatatataataactgctttaatttgtctttctgtttcttcacattttcatgcaaggaataaacacttaaatgcctgcattctaagacaattctctgtaatgaactcatggtgctgactgatttgatgacagttataacctggaactgaacatgtaccaagtatgaatggcatctagtgaaaaatatatagattattggatcttgtttgttgttatgctgtttgactgatatattgtgtattatgagtactgttttgtagacagtgcttgaaatttttatctggtaataatcaaataaaaggttgaagacttgtgttgttgatttctttgttgttttgctaccggtatttttgagttcgtatcatcttatttgttaacttcttttgtttgtgaaaattttcagagttcaaatccaccattcacctcagttgaattagatcatagtgattctggaagggaaggatgcacagtcacaactcttactgtgactgctgagcccaagaactggcagaatgccattcgagtcgctgttcaagaggtttgtacttttcctaactaacaaattggatgcacatcaatctcttggaaattagtgtaccaaataaatgttgaagttgagcttttgatgttttggcattgatggaaggacagaaagtttaagctgcctcattatgtgttaacaaatttattaggtatggtcatgaagtaatattatgataaaagctcctatttcgtcttgaaacatgttggggtgttgtttagtattatatttctaccctttctttggcctttgtagtggcttttgttaccttttttttcttctttttttttttaaatttatcttgtcaatttgttcgtttaattgtttcatcttttattaattttaagtgaagctctgacctgattcatttggttatgatgctgttatacatccacggaactagatcggtatctctgtgttagtgtgaatgtgttgtctttgatgcattactcaactccaggatatcagttatttttgctttatatggccatattattctagtgtttggcaacatgatgtaattttatatcgatggttccgttaaatctcttctttgcattttgttcctgattgtatcttctcttttccgtctggtataggtacgaaggcttaaggaatttggtgttacaaagggtgaattaactcgctacatggatgcacttctaaaagatagcgaacatcttgcagcaatgatagataatgtctcttctgttgataatttggaatttattatggagagtgatgcattgggtcacactgtgatggaccaaagacagggccatgagagtttgattgcggttgctgagactgtcactcttgaagaggtaattttgtgttttgaatgtcgtcatggtttgaccttttcaaatttagatgtcataatggtgtttctcgaaggcaaatattcctgctttatctggttattgtttcttacatgtgtatagttagacccaaaaaggaaaaatctccgtacacgcatatctactcatggtatcatttattgccagttcttgttttttgccaaagcaattgattttggaaccatcgcaaggtctgtcctggtcagggcttgttcacatgttcctctattttcttttttattcttgaaccaattctatgacacttaatcactgttttgtggtactctttcctctccatttggttctgttcatgttcttctgttggccttctttatcactcgttgagttttttttcttctaatcttgcaggttaattctattggtgccaaggtgctggaatttatttcggatttcggaaaacctaccgcacctcttcctgcagcaattgttgcatgtgttccaaacaaagtgcatattgatggattaggtgagactgagttcaagatatcaccgagtgaaatcacggctgctatagaatcaggactgaaagaaccaattgaggctgagccagaggttattttataaaacatatgatacccatttccagtttgctatatattttgaacataaaacatgtggttaactgaactttgtgttgaatttttggttggctacagcttgaagtgccaaaagaattgatatcttcaatacagttagaagaaatgaggctacaacgtcaaccatcctttgtccctttggtttcagaatcaaatttgttaaaactgcatgaccaagagacaggaatcactcgatgctgtctttcaaatggaatcgctgtaaactataaggtaataagtatatttcagtttagtggtcactagtcactcacatttatgaaattggctcttcattattgtgaagttccctaccttgctttcatttgtgcatataaccaaacgttgttggaaagtaagaagaagattgttaggaataatataaatactaggattgggcctcacctatcagcttaagcttttgggagag

SEQ ID NO: 1044 - DNA, 2533 bp, Euphorbia heterophylla
ttcatttgtgagagacaatatttctgtttatgatatttagcatcttcagaattagattcataaccaaagtttactgtatgcttcttatggatgggaatgatgatgattgataatttttgtagatgtatttattattttgttgtaaatttagctagtgaatgtttatatgggtttttcagtgtgcgctatctacaagtgtttcgtgcctaaaattgaaaccttatatcttgcagatacacaaccaaatgaggaacagctgataaatgggagcgatactgtgaaagatgggcagagaaaactacgcagtcatccgcttttcttcggagtaactatggggctgctggctgagattataaattcaaggttacaggcctttaccacacgtccttgtattgtgctttttttttcccaatcagttattctgattctgacatacagtcagttattgatgccttgctgggtttcttggatggattagaaaggaaccaaataatctgttattggcgtctgcaacagataaaatggtttatgtctggtaaaatctgaccagcttaatgcacgatccccggaaaaaagagggccttaatggaagacactgaatatttttgaactttgacttttagaaaaatgagcttaagtcaactttaagattaaaatttggctatcaccattcaataatgtgtaggaaattatttttgatattgaaaattttgttatgtgcataaatgtagcgaacgtttttaattcagatttgagtcatttttcatattctcagaaattcaataacattgctgataactgtttcataggatggtactccgataccataatttgtgccttcaattaaacactgaaaaaattaatcttggtcgagttcacctcagtaatacttgcatcaggcaacctgtatgatatctgaatttaatgatatagttagttttcgaaggtttctcgattatttattaattgtattactattatatttggaatatcatgaatctataaatgaataaattaataaacatgtgtgattgtgttgatttgcttattcttttggtgcagactgtttactaccgtcagagattctcttggattaacatatgatgtatcgttcgagttaagcctcttcgacagactaaaccttgggtggtatgtagtatctgtaacatcaactccagggaaggtttataaagctgttgatgcgtgcaaggcggttctaagagggctgcacagcaacaaaattgtccaaagggagttggacagggttagtttacataacagctaaaccactctttctctacctttatcatcaattgcatttagacttggggttagatggttagtttatggtccgatcgtagtatccatacgctcaatagcaagtggggtccttgtaccccactttcttcataatattaaatagtataaaaatgtagacgaaaataatcaattggacccatcaacattgaaattatcaattgattctagaaaaatagaacttatgaagaaatttatgatatacaccttaataaatgtatctataaatgttgtttatcaaagaattatctagctaaaataatatatatatagtaaattataagtatgacattaattgctcagtattttctttacaatttattatgcattaagaatattcaatgttgttatttatgaacgttattttccaaatttataattcaatatacaagggcaccatggtaaaaaatgtctggatttgccaccgatggctggaaagatggacggttatttatgtgaactttttgtaaggaaaaaaataaacacagtttgtgcatgggattatggtattctactatttttgtattgtgcgttgactgtgtaatcgttgttcttctaattacaggcaaaacgaactcttctgatgagacatgaggctgagattaaatcaaatgcttactggctcggattgcttgctcacttgcaagcatcttcggttcaaaggaaggtaaactcgaagctttgcattcaagtgtatcaactatagtatattctagaggcatgaaaattatgttccaaaaaatattaatgattgattataagctttgtttttatatctatgtttttgggtttcaggatatttcttgcattaaagatcttacgtcactttacgatgctgccactattgaggacatataccttgcttatgaacaattaaaggtcgacgaaaattcgctgtattcatgcatcggggttgcaggcaatcatgctggcgatgagaacgttggtaagtgttacgagtaaaagtttgttgaactggcatttcttatttcatattcttgtgtccgatatctttcctaaaagttgttacctattaggggaagtccaaccatattctccatctttctttccctaaacttcgttttgcaggatctagtgtttttcctctccatttaattcccttaaaataatatattattattattattattattaggcggaatacatcaatacccctttaaacttgtccataaacgccaatttacctcctgaactt

SEQ ID NO: 1045 - DNA, 972 bp, Festuca arundinacea
caatggattgcgcgtggtgactgctggcaaaaattgtcttctttattacttcagtggtctgattttgctagtaggttcttatggttagcacaataaacgtgaattgatcatcagttcaagtgtaaaacaataagttctacttgcatgttttgtttttgtactaatcaaaggattcccctggttccgtgtccatacaagcttaatacggtagaagtcgcatgttttttttattttgaagctagtggaaggtttatgtactgcaaatcattctactgccaagtagcattctgcaaacaaaggggcagttgcctgtggctattttgagtatgcagcaacctaaatgttgaaggaacatcgaattctgaagttagcgaggggtcttgtacttgcaaatcaaatgatttacgtagtttcgttctgagaaaatacataaaacaataaaaagtttatacacagtattgcagatttgcaggctatagcgtgaccacataatccactctttcacttgttcatgttgaaaatcagtgaagtatcattttcttacttgactatttgcttttcagaccaggcatagtcatattttgcgtgctgctggacctgacgaaccacatgttgcaagtccaacatggtctgaggcagctctcgataaaccttatcttgatgaagcgattggaaacgaggagcttgaagctgtcctggacacacctcttccttcccatccaaagctaatacggggccaattgaagaatggcctcagatatcttattttaccaaacaaagttccagctgataggtgacggaacttcttttcacctccatatgttacactttcagcgatagtacttccataatgttcttttgctgaaacgaaattatctacctgtttttctgctactagctggatttcccagcatagtggggacttgtggtcatgagtatgatgacataggccgtactgccatggtcatttcc

SEQ ID NO: 1046 - DNA, 347 bp, Festuca arundinacea
aggttaacactgttggcgcagaagtacttgaatttatttctgactttggaaaacccaatgcaccacttcctgctgctattgtggcctgtgtaccaagaaaggtccatattgatggagtaggcgaaagtgattttgagatacatccagaagagataaccgagtccatgaaggcaggtcttgaagaacccatttacccggagcctgaggtatgttggttatttgtgatgtctttttcgtgttatgaaactatactaacttggcttagcaaagttcatgcttgaatttgttttcatgccactgaaaaccgtaaagcggcattttgttgattgttgttgtgctggttgcag

SEQ ID NO: 1047 - DNA, 494 bp, Festuca arundinacea
ccccaaagctgccaggtggcttggctgcaagcctaactggtgacagatcacctgccacagataaaataaaacctgtaaaaagggaaagacaggcagttagacctcccgtagagcataaatggtctcttcctgatgttcatcaagatgccaagcctccagtgatttttcaacatgagttaattcagagtttctctatcaacatgttttgtaaggtatgatttgctgctagtcttaacacttaatttatgttttgcacctttgtgactagtttactactaaaatgttcattctaatagtagttcatattatatattaggtagataaagaagccatatcagcattgctgtaatgcatccaccacgtagagttttatagtccatctatttttgggtaatattgaaaagtctcatgttaacaatggtgcccttaatatggtcttcttaaagatattttaatatactgatttctacaactaatttactgctttagtttat

SEQ ID NO: 1048 - DNA, 478 bp, Festuca arundinacea
cttttttgattaatttaatgttcaaagatatgtggcagaattattggtgaaacccttgaatggttgaactagtacattgttttgacttgtcttgattagctagcataaaatatgcgtgcttgtacatggatacatcagcaaacattgtggctttccgtgctcttttgttatcttgcattcaattttggtgacatttgaagaagtatatagatcaatcctctggggcaaagtgttgatttaagttcttgaacatgaaaagtgtaccccagcacatggatccacagtaaatatggaaccatggttaattcatgtcacacagaaactttggctaagttggaccaagcaaaattactttgatatgatatacatatgaaatatgtgcactatggacttctaactatttcagtttgtaggtttgaggctcacatggaagttcatgttggatcgattgatgaggaagaggatgagcagggaattg

SEQ ID NO: 1049 - DNA, 235 bp, Festuca arundinacea
aatttaggtttgccttaagagataacggcatgcgtgctgctttccaactcctgcatatggtccttgaggtgtggcttttcagcttactacataacatactcacctgtctcaccataggaaaaactctctgaaacatgaggttgcatttacacaatttacttctttgtgttacagcataatgtgtggctagaagatgcgttcgatagagcagctcagttatatttgtcttactacc

SEQ ID NO: 1050 - DNA, 330 bp, Festuca arundinacea
tggtccttgaggtgtgggttttcagcttactacataacatactcacctgtctcaccataggaaaacctaagttttctctgaaacatgaggttgcatttacacaatttacttatttgtgttacagcataatgtgtggctagaagatgccttcgatagagcagctcagttatatttgtcttactaccgctctatccccaaaagtttggagcgtgccacggctcacaagcttatggtagccatgttgaaccatgatgaaaggtttgtagagccatctccacattcattgcaaaagctgactcttcagtcagttaaagaagccgtcatgaacca

SEQ ID NO: 1051 - DNA, 766 bp, Festuca arundinacea
ggtcttgaagaacccatttacccggagcctgaggtatgttggttatttgtgatgtctttttcgtgttatggaactatactaacttggcttagcaaagttcatgcttgaatttgttttcatgccactgcaaaccgtaaagtggcattttattgattgttgttgtgctggttgcagcttgaggtgccaaaggaattgattactcaatcagaacttgaagacttgaaattgcaacaccaaccatcatttgcccctttcggtaaagagcagggcgtggtgaaagtatttgacagtgaaactggtataacacagcgccgcctttctaatggaatttctgtcaactacaaggtacttagtcaactggagcctcaggctatttttctagagacaacataatcatcttcacttcagtaggcattctggatagtttagcttttgtttcatgtttcatactaaaaacataatgattattgatgacagatcacacaaaatgaggcaagggttggtgttatgcgcctgatagtaggtggtgggagagccaccgaagattctgactcgaagggatctgttattgttggtgttcgtactttgagtgaaggtggctgtgttggtaacttctcaagggaacaggtatcttccacaaactattcagttttatatctgtgccagccaagctttccaaaattcaaacttactactttctatgataaatatttaaagcagacacttcttgcaagattaccccgtctattctgctaatgtagttcta

SEQ ID NO: 1052 - DNA, 279 bp, Festuca arundinacea
ttaagcataactgtactgttctaatgtgtacacttgagtattggacattatgtagcaagcatcatcattttctacttgttaatttgataagcaattttcttgtgtttcaggcaaagaggacattgctgatgaaacacgaggctgagacaaagacaaatgcctattggcttggtctgctagcccatctgcagtcttcttccgtgcctaggaaggtaaattctatatatgagggttataagcgcgcatattctgtagaaaattggaaaaggaaatggactg

SEQ ID NO: 1053 - DNA, 493 bp, Festuca arundinacea
catggtgtatttactgtgccgtggtacctttggataactaggttacaagtggtttgcttctgcaaaaatcttgatgatgcccctatttattcattttacactattaaagcaacatacttcgttacacatcttactaatgttccacgcctcgttattcttgactaaaagaacctcagttttcactttacactattaaacgagacacttcatgattttcaggaaactgcatatttttgttggtctttacctaataggactaacgtgatgagatgcacctttttctctcaggctattcacaacagtacgagattccatgggattaacctatgatgtttcttttgaattaaatctttttgacaaactggagctgggttggtatgtgatcgcggtaacttcaaccccgagcaaggtatttaagttgtgatcttgagcttgttgttctgtgctcttccgctgctaatactatcgttttgtgatctttgatgccaggtcc

SEQ ID NO: 1054 - DNA, 732 bp, Festuca arundinacea
gatttcttctcttgtttatctatgatctgacatattagtttgtcttccatgtggcaggaatacggtgaagccttgctcccttctgtgctggatgctttgaatgaggtaagatatttactcaattgcattcttatttaggccactttttaagagcatattcaattggttagaggcccatagcaattacagactcttcaactactcactatcattttttgttaatgttacagcaacacattcaaactgctagctaaaatatagatgcatgctattagtctgtttgacagatctcttgacgttattacgtagatgcataatcaagttcttcactttatattctcttcagatagcttttcatccaaagttttcttcatctcgtgtcgagaaagagagaagagcaattctgtcagagctccagatgatgaacacaatcgagtaccgtgttgattgtcaggcaagtctttttcccagttagaaaaattccaagaagggatattattttaatattcctggaacagtgctgaatcattttatattccagggcactatctttctgtactaattgtggctcctatgctgcagttgttgcaacatttacactcggaaaacaaattgagcaacagatttcctattggacttgaggagcaaatacttaatgggatcctgataagatccgcaagttccatgagagatggtattaccctgcgaatgccactttatacctggtaggag

SEQ ID NO: 1055 - DNA, 265 bp, Festuca arundinacea
caactaatttactgcttctataagtgcagttccttaaccatgctgcccatggctaactattgctttccatttgtttgacagatacctgtcaaccaagttcagacatacaaagacctgcgcagtgtgctgatgaaacggatatttttatctgctctgcattttcgaatcaatacaagatacaaggtttgtgattttgagaaacattcatgatctgttgtccaatggacgctattttcaaatttatatatgttttttccatattcat

SEQ ID NO: 1056 - DNA, 1184 bp, Ipomoea hederacea
aaaatctggggaacaatccaacaaactggagaatgtggaaaatggctccaaggaagatttcacactcatccattgttctttgccatcactatgggtttattggctgaagtaataaactccaggctttttacaacagtcagggattctcttggattaacatatgatgtttcatttgaactaaacctgtttgatcgcctgaagcttgggtggtatgtgatttcagtgacatcaacccccagtaaggtccataaagctgttgacgcttgcaaaaatgtcctaagaggtttgcatagcaacaggattacaccgagggagctggatcgggcaaggcgaacattgctcatgagacatgaggctgagataaaatcaaatgcttattggcttgggttgttagctcatttgcaagctgcatcagtacccaggaaggacatctcatgtattaaagagctgacttcactatatgaagctgccactattgaagacatatatgttgcctatgaacagttgaagatagatgaaaattccttgttctcttgcattggaattgctggggtaaatgctggagaagacatatcagtacctatagaagaggaagattcaatcgatggccttcctaatgttattcccatgggacgtggttcatctacaatgacacggccaacaacttgaggggtggtagaaattcttcgaaagacagattgtatgagtgacctataggacacttgtcagtgcttttgctgggtagaagccgtatgtccactggcagaatgtgttatatatgcccttgacagggttgtgcagtcatttccaaccatagagaaggtgcaggacagcaagctgccactcgctacggtatacagattaagtcttggtgctgactcgacgctagggcttcatgagattactaggtccccattggttatggcattgaatggacagaagtatagtctaactttagtgaaactacaatttcatatgtacccaagtaatgttctttactcacttcaataggatttatatacggagtactaattttttcatcatgaagccaatattaaattcagtagtacagcagccaaattgtatgtatggattcataattctttcctggctttttcttgtgctaaagttgtattatgcacacaactttcactgcttacaaaacatatataaatatattttcc

SEQ ID NO: 1057 - DNA, 1227 bp, Ipomoea hederacea
agatatagataacattccaagacagttgaccatattgaagctgtttttgggcatagtggtgggcagagtaacatggaaaatggggcaggtgctgcacctacaccaagtgcatttggtgcaatggcaagtttccttgtcccgaaattgtcagtaggtttggctggaaatacatctcatgaaaggtcctctgtctccattgagcaatctaaaacttttaggaaggagagacatgctgttcggcctcctgtacaacataattggtgccttcccggtagcaatgaatatgtaaagcctccacagatatttcagcatgaattgcttcagaatttctctatcaatatgttctgtaagattccagtgaacaaggtccgaacatatgctgatctgcggaatgtgttgatgaagagaatatttctttctgctttgcattttcgcattaacacaagatacaagagttcaaatcccccattcacatcagtagaactggatcatagtgattctggaagggaaggatgcactgtgaccactcttacagtgacttctgaacccaaaaattggcggagtgcaattaaagttgctgttcaggaggtccggaggctcaaagaatttggtgtcacaaaaggtgaattagctcgctatttggaagcactaattaaagatagtgaacagttagcggctatgattgataatgtttcatctgtggataatctggatttcattatggagagtgatgcacttggccatactgtgatggatcaaaggcaaggccatgagagtctacttgagattgctggaacagttactcttgaggaggttaattctgctggtgcaaaggtattggaattcatatctgattttggaaaaccatctgcaccccctcctgctgcaattgttgcttgtgtcccaaagaaggtgcacattgatggagcaggagaaatggaattcgagataacagcagatgagataatagctgcaattgaagacggtctgaaggaacacatagacccagaaccagagcttgaggtaccaaaggaattgattgcctcaacacagctgcaagaactaaggttgaattcaaaaccatcatttgtaaccatcagtccagatgtagatgatacaaaactgtatgacaaggaaacaggtatcgttcagcggcgcctttcaaatggaattcctgtaaattacaagatatccaaaaatgaagccaattgcggagttatgcggctc

SEQ ID NO: 1058 - DNA, 646 bp, Kochia scoparia
ttttttttttttttttttttcccacttccaaactatggtttttatgtcactttgtgattaaaatgtaggctgtatttagccagaccggctttgagaatgagacagaggcttctgcacctcctacacctaatgcatttggtgcaatggccagttttcttgtgcctaagctctcagttggccttggaggaacttcacaagataaggcatcaagttccgaccagtcaaaaattgttaaaaaagaaaggcatgcagtacgtcctcctgtacagcacaattggtctttgcctggaagtggttgcgtggctgatcctcccgagatatttcagcacgagttgcttcagaatttttcatttaatatgttctgcaaggtaatgataagttgagaaaatttaacttctaattgatgttgtgaaatcatgtgaaagcttatctaattctttctgagtaccgtcattgtctgtttgtcttctgtgtttgatttcttcatgtgatatctgcatacaaatgctgtctttgagcagtttgataaactcgttccttgtgcatcataatcaatatgttttagtctgttgtttttcaattggcaatagtgcatatgtctaattgataaacttagtactgtacctcattccatggacttcatgaa

SEQ ID NO: 1059 - DNA, 8532 bp, Kochia scoparia
aactgcgcaccgcggaggtggccgctgcgaacgccgagaacgaagctgattgcgtccatgaggttggatttcccggacccattagggccgattatggcggtgaaatcgtagaatggcccgattacttggtggcccttgtatgatttgaagttttcgagctctatttgcagaattttgcccggtgatgtgagtgatggcatggtgaactgagtgaggaagtgagtgggtgaattctagggttttgattttggggaagagtgacgagggaggagagagagtggaattggcggtttgagatggtggatttgaaatttaggggtttttttggggggaaggcgagatttgggggaaaatgaaaatggcgggcgaagaagagagagaaagagtgaaaactgaaaagggggagaagagaggagaagggaagtcttcccgttttacttctttgtcaaactcgtctattgccttcaacaaaaagaattccatttttgaaagtttaatctttttattttcaaaaataatacggagtattaattttaggataatgttatatgtagtccttaagatatgtataacacataaatatactttttaaaatggtaaaaaaaaagttgtgaatttatgacaaaatcacacacaaatcaatgtaataaatgttagattttatcaaacattactatttttgcattttatttatagccttaagggctatctttaacattttccttaattttaatttttgaaatatatcataatgaatatttattccccgttgaaatgtagcaaagaccaaaatggtattaactattgaagcatggtgatcattaattacttactgcacaaagtcttctacctatgctttctagcttgagatttttgactgtagggtaaaacctaagagtttcatccctctataaatacaggcatcttttgtcattgtaagtgtgcataaaactgaatacaatacatatgtttcactataaaactctctttattctttatttctcaattctcacaacattcccattctatgtaggtattggtagtagcgagttatacttgaaattcgctaaaaaccactagcgacttaataggtgaattcactatcatccgtagcgagtttctcttgtaattcgctactagtgatagcaatgttgtctcaatttttttaacttttttttaaaaaaaattgatcttacatggacgatctattaggaattagtatccaaaacgaagtaaaatgaaaattttgcaaagattaacaatatgtagggaaaaaatggacatatacttacgtttgaactcacaacattttccacattttaagagatttttcctccctctccgttttaaaaacgacttcattcctctccatgtttgagccttcaaaaaagagggcaatacaaattattcagtttgtgaacatgttctatctttataaccatatattgatcaacatacaatgctcccagttaggtaatacaaagtttataaagtttgtctgttttcttttcttcctttctgaactctgaattaagttatatccttcgcataagggacacgtgtaccgatatacctagattgccttcgtctagcaatgtataaagacacattgccctgtaaatcatagaaatatcaaatccagtagaaaacttcataaaccatatattttaacaaggtgtgctcaacgatgacatggttaattgcattgtacaatcaattatacattgcattgcacaactagttgtgctacgaataacttgtacgatgtaattatacactcatttatttattcatttgattctgacaatgaaccaaaatatgtgagcttccaagttacaaccaatcgatcatcattctcatgtgagctaatgaattgttacacaatcgcaatttgagctctgagtccaaaatagttcagacattgagcaatattcaatctaatgcccaaaaaataactccaccattaaattccatttcgataagagcaaaattgtaaatctaatcagaacagcagtgtacaacagaaaaacaaagtttgtacatcccagtatcccactacaatgtaaaaatttctcaattaatgctaaattaaataatttgacaggagttcggaccaacagcaataacaagtcatattataccttgttggaaaaaaagcaagttgttgggtgattcaatctagtttgcttgtctaagatctctatcagaaagatgtgttataaggcttaagctttagactttttccccttcccttcaggtgcgggtttgctctgaaaaggtatgaaggtcttcccaacatatggtactaaaacttctggtacttcaattccatcttccttctggtagttctccaaaatacaacacaaggttctctcggttgctgtcagagtagaattcaaaagatggacgtattgttttgtctgttcgttgctctgagaacaaatgcagtcaatcagaaattattttccagatgcactactcatctacaacgagtcaacgacaatacaaaatttagagtgagatgtacctttttctggccatatcgaatttctaattttctcgactggtagtctgtacagttggaacatgataccaactctctatatgtctgagatgaagggaaccaagcttccaaatcatatttcttagcagctgcatcattaagagcaccagatacaatggccactatctgatagggaagacccagctgcaaaatggcaacacacagaaaaactcaagaactcaaattgggcgaggcactccaatacagtatataggcagcacaacaatcatatatcttacattcaccactaattcacacacacaattgcacaaatgctatagaaaaagatgtctaagtactgcatttagtaggtggcgcttaaagacttgtgaggtgatacccaaaacttgggaccaaagctcactcctcacacattaaaaaagcactgcatctagtcagatgtcctctatgtctttcactctttctaatgacatatctgaactagaaacgatagaaacatcagaccacatagaaagcatagcaagaaatttacctgctgataaaaatcttctgaattttttagcatatcctcgagcatttcccatgaatcattatcatttgggctagtgaggcaaaattgttccactttctcaaactgatgaactcggaagattccaagagtatctctcccatgagaacctgcctctttccggaagcacgatgagtatccagcatatctggcaagaaacacaataagcacaggagaatgataatctataattgatcactcaaaagaactaagattgcaccttattggaagttgcgagggatgaatccagtcatctaagtggtaagcacaaagtggctgctcagcagtggcaatcagatatttgtcatctccttctccggttacctacaagagaacttagtttgtcaacagaacattcaatgattaaaaaattaccagttagatacaaagcagaagtgtttccaagctcagcagagaccagagggacagtaatccacatactgaaacacaatgtacaatcaaaatggtgatacaaggcaagctaaagtctaggattcagaatagcacagaatgacatgtcatgcataaaacatttgtcactgcagaaaaattaccttgtagagctcttcatcgaattgggctaattgtgcacattttgccattatatctttccgcatgaagaatggtgtcattagttgggtataattcctctttaccagaaaagcaaggccaaaatttatcaaagcttgatttagagccacaccatctcctttcaagtaaaaccctctaccaccagcaacattggagcctgtacatgaatgtaatatataccacacttagcacccaagataagataataaaagatgcgctgtatttaaccatgttgactaaacagcacgtgtgaagagcgagatagaggactggataacgtaattaaacaaatttactacttcctccgtttcacaatagtcgttacactcttgaaattgcggactcctagacaattttttagggaagaaagaaatagagagaatgaaaaaaggtggcttatgtgagaggagagagatagaatgttttgtccaaaaaaggaagtgtaacaagtaatttgaaacttccttaaatagaaagcttagcgagtaattcgaaacggaggaagtacaacacaagttgaaggacactttccaacataatgcatcctaaattccaaccaccactagaaaatacacaacagttgtcctagaagcattggacttatggactatatcagtcaattgaataaatgcccccaaaatacatggcttattcaatttccctgccagtactgccaaatcaactccataatctttaattaagcaaccaaaaaataaaaatcatagcaattaatcaaattactttcttgcttgatgattagtgagaaaggcaatcatttagcaaaaaaaatatattaaaaacttcaccatggaattcaattacttcaaaggtatgcactcaaagaggacagcaataagaagaccaaaatacaacaaaaatacaggcatctagaaccacatctgcagaaggatacaaaaatttagaaccaagaatattttaaaaaacaaaagagcgaggaggattaaaacaatggataagactcgtgagaggtgtgaacattacgcaagaaaaaactgaaaatccaaccaacgaacatactggagagattaacacaaaactttcaaattgccaataaaaaagatacctttctttgaatctactatcccaagtagttcaacaagctcaacatggtttttcaattttggctctgttcgcttctcaccccatgttcgaatcacagcattgttcgcctgtatcatcatgcaaatgtgttagtggatattaaaatgaatgactaactgcatttagttctaaacgaagtagttctaaaacattcttgggcaccacattcaattaccaagtaatggacaatatatttagcgcatcataaactaccatagaaatcatacctcgtcgttgctaacaggaacagaatcatggattagattcccaaccagttccaatttggcatacaatgcattcttaacttcctgaacttcagcttctttttgtgcacataaagccttgatctcatcggtacttttgatcttttcagttgcatcctctttagcctttatagagacaaaagtgggaggacattaaaaaaaatataaatcatgctgaaaaaacctggaaatctagaagagttgagtaactcacaattttcaagcgtgccacctctttgttgatgctatttaggctcttgcgcagactatcaagctcaaattgacctaacattaaggaaaattaatactactagtgctgtttgacggagtgaaaactacattaaacttaaacagtggtagcaaactagcaactacgaaattatgccctcaaaaggccaaaaaacatacacacattcaaaggtgtagaagcatccgaaacaggtttcacagactcaacacattatgtttgaatataaaaagtccatggccctacttccctaatttgtttgaaactaagtgatccagttctccttgtttcacttggagcaacaaagtgaaacgttccaactttcaacacaactcatacaatgtagtacagaataggtcaaaataatcaccacttcaccagtgaatgtcaattttcaacaaagaatcaagtagcttctcagttgtgcgctgcactgcatcaatctgtgtcctagttttctaccaaccttttcagtgtctgtcctgaatgtacttccttgctaattatcctgtattactgcccccttttttcatgaaaacctgctttgactacttaatacttttttacttacgaatgtttagctttaccgtgggtggtcaagtgatggtcagactattgtatctagatcagtcaaaattaggaatagtctctggagacagaagggtctcatcctcatgcaaattcaaccagggataaaatgtacttgtgctgtaatcacaaccttcaaagaaggggctcagttgccaagagttgtagttcaagattttcagcagacaaatcaacatttcctttgtcaaagaacatccctgacactgtaagtaagcgcctttatactgctttgagttgattagctgctcacaaaacctgtcatctgctttcctaaatatttgagttctctgaattggtattgataattgcatgattgtttacttgtttttgttatgagttgatttttatatttcatagttaatgattgaatcattgggggttgcctatcagaaaagtgataaagtgatggttcgtggttcctgtataaataattccatatcaaacaatttttacatttgaaattgctgaaattttaggttggattttgggttttcatcaaacaaactgcaaacaattagctctgtataagcatgtttcataagcgcaaatcggcaaatcccatgctttgattgttatctattctactttaaatgcaaaattgaacttatcatttggttaataagtacaaatttctcaacttttccctccaatccattgcttatatcaaatcgaccacttcttcaaaaattattgattgctaatcatgttattagacctctaatatcactataatctactttcccactcatagtttacacaaaaaaaccgaactatcaaatttgcacaaagcacaatattataagtagaaatttccccccagaattgggctctaataaaatttccgtattgtaagtatattcaacaacttcaacagcataaataaaacaaattcaacacaagttcatcaaacatagaaaaagggggaaaaaaacagatcaaaaaaccaaaattcaacagcaaaacaaacaagtatgagagagaaagagtacgtttgcgccattcttcatcaatgcggatgatttcatcaacgatagcttcatcagcgaatcggcggcgttgagattcgcggatgatttcagggtttccgcccttctcaaccctaaacaaattgatgtccaacatttttcgcgattgaaaagcggcaacgatgagagagacagagtgaagaacagaagttcgggcgtcaaaaaaagttgaagttgaaacgatgagagaggcagcttaaaaccctattatggcgagatgaggaagtataaacatatggggatgggatagtagggtcaatcaccctatttaaatattatttttttaaaaaaataaaataaagataaaatgataagaaaaatgaaaattacaaattgtgctgcgtgcactcggatgattccgattggagaacttcaactgcaagcggcaaccataactcaacggcgaccactttccgactgctaacctccggcgccaatcatgttgcgacggcgaccaagttccgacaccaaccttactgcagctgcgaccaaaaacgtaagaaatgccagaagctattgaccacccgtggagacgaatacagtgattccgatgagtataaaaagaacaaatttctacgcgaacaaatcaaatttcaagcatttagaagttgagatttaacaatgcctgaaaagagatttattgtaaataaaatgatacggagaaagtaataacgggtaaaaagccatgtaatgaccgtggatgtcatcagttgaaaaagttattgcttgaagctgtgcatcgttagcgttgtgccatcgtgaagatattgggtatgtttggatgggcaaataattctatacaattctctacctttgtcttattgattaggaattttgtctcaaatagctcactagtagtgattaggattttgttttttttaaaaagaaaaaaacaaagcaaaaaaaaatatccatcctacgtgaacggtatggtagaaaatatttttcaaaatgaaacaaaatgatagttttgtaaaagtttagcaagcaatatgtaggagaaaaaatcattgttgaataagataaagtttggagtacaaatgagtatcaatttatctatctatctattgatgttttgactttcctgaatataccttaggtataccaattgttcttaaaaaaaattaggtcaaattgttggtacattcaaagatttttttttgggttgggtcttcaaccgttttacaatatttttatgctaaattgttggtaaatccaaaaatttttaagggatttcaacttatttttaacggcgaaatatttactcatttctttaataacatgacatatgttgagattgataaattagactccattgaatgaaaatatacaaaacactaattgataaaggtgtaaatggttagaccgttagagcacatatgaataggagtaagtggtcatgaattcaaaacttattatccttatttatctaagcaaataactttgatttgtataaattgatatcctatcaatatttttatttttatttttttactcgttaattgatgattttttttcttcaaatggacaccatacttctctcttcccttacgatcgacatcgttgtttgaaattacttatct

SEQ ID NO: 1060 - DNA, 1232 bp, Kochia scoparia
aaatcaatagttgttaaagaaaggtgataattgaaggttcaacaatggcggcttcagcttctgctgtgcttggcggcgtttcgaaccttcaaattcgtaataaattgaataatcttggagatgataatagttgcggtgcggcaaatgttgtttctgctgctggaatttctaggtcttcttattgcaaccctaattttcctcgattgcgccttcgtcggccttcaacacgttcttccaagtgcaggtttatctcctaattcagtattttgctaatactttggtgtgaaatttgctaatacggagtactttgggttgaaattagctaatgctactatttgttagaattttagttgattaacacactattaataaattagtatgaatttgatttaggcagtttgaaatcagaccatttgtgctaatatatttcggaaaatggtatgtattgttttttaagtgtttaaaaccaaatcattcgttgttagatacggagtatcatgaatgtgcggtttattttaatattcttaatgtgtagtttgtgtttaacatatctgcttttatctatgtataagtagccctatgtgtatcatttctgtttattattaaactatcactccatcaattccatacatttgattgattcaacaagacttcatattagagccttagaatatatgggcaactagttttattactttatggtccattcaactaacctgctgaattttaatggtggaattacgggtcaatgattaagttctacattgaatatctttgtttttggaacaaagaaagtttaaattggaaatgttatttggaaaggcagattcattttaggcatgtagctattgttttatttaggacgggaatcaagaagaggaaggagaagtgagaagaggtacacagtaaggaattgaatggttgaaacacttgaaagaatgaggatgagagagggaatggttgtgggtgtgtgcgcgcgcgcgcggaaataggtggtgggggaaatgaaagcctgaaagggacacttaacttgtcagcttcttatcacaaatgggcattgatttgtgattctgaaggttttaatggaatttcctttgttaagagttacaatcacacttattgtttttgaatacgaagtatctatgataaagatgtcatatttcaaaaagtaacaatggcttatagttgggcgtctcaaacaatccgtactctagtgtgagggtgggccaact

SEQ ID NO: 1061 - DNA, 3930 bp, Kochia scoparia
ttatatatatgttcactctttcagtatttcatgtcgatgacacactattttcaagctcaaaaaaatagaatgacaattctattggagatgagaagcctattaaggatgtcaacaagatgatgtgtgtaaggcatcagcataggccatctatcatgtacactttggcaagaaggaaaataagttaccaatgaaattatgagtcgtttacagtcttacagattggtgtcaaagtttcttgagtaggaaaagttattcgtcttaggacttaagagactaagagagagaagaacagttactttaataaaaatgccgagtttctataaggcaattcatctgaaatattgtatgagattcatgttgtgggagggagttcacctcttgaatgtgaacaactgtcttaacctaatttcactgatttgcattacaattttattctttttttcctaatctatttgtgctgattcttctacataatgacctgaggtcacagcgatatgattaagatatataaactgtacaagcaagaacagtcttttttgtatgaagtttgaacaagtgtagaacttgagactttgttttaagtttacgctgagttgattgtatttctccaagtaacctatcttagtgaactcacatattcaactaggttatcttgctaagatgaaatgttgtctagaagcataccttattgtaaactttacctcaacctgccttagtaaacttcccaatcgataagttatcctgaataagatgcaatgttacttggaaagatacagtgctttataaatctatactctatgagtaagcttttctgggtaatagtttgtgactattcctgatgacaacttcgtcactatgctcctaagcctgctatattgctttctagttctatacgcgtttaatcttgctattaattaactaatactcttgtcaacatgcagcatagcgtctggctggatgatgcctttgatagagcaagacaattatacttgtcttattatcggtcaattcctaaaagcttagagcgttccacagcacataagcttatgttagcaatgttaaatggagatgaacggtttgttgagcctacaccagaatcactgcagaatttatcattacagtcagtcaaagaggctgttatgagtcagtttgtgggtgacaatatggaggtatattctctcttctcgtcaaaattaatatatgtattgccttaaaaacctttaacatgtgcctttcatcttaaacgaccaggtcagcattgtaggagacttttcagaagaagaaattgaatcttgtattcttgattaccttggtacagttagcgcaactcgtgattttgagaagaagatttatgaccctattatatttcgtcctccatcagatatgcaatctcagcaggttaggtgtaatgatttattttctcgtaaacttgtcaagtgctgctttcagagttccctcccgggtttcaaagtttggcgtagtaatgaaactaaattctatcatatttgtaggttttcataaaagacactgatgaaagagcttgtgcctacattgctggccctgccccaaatcgatggggctttacagttgatggcatcgatctttttcaatccattcacaacgctccacctggtggcggtaagtcacttttatctgtttgctttgttggaatagtatgatagctagaatttcgtgcaaacaactttgatgattgctctagatgttggtcctgtcaaatagtttttgctttccgtttgacagaaacattaccggatctttcgactaatatggtactgacctacaaagagataaacatgcactataaatagagtttgtatctctgtcattgacaggtcatctggcattaacagttgaactttcaaatgcctttagagaagcttctgccttgggtagatggggagtcacgctgccttagaattagatggaagttactggcgttgatatttgtagaagtgagatgtagtatctagccttttttcaacattgccttctcttatatgttgtaaaagagcttctttatgtactgtccaagtctacttctattattaagagcccttaatgactggctaatgattctaatttgaagattcatgtaattttaaaatgtgtacggggttgccaaccgttagtgtgtttttttttgacaagaccgttagtgtgttaatgatattggttacctagaagaataagagtttttattatcgtttttgctacatgcttgtaggtgagctatcgaaatctgagacatcatcatctggaaactctgatgatgtgaaggagcagcagagcaaaattcagggccatccattgttttttggtatcacaatggggcttttagcagagattataaattccaggtaatttttggggcaagattaacaccctgttgagtgatcttgctggctacaccgctatagatataaatataatcgttgcaagttatgttcacatttctggcagtctgcttaactgtgaccattttgcctcatgtttactttggataaatcacttaaagtgggacttcgtgatgaaagatgttgtgtctgagtctctggcagtctggctaacaaccacttatttgctgtctctaaatttatgttcaatttaattatgtttgtgaaacccagagtgtccgagcctctgatgggctggctataacctcttttttgctgtctgtaaatttatgcttagtaacttagttttgtgaaacccagtgacaactatttttatgatctcatgtcatttcaaggacctgcttgccaatatacctcctgtaatgtatgagacaagaaaagtctgaccagatcaatgaggattggaagaattatatttcaattgatttatgaatcatgcaaagtttttattccgactagtctaaaacccaccttggttcacaagtttttactggaattcaacaacttaaaatgaatcaatgaatttatattgaaggaatagactgggaactatgctcctgttgttgaaagtctgtgaagaaccatcagttgctacttcactgtcttccttaatctatacccattcctgttaccttttatatataatgtgtgcctgaactctcaagctaactagttcatcagtgcaccaactggttaaggaatgtactacttatttattaggaagatccacgtctcaccttgttaagcctctgttcgatttttggattgactgcaaggtgaaaagtgatgtttttctgcattcaatgcttatcttgtttgatggtttgggggcatctacagatatgtctcttttcagtgcacttgtttgatatgcgttgctgatattgtgtttataattctttacaggctttttacgacagtcagggattctctgggtttgacgtacgatgtgtcttttgaattgaacttatttgataggcttaattttgggtggtatgtgatctccgtgacatcaactcctggaaaggtgtgaactcagttaaaacaagggatcttttttatgtcatagaggcttttttttctttcttttccctttcgttaatagaatatttttcaggtacataaagctgttgatgcttgcaagagtgtgctcagggggttgcatagcaaccaaatttctccaagggagcttgacagggtatgtactgctaaacctttttcttctttttgaagtgggggtgggagttgagtgacatcaggttgacataatgggaaagaataggacatggaagcatatttgtgttgtcaaatgcctgagcatcgtagttccaatatgtagtccatatggtttaaaaaatcaatttttttttaaaaaaataaatatttatttgatatgactttccactattttgttatgttttatccgttttgtatatttataattttattacattatgcactcttgtttcatttagcaatgtcgctggctcactgc

SEQ ID NO: 1062 - DNA, 1714 bp, Kochia scoparia
gaagagtgggatcatggagatctcaaatgaggtagagagagaccgtaaatgaaaatgatttggttggaaggagttaggaaagatatgacgcatatggatttgttagagaagttgttcgtaggagatgaattaggaaaacttacgctgaataatcaccttttgttcatgtaatcaaccgcatttatggatcaaggctttgattgattcactgatttacttcgctaaaaatgcttgtattggcaacttcaaagttatttcttggaagggtgacttgatttcactttttccctcctctctatcaagctattcacatttcaatgattgaggaagctgtgcgtgactaggaacaagatttaaattggtttgtaaatgcaagtagcccgtccgtgtaacactgtaactagtcatttagtttgtaatttgtattatcttctttcactgtcatataaatggtggctgtgttcttacttcctagtgtgatgcttgtgatggtttccatcttccaggtagaggacacattacaagtgtaatttaggttcatgtcaattttgcttgtgaaatgagttcatttacaggccgttgtcctgtagttttacattctcttctgccgtcttttttctactaagaagtatataaggctacacgcatgcaattctaatgttcactgtcatcttagatttgaagcgcatatggaagttcatgctggatcaattgacgaggaggacgatgagcagggaattgcacacatgattgaacatgttgcatttcttggtagtaagaagcgtgagaagttgcttggtacaggagcaaggtctaatgcttatacagatttccaccacacagtctttcatattcattctccaactcgtgcaaaggtttgttgcttttgaccgacattgctgtctgattatgttatagttaagtgcaatgttatttcagatccttttctgtttgaaatgttgaatctcaaatatgaagcagtttgttgcagtactttgattaatcccacttaagtaattaaggcttatcaatatactatttaaggcttactaacttatatatgcaagtacataatatgcacatgtactaactacatttatatggtattgttaggattctgacggtgaccttctcccatttgttctcgatgctttaaatgaggtaattatgacattaatgcaaaaattgtcgactccaaattatataattttcagtcttttagcaactttgtgtggtattatttatagattaagttcaaatttgtgtcttttatgcagatagctttccacccaaaatttcttgcatcgagagttgaaaaggaaaggcgggcaatattgtctgaacttcagatgatgaatacaatagaataccgcgttgattgccaggtgtgttgcgggtggtggctgatgttaagatgctttctgtttccaagtacttgtgggttttgttgcaaaatattacaaatttgatgtgtatatttatttcattctatgcagctgctgcaacatttgcattcagagaataaattgagtagtaggtttcctataggattagaggagcagatcaagaaatgggatgttgataaaataaaaaaattccatgagcggtggtattttccagctaatgctactttgtatattgttggggatatcgaaaatatctcaaagacaattcaccaaatagaggtaggctaatgaattaatcggttgtcttt

SEQ ID NO: 1063 - DNA, 2050 bp, Kochia scoparia
actctttgtcaacttctaaatttgttttgcttactttctttacaatttcacattctcttgtgattttgcaggttcccgtgaatagagttcagacgtatggtgatctacggaatgtactaatgaagaggattgttctatctgccttgcatttcaggattaacacccgatacaaggtgcacgcattaatctaaaaacaattagctgtttaacttttcttgtgtatgcttcctgttctttaaatttctatgcttctgaaataattatacagctgctgtgctggcatgtgagttcagtatgctatacgagtggtgcatttgccatgctctttaacaatggtatactgcatcaaacaaagccttttttttaatgaagtataatgtgtttgccattctctttaacaatgtatactgcatcaaacaaagccctttttttttaatgaagtataatttgtttgccattctctttaacaatggtattctttttgaaaatttcaatcaagcttttgcttctgatgcatcctgcatgatttggtcctactgtgcttctctttgtttgtgactgtctagtcaaagtcatattttgaattgtatctattcttggctagtgtttatgctatagttttgcttggaagaagttgctagtgccttttcgtttgcttttacttttctcatacctcagctactcaatggaacaattacagagttcaaatccccctttcaccgcgatcgagttggatcacagtgattctggaagagaaggttgcaccgtgaccactcttactgttacagcagaacctaaaaattggcaagatgcgatcaaagttgcagttcaggaggtctgtactttgtttgtcaagtttaactgtgcaatcatgtttctaattctttggtgaattgaattctaagatgttgatcaataatagtagctttctgattgcaggttcgaaggctgaaagaattcggtgtgacaaagggtgaattagctcgttatagggatgctttgttgaaagatagtgaacatttggcagcaatgatagacaatgttccatccgtggataatctggattttattatggagagcgaggcactaggacacaaagtgatggaccagttacaaggtcatgagagtttggtagctgtggctggaaccattacccttgaagaggtatttttgtttgttttacctcatatgttgagggtctatggtgaatcttcatacatttatatatatacctcctctgttctttttactcgcaccattgtagagttgcacgggatttaagtaaggaagaaagagagtgtagtggcccccaactatgcaattaaatagcattatattggagagaccgagaagaaaatatattaatcaaatctaaataggagagatacattatttaattatatacataggggtgataaagtaaactggggctatggtcacataccaaattgggtaatggtgcgagtaagaagaacagtggaattattaagaaaaagtattagacttgataaaaacataaaggtgagaatttaaagggagcttgtatgagtgggaccaatacaataattttggaccacaaaatagtcatcgtcttacttcgaatttctggcggatctgtcaccatcattgactaccaatgtgctcatttccatgctcttgttcacactgatacagacatgaggagcacacgtgaaatgaatttatataggtaacattacaattagaaggggctgtttggtatgggggtaacaagaaaaggaaatggaatgaagaagagcttttcccttagttgtagtttagttagcatttttggaaatccctttctcccatttcgagtttgaaatgaccagaaatccctttatcattattccccaccttaatccctctactctataacccatgttaaccaacatcctttggaaataaaaataaaaatagataaagagagatagagaaaggggagagagatttatacacaattacacacacctttacatacttacatagcttaaattaggattatatcaactttaatctatagtttttatgg

SEQ ID NO: 1064 - DNA, 1488 bp, Kochia scoparia
  unsure (1)..(1488): unsure at all n locations
gaagagtgctaatacaattgttgcattnattccgttacggagggagtatttgttttttgctagtccagtgacctgtatttttctgattgatgattttattctttgggtaaagagacactgtaggtctgtagctttccctatagtgagtcttttgaaaagtattgttttgagaggaatgggtagattaaatctcatcccacagaacatatttccaacaacaaaatttacatgggatccaagatttcaagcctttgctttaagctcattatgttgattgattcgaatttctgaaatttgtcttttttttttgaacttttaacttaatttttaattcgtcctcattacatgttttatatgtgtgtgtgtgtctgtgtgtgtttaggtgaggcaactccgtgttcggtgcgatgctgttggtccagaagaaccgcatgcagttagcgcaaatttgcaggaaggaacaataggaaaacaggaattggactttcttgatcctgatataagggtagaggtggaggaatttttgaatactgaacttccacctcaccccaggttataccgaggacaattgaaaaatggactgcgttacatgattttgccaaataaagttccaccaaacaggtacgggccgcctatatcatagggttttactttccctattcatatattgaatgcaagtcttattctgaatgttggataatttttgaagttattattcccttcaagttttaaaacctcagtatacaccatgactgttcaaaactcattttagctacttttttctccgtttcacaaaaaatgcatcagtcaacatttcatgtatgccaagaaattactttgaccctcaataactataattatgaataataaaaaattataacatgttgatattaagatagtatttaacgagacgaatcgaacaagatcccacttgactatactttttattatgtgcaaagctcaaaacttggtcaaagtatataatgtgaatagacgaatactggaaaattttgactgtttcattttttgtgaaaggaggaagtaaaattttttcatgtatttttagttgcataagctaggctcttatatgattgtgttgtgtaagtgattagaatgggacctgggggagtgctttaggtccatggcctttttccatctcttctaaataggatggaaatgacatcctctttggttgattgaggatatttagctgcaagtgatcatgttcgccattcaacgctcctgtgtgattatgtatatatttacttagctaaaaattggattgcatcaagggtcagcgttaagtctttctctttttgcaacggtcctaaatgaagtaacaaggccaattcaaaatgaggtcccttagtgtatgttgtttgcatttgatatcgttttggtggatgaaactaaaatgggttttaatgccaaattggagcaatggaagcaaatgttagtatctagagggtttaagctaagtcttacaat

SEQ ID NO: 1065 - DNA, 955 bp, Kochia scoparia
ggcagtaatttttgtcgttatgcatcattaagacagcagtataaataatacttagtaaaatgactacacacacacacaaacaaaacaaaaaacacacgatcgcacacgtttgtcttctttctcataatggaaagggtctctgttatttggccatgtggggtgtatctgcttgtctatattctatcttttgtaaaggcgcaattttggttttgcttttattgatatcgacttctgctattggtcttgttataaaagtctactacaattcattttaaaaactggtttcaggcgaagaggaccttgttgatgaaacatgaagcagagatgaagtcaaatgcatactggcttgggttgttggcacatttgcaagcagattctgtttcaaggaaggtaaacattcttatatacaagtataccaatttccatcctcttcttcaccagtagctaaagcatagctgtttgatttccttgtaccattctaaataacttgatctctcgtcaggacttatcttgcattaaagacctgactttcctctatgaggctgccactatagaggatgtatatgttgcctatcagcaactgaaggtggatgaagattccttgtactcatgcattggtattgctggagcacatgctggagaagaaatttcaggtgataagatttaggtggtttaatttagttaggactgcttaaagttgttacttgctagatgctacctatttctcacctttacgatgacctatcttttgttctaattttctttctgccttctcttaccaaacttgatgattatatatcaattagtgattcctgttcagtttctcatctgttatggccaccctgctaatggtcttgccttcaatatataatactccctccgtttttatttgattgttccactttttattttggactgtttttaaaatagttgttccaaacctattcaaaataac

SEQ ID NO: 1066 - DNA, 2939 bp, Kochia scoparia
gagtaccaggttttttgcaactcttgttccctaggttgatattgcttttgcttgggtcactgttggtgaattccaattgccatagttgtataatacctcctactattgttgcttgtttgagagtaaacacatatataaatgttggcattttttctttatatgctagcatgttgtgaagtggtttagcccgtttaggagatgtttttgttaaagtcaggtatagttgcatcacaaccaaagttaagagatggatggagggagtgcagcattattttgttgtgcttgctaatttgttatttattttgatgcctcactgactttttgtagcatatgataatgagcttttattctttccttcttacttgcaaattcctattttgtacgaaactttaagaccgttatacattaagtcttatcattttgtaaaggtcaattctattggagctgaagtgctggaatttattgctgattttggaaaaccaactgcccctgctcctgcagcaattgttgcttgtgttcctaaaaaattgcatgttgatggaattggagaaacggatttcaagatatcaccaaatgaggtatctgaagctatcaggtcaggattaaaggaacccattgaggcagaactcgaggtgcaacacttaacagaatattctcataccttttgaaactcagtgtcttgctagtactttttaacttttcttattgattccattattttattggtgtttttcccagcttgaggtgccaaaagatctcattacttcatcacagctacaagaattgaaattgctgcgcaacccattatttaaaccactggatacggaacaaaacagcactaaagcttatgacaatgagacagggatcactcaacgtcgtctatcaaatggtatcccagtaaactacaaggtatagctttaccctgtcatgtttcatttagcatccccgaaaagattgttccatttcatttcttctacttgattctatttcaacgtcgtctgaattggtgttgtattattgtatgttgggtaagaaagtaatggagaggatgatggaggctgtggtgcattaaaaaaatttggagaaaactttatggaacaaaccaaaaagaaaagtggcggcgatattttagagatggtgggaatagcctttcaatgtttcttatgtacttgctactttgcacttttcacaaagaccaaggaaatatgtgggctccactaaatagtacatgaatgatgagataaaaaggaattaatgggttactttatggggtttatgataggaaaaaaacaaaagatgagggtacaatggtaaaaaagtgaatgggaccacacaccaaaataggaaatgtagcaagtaattagagacaaccaaataaggaaaatgtagcaagtaaaaaaagacggaggggagggagtactacagagtacaggcatcttgattcagtgtatcttggcttgcttcttgttggatctactgctaacactgttggtcattgggttttgtcagtttgtcacatgatggcttgggttgcgtatgggttgttcatatttccttgtcatagaaatcaagcatctctcactgttttaaaattaccaatctttcataatgttggaatttatagtgttagcgatttttttcttccacatgttccccaaagaataggcattcactcgtgagtaaagcgaaatttcaacaagttgcgtagcgtagttactttgcttttgtattatgttcaaacaaagtcatcatggtcaaaagcaagaggagaagaatgatgtattttcaaagggaactcattatctaaagttgtttgatgtgaggacttgttattctgtaaatccttttctcatctctacattttaaaaatttcttccatcaccctgctctgtttcatgttggatcaatagcctctgcatttactgcttttttaaccttttaacttttgaattcaaattcattgtagatttcaagacatgaaagccagagtggtgtcatgaggcttatagttggcggtggacgagctgtggagagttcagacgaaaaaggatctgttgttgttggtgttcggactctcagtgagggtggccgtgttggcaacttttctagagaacaggtaatgtccatctagtattgtactattgaaacttgaagggcacgatttttttgggtacttggatctgttgttgtcttttaaaaacttgcttaaacctacggggtaattaaagacatagcaaagagaatgaaggtggtgatagaggagcatatgtagtgggggtgtgaggagggaggggatattattccccctgcttgagggtaacagtttccctagggagggggtgaataactatctattccatctacctcatttcaaggtgattttttccccctctttccctcctcacacgaccgttagctcaacgctgcatccccttcattgccacccccacctatcctcattttccttattatatttcctattaccccatattacactagatcacagtaaatttatattccatttctagcccctcttgtcacatactttttaaatctgttggtctatagtgtgtaaatgttactctaatgttaaagatgcttctggcaggtagaactcttctgtgtgaaccatttgataaattgctctctggaatccactgaggagtttatatgcatggagttccgttttacgttgagagacaatggaatgcgagctgctttccagttactgcacatggttcttgaggtacttattaaagttcatgatcatcaattctgatttccttctttgacatttactgcctggttttaaagcttgctttccttttccaagagtgtttaattgtttactttgaacatgaatctagattggttaatgcaacgttgattcatctagacctgtccaggccttgttattgggcagtcccatattggtggca

SEQ ID NO: 1067 - DNA, 358 bp, Lolium arundinaceum
accgatttctgcaactaatttacttgcttctataagcgcagttccttaatcatgctgcccatggctaactattgctttccattgtttgacagatccccgtcaaccaagttcagacatacaaagacctgcgcagtgtcctgatgaaacggatatttttatctgctctgcattttcgaatcaatacaagatacaaggtttgtgattttgagaaacattcatgatctgatgtcctatggacactattttcaaatcttatagatgttattttccatttttgttgttgcatgagaatcttgtttttttttggtttgtaactttatatccttatataattagagcgcttcacattttcatattt

SEQ ID NO: 1068 - DNA, 294 bp, Lolium arundinaceum
ccgagcaaggtatttaagttgtgatcttgagcttttttttctgtgctcttctgctgctaatactatcattttgtgatctttgatgacaggtccataaagctgtggatgcatgcaaaggtgttctcagaggtttacatagtaacaaaattgttgaaagagagctggaccgggttagtcaaattttcttgatattttgcattaatgtgctttaatattactattgtaccgaccaatatgcaattcttttgacaaagggaatatattaatatcaagagataccaattacacctagcc

SEQ ID NO: 1069 - DNA, 464 bp, Lolium arundinaceum
gtgtaaagcaaagaagcaaagggatagttacattacaatcctcatgctgaagcattgtgggaaaaaagacacatggacattttgatactttcctgaacatgtgtttgagtctgaaagctcagattgttctgtcgtccataatctagacataatttggctgcggattcttctttgccaggtatacataaaggatacagatgagagagcttgtgcgtacattgctggaccggcacctaatcgatgggggttttctaccgaaggaaaggacctctttaatgtaattcgaagttctagcgcaaatggtaattcttacttaatactctgtgctgtgtgctgtactctctcacatgagtcccatgtccgactccatcgcagtttatattaacatatcttgagttggacatgattcttttttctgtttgaggaattcctacacatcatctatcaatgaccttgtgtagtag

SEQ ID NO: 1070 - DNA, 428 bp, Lolium arundinaceum
gcagttgcagaaactgtcatgcttgaagaggtactacatcatgtcattatcatttctcttgcaaaggccatactcaaaataaatgacatcattgcattttaccttctgctagttttacaaaggccacacattttaccatatgtaggttaacactgttggcgcagaagtacttgaatttatttctgactttggaaaacccaatgcaccacttcctgctgctattgtggcctgtgtaccaagaaaggtccatattgatggagtaggcgaaagtgattttgagatacatccagaagagataactgagtccatgaaggcaggtcttgaagaacccatttacccggagcctgaggtatgttggttatttgtgatgtctttttcgtgttatggaactatactaacttggcttagcaaagttcatgcttgaattt

SEQ ID NO: 1071 - DNA, 1053 bp, Lolium arundinaceum
gaagtcttccttttccttctttgatgcagagctcaaatcctccctttacatcagttgagctggatcacagcggctctggaagggaagggtgcacggtgaccactctaacagtaacagctgaaccccaaaattggaggagtgctatcaaagttgctgttcatgaggtttgtgctttcatggctcagttatcctgtatgtattacatatatcgttttagctggctgtattgtgtcattcgaaatatggaccaattatctagataacatgatcctcgaatcagttcagtactaatatataattatctattgccaatgtaagtgtcgacttagcacgtacgtgaagacctattgccctatttggccacaaggaatgatttatgaacatcaattgttcaaaagattagatgataaggaattgaacggaagatattacagcaagattgtcctagcatgagcccttcctaagtcaagcctagcctggtctgaactgtctagcgtctactattccagtctaatatggcatccaagcccgaatctaggccaatccagccctagtgtgagctggaaccaaccctagctgattcaggtttgacattaacctaggtcaaatccaggccaagcttgaactctagccaactagccggttcattgcaagtgttcaattcctgtttaccaacttttccttatgttgttttaggttcgaagactcaaagagtttggtgtcacaatgggagaaatgacccgttatatggatgcactaataaaagatagtgagcagctcgctatgatgattgatagtgttccctcggttgacaacttggacttcattatggagagtgatgcacttggccatactgtcatggatcagttgcagggacatgaaagtttgcttgcagttgcagaaactgtcacgcttgaagaggtactgcattatgtcattatcatttctcttacaaatgccatactcaaaataaatgacatcattgcattttaccttctgctagttttacaaaggccacacattttaccatatgtaggttaacactgttggcgc

SEQ ID NO: 1072 - DNA, 258 bp, Lolium arundinaceum
aagttttcttcatctcgtgtcgagaaagagagaagagcaattctgtcagagctccagatgatgaacacaatcgagtaccgtgttgattgtcaggcaagtctttttcccagtgttaccacttgagaaaaattccgagaagggatattattttaatattcctggaacagtgctgaatcatttaatattccagggcactatctttctgtactaattgtggctcctatgctgcagttgttgcaacatttacactcggaaaac

SEQ ID NO: 1073 - DNA, 412 bp, Lolium arundinaceum
tatgaaatatgtgcactatggacttctaactatttgagtttgcaggtttgaggctcacatggaagttcatgttggatcaattgacgaggaagaggatgagcagggaattgcacatatgattgagcatgttgcattccttgggagtaaaaagcgcgagaaactcttggggacaggtgcaaggtctaatgcatatacagacttccaccatacagtcttccatatccattctccaactaaaacaaaggtccttattttgcttattttctcaatatcaattttggaattagacattaactcctggtgatttgttcgatgccttcttttgttttctgtttgcatattttatttgggtttcaactctagcctaccccaacttgtttgggactgaaaggcttggttgttgttgttgttg

SEQ ID NO: 1074 - DNA, 550 bp, Lolium arundinaceum
ctacataacatactcacctgtctcaccataggaaaacctaagttttctctgaaacatgaggttgcatttacacaatttacttatttgtgttacagcataatgtgtggctagaagatgccttcgatagagcagctcagttatatttgtcttactaccgctctatccccaaaagtttggagcgtgccacggctcacaagcttatggtagccatgttgaaccatgatgaaaggtttgtagagccatctccacattcattgcaaaagctgactcttcagtcagttaaagaagccgtcatgaaccagttcgtgggtagcaacatggaggtttgttgaatagtttgtcatttctgagtttccgttctctaaaccttgtttgaacatttcttcttaaccatgttcaagtttaatgttgattttttttacaggtcagcgtagttggtgatttcacagaagaagaggtagaatcttgtgttctcgattatctcggggctgtgagggccgcaaattcttcaaacaccaaggaacatattgagaagatctcattcttgccg

SEQ ID NO: 1075 - DNA, 283 bp, Lolium arundinaceum
gtattagtatgtgtaatccaccagtgatgttcacatatcgtctgcatattgtattattaactaatgctgataattgtttaacatttcatatgatctgcatatgatttttatttcaggttgaacttttctgtgtcaacaatctcataaattgctcgctggaatccaacgaggagttcatctttatggaatttaggtttgccttaagagataatggcatgcgtgctgctttccagctcctgcatatggtccttgaggtgtgggttttcagcttactacataacat

SEQ ID NO: 1076 - DNA, 529 bp, Lolium arundinaceum
gatgaacacaatcgagtaccgtgttgattgtcaggcaagtctttttcccagttagaaaaattccaagaagggatattattttaatattcctggaacagtgctgaatcattttatattccagggcactatctttctgtactaattgtggctcctatgctgcagttgttgcaacatttacactcggaaaacaaattgagcaacagatttcctattggacttgaggaacaaatacttaaatgggatcctgataagatccgcagattccatgagagatggtattaccctgctaatgccactttatacctggtaggagaaattgatgatattcccagagcagtgcgggagatagaggtaatcagaaattacatcctactaaacattgttgttgatagattagctgatgccagtatattaagtagcaggcttgttagctgacccatcacaatgcaggctgtgtttgaacatacacttactggaaacgaagtaggccctatgtcgactgcaggtccatttggggccatatcaagcc

SEQ ID NO: 1077 - DNA, 467 bp, Lolium arundinaceum
cgtatgaaataataccaatatggctaggaccggtctatttggattccagggctgtacaaaaaattttgaacagcagtcagcatattgtgtacctactaccttctaatgtatgatcacacgttaaatctctacaaattgtattttcccatatattattattagttattggaactcaacccatatcgtatccttcattagtatttttgtactattattttgcgcacttgtgttgttttctcttcctgtgttgtatcactgtcttactgtagttcatttgttccaattaaatgcaggatatatcctgtattaaggaaatgacgacactatatgaaagtgccacaattgaggacttgtatctcgcatatgagcacttgaaagttgatgattcatctttattttcctgcattgggattgctggtgccgagtctggtgaagacatgaatggtacgggaccagaatattaagtg

SEQ ID NO: 1078 - DNA, 306 bp, Lolium arundinaceum
actgtactgttctaatatgtacacttgactattggacattatgtagcatcatcattttctacttgttaatttgataagcaattttcttgtgtttcaggcaaagaggacattgctgatgaaacacgaggctgagacaaagacaaatgcctattggcttggtctgctagcccatctgcagtcttcttccgtgcctaggaaggtaaattctatatatgagggttataagcgcgcatattctgtagaaaattggaaaaggaaatggactggctctccattctagccctggttgccagggcacttggttgc

SEQ ID NO: 1079 - DNA, 202 bp, Lolium arundinaceum
cgagattccatgggattaacctatgatgtttcttttgaattaaatctttttgacaaactggagctgggttggtatgtgatcgcggtaacttcaaccccgagcaaggtatttaagttgtgatcttgagcttgttgttctgtgctcttccgctgctaatactatcattttgtgatctttgatgccaggtccataaagctgtgga

SEQ ID NO: 1080 - DNA, 278 bp, Lolium arundinaceum
cgaaccacatgttgcaagtccaacatggtctgaggcagctctcgataaaccttatcttgatgaagcgattggaaacgaggagcttgaagctgtcctggacacacctcttccttcccatccaaagctaatacggggtcaattgaagaatggcctcagatatcttattttaccaaacaaagttccagctgataggtgacggaacttcttttcacctccatatattgcacttttggctaaagtacttccataattttcttttgctgaaacgaaattatcta

SEQ ID NO: 1081 - DNA, 349 bp, Lolium arundinaceum
atactaacttggcttagcaaagttcatgcttagatttttgttttcatgccactgaaaactgtaaagcgacatattattgatgttgttgtgctggttgcagcttgaggtgccaaaggaattgattactcaatcagaacttgaagacttgaaattgcaacaccaaccatcatttgcccctttcggtaaagagcaggacgtggtgaaagtatttgacagtgaaactggtataacacagcgccgcctttccaatggaatttctgtcaactacaaggtacttagtcaactggaacctcaggctattttttttaaagacaaaataattatcttcacttcagtagccattctggat

SEQ ID NO: 1082 - DNA, 570 bp, Lolium multiflorum
ctgggttggtatgtgatcgcggtaacttcaaccccgagcaaggtccataaagctgtggatgcatgcaaaggtgttctcagaggtttacatagtaacaaaattgttgaaagagagctggaccgggcaaagggacattgctgatgaaacacgaggctgagacaaagacaaatgcttattggcttggtctgctagcccatctgcagtcctcttccgtgcctaggaaggatatatcctgtattaaggaaatgacgaccctatatgaaagtgccacaattgaggacttgtatctcgcatatgagcacttgaaagttgatgattcatctttattttcctgcatcgggatcgctggtgccgagtctggtgaagacatgaatgatgatgagcctgatatgggggttcctggtatggttcccattggcggccggggtctatcaaccatgaccagaccaaccacatgagtagtacactttttcacaccccaactttctcaaggcatcaacctagctcctgaagagaggatctgtatgtgaccctgtggagactacatatgatgattgtataagtactccc

SEQ ID NO: 1083 - DNA, 712 bp, Lolium multiflorum
gggttggtgttatgcgcctgatagtaggtggtgggagagccactgaagattctgagtcgaagggatctgttattgttggtgtacgtactttgagtgaaggtggctgtgttggtaacttctcaagggaacaggttgaacttttctgtgtgaacaatctcataaattgctcgctggaatccaacgaggagttcatctttatggaatttaggtttgccttaagagataatggcatgcgtgctgctttccaactcctgcatatggtccttgagcataatgtgtggctagaagatgcgttcgatagagcagctcagttatatttgtcttactaccgctctatccccaaaagtttggagcgtgccacggctcacaagcttatggtagccatgttgaaccatgatgaaaggtttgtagagccatctccacattcattgcaaaagctgactcttcagtcagttaaagaagccgtcatgaaccaattcgtgggtagcaacatggaggtcagcgtagttggtgatttcacagaagaagaggtagaatcttgtgttctcgattatctcgggactgtgagggccgcaaattcttcaagcaccgcggaacatattgagaagatctcattcttgccgtttccatcggatctgcattcccagcaagtatacataaaggatacagatgagagagcttgtgcgtacattgctggcccagcacctaatcg

SEQ ID NO: 1084 - DNA, 520 bp, Lolium multiflorum
cgtactttgagtgaaggtggctgtgttggtaacttctcaagggaacaggtatcttccacattctatgatcaacatttaaaacatacacgtattgcaagattacactgtctattctgctaatgtagttctagccccaaattcttgttcattaaaaaaatttactactccctctggccccaattacttgttgcatcccatatacaatcaagcatgcagttgaactgcagttaattggggccagagggagtaataaatttgaagttactgttgtttttactaattgcatacaccatttcactttatccttccaattcattcccactggcccctgtgttagtatgtgtaatccaccagtgatgttcacatatcgtctgcatattgtattattaactaatgctgataattgtttaacatttcacacgatctgcatatgatttttatttcaggttgaacttttctgtgtgaacaatctcataaattgctcgctggaatccaacgaggagttcatctttatggaatt

SEQ ID NO: 1085 - DNA, 560 bp, Lolium multiflorum
gtgtggcttttcagcttactacagaacatactcacctgtctcaccataggaaaaactctctgaaacatgaggttgcatttacacaatttacttctttgtgtcacagcataatgtgtggctagaagatgcgtttgatagagcagctcagttatatttgtcttactaccgctctatccccaaaagtttggagcgtgccacggctcacaagcttatggtagccatgttgaaccatgatgaaaggtttgtagagccatctccacattcattgcaaaagctgactcttcagtcagttaaagaagccgtcatgaaccaattcgtgggtagcaacatggaggtttgttgaatagtttgtcatttctgagtttccattctctaaacctctcttaaccatgttcaagtttaatgttgatttttttacaggtcagcgtagttggtgatttcacagaagaagaggtagaatcttgtgttcttgattatcttgggactgtgagggctgcaaattcttcaaacacggcggagcatattgagaagatctccttcttgccgtttccatcggatct

SEQ ID NO: 1086 - DNA, 367 bp, Lolium multiflorum
gtgtgttgatcagcactcataatatggtgtagatgtatttttatatcaaatttcgtagttttatccactttttgtttatttatttgtaatttgttatgttagcagacgatgagcctgatatgggggttcctggtatggttcacattggaggccggggtctatcaaccatgaccagaccaaccacatgagtagtacattttttgacgccccaactttctcaaggtatgttacaacttttgaacaaagtgtgctgtattaagtgctctacatacattacttttccaatcgtgcagatttctgttctaatttcagtatattacaccacaggcatcaacctagctcctgaagagaggatctgtatgtgacc

SEQ ID NO: 1087 - DNA, 262 bp, Lolium multiflorum
gaggagttcatctttatggaatttaggtttgccttaagagataatggcatgcgtgctgctttccaactcctgcatatggtccttgaggtgtggcttttcagcttactacatagcatactcacctgtctcaccaaggactctctgaaacatgaggttgcatttacacaatttacttctttgtgttacagcataatgtgtggctagaagatgcgttcgatagagcagctcagttatatttgtcttactaccgctctatccccaa

SEQ ID NO: 1088 - DNA, 241 bp, Lolium multiflorum
tacttcatgattttcagtacattgcatatttttgttggtctttacctaataggactaacgtgatgagatgcacctttttctctcaggctattcacaacagtacgagattccatgggattaacctatgatgtttcttttgaattaaatctttttgacaaactggagctgggttggtatgtgatcgcggtaacttcaaccccgagcaaggtatttaagttgtgatcttgagcttgttgttctg

SEQ ID NO: 1089 - DNA, 445 bp, Lolium multiflorum
ttcatggcttgtgtaaagcaaagaagcaatgggatagttacattacaatcctcgtgctgaagcattgtgggaaaaaagacacatggacattttgatactttcctgaaaattttgagtctgaaagctcagattgttctgtcgtccataatctagacataatttggctgcggattcttctttgccaggtatacataaaggatacagatgagagagcttgtgcgtacattgctggcccggcacctaatcgatgggggtttgctactgaaggaaaggacctctttaatgtaattcgaagttctagcgcaaatggtaattctaacttaatactctgtgctgtgtgctgcactctcacatgagtcccatgtccgactccattgcagtttatattaacatattttgagttagacatgattttatttctatttgaggaattcctacacatcat

SEQ ID NO: 1090 - DNA, 750 bp, Lolium multiflorum
atctctataaattgtattttacccatttatcagttattggaattcaacccacatcttattcttcattagtatttttggactattattttgtgcatctgtgttattttctcttcctgtgttgtatcactgtctaactgtagttcatttgttccaattacatgcaggatatatcctgtattaaggaaatgacgaccctatatgaaagtgccacaattgaggacctgtatctcgcatatgagcacttgaaagttgatgattcatctttattttcctgcatcgggatcgctggtgccgagtctggtgaagacatgaatggtacgggaccagaatattaagtgctcgtgatgaaaattattacataagtatctcagtatattgttaatttgaaatttaatgtgtgtgctgatcagcactcgcaatatggtgtagatgtattttttaaatcaaatttcgcagttttatccaatttttctttatttatttgttatgttggcagatgatgagcctaatatgggggttcctggtatggttcccattggcggccggggtctatcaaccatgaccagaccaaccacatgagtagtacactttttcacaccccaactttctcaaggtatcttagaatttttggacaaaagtgtgctatattaagtgctctacattcaatagttttccaatcgtgcagatttctgttctaattcagttaaatccacaccacaggcatcaccctagctcctgaagagaggatct

SEQ ID NO: 1091 - DNA, 899 bp, Lolium multiflorum
ttgtgatcttgagcttgttgttctgtgctcttccgctgctaatactatcattttgtgatctttgatgccaggtccataaagctgtggatgcatgcaaaggtgttctcagaggtttacatagtaacaaaattgttgaaagagagctggaccgggttagtcaatttttctttatattttgcattatgtgctttaatattactattataccggctagtatgcaaataatactgccatcctttttaatcatgacagttagtttagtttaagaaaaccgtgcattttgaagtattgcacatcttgtttagttcatgcacttaagctgaatacgcatcttggaaaaattttatgtgcttgtcgattgaataccaagctcaaagctttaagcataactgtactgttctaatgtgtacacttgactattggacattatgtagcatcatcattttctacttgttaatttggtaagcatttttcttgtgtttaggcaaagagaacattgctgatgaaacacgaggctgagacaaagacaaatgcttattggcttggtctgctagcccatctgcagtcctcttccgtgcctaggaaggtaaattctatatatgtgtgttactagtacaatacccatgcttcgccacggaaccaccaataacattatcatgaaggaactgttgatgggggagatgaggaggtagggtgggaattgcaattctgtgcattcttactttctctacccgtaatttgagccaagccacccgatacatccaccgagatacacaataataaagcagctatttatcatcggcatgatctgcatcaaattcaatgctagtgcagcaactcctttgtactccaccgtcttcttcaacggaccacttattggataattaaaatcacacagt

SEQ ID NO: 1092 - DNA, 1673 bp, Lolium rigidum
tagacgcatttcaatgtgtaggttcgcttattttggaaaaaaagctgtaaccaatttggaaaggagggagtatatgatttggttgacacttggtacttgggagcttgggaccatctgagcttaccatgctgtagcattcagttggttaatcaagtaattttactgaattaagtacatctaaaccttgtgcttttctgattttgtacccacgcttctggagggccttaattgaatggaaactgtaaatacatatatgaaataatactgatatggctaggaccggtctatttgggttctagggctgtacaaaaaatttaaacagcagtcagcgtattgtgtaccttctaatgtatgatcacatgttaaatctctataaattgtatttttcccatttatcagttattggaattcaacccatatcttattcttcattagtatttttggacttttattttgcgcgtttgtgttattttctcttcctgtgttgtatcactgtctaactgtagttcatttgttccaattacatgcaggatatatcctgtattaaggaaatgacgaccctatatgaaagtgccacaattgaggacctgtatctcgcatatgagcacttgaaagttgatgattcatctttattttcctgcatcgggatcgctggtgccgagtctggtgaagacatgaatggtacgggaccgaatattaagtgttcgtgatgaaaattattacataaatatctcagtatattgttaatttgaaaattaatgtttgtgctgatcagaactcgcaatatggtgtagatgtattttttaaatcaaatttcgcagttttgtccaatttttctttctttatttgttatgttggcagatgatgagcctgatatggcggttcctggtatggttcccattggcggccggggtctatcaaccatgaccagaccaaccacatgagtagtacactttttcacaccccaactttctcaaggtatcttacaatttttggacaaaagtgtgtatattaagtgctctacattcaatagttttccaatcgtgcagatttctgttctaattcagttaaacccacaccacaggcatcaacctagctcctgaagagaggatctgtatgtgaccctgtggagactacatatgatgattgtatatgcaagtactccctatacccatcaatgcatttggtcaagccaattgttattccttgagcaattgcaacagaaagctttggttgttgcattttctagaaaaatagatatgaatgttcccaaggaacttgaaagccttccctggaaggccattttcagatgtatagtaaagaccgatttgattcatgcacattcccgttgttgtaactagtagtattcttcaggtcattgcagaagatagagtgaccataggatcgatgataagttactgagcaacggcaaagtagcatagagcatctgtaacacaatagtaataatatcatacgcttgtaacattctgttatctttgtctgatagtgtgaacttgataatgaaatggatacaattttgctgagaatgttggattgaattgcattctggaccagctaatgctatataagttgcaacctgtaccatctatgctcaaagctatttacattcaaatcatgcaacctgacttgatgaatacaggagagagctgctg

SEQ ID NO: 1093 - DNA, 1982 bp, Lolium rigidum
ccaggtatacataaaggatacagatgagagagcttgtgcgtacattgctggcccggcacctaatcgatgggggtttgctactgaaggaaaggacctctttaatgtaattcgaagttctagcgcaaatggtaattctaacttaatactctgtgctgtgtgctgcactctcacatgagtcccatgtccgactccattgcagtttatattaacatattttgagttagacatcattttatttctacttgaggaattcctacacatcatctatcaatgactttgtgtagtagtgtatgaacacgtggactgatatttgtcctactaccgcagcagaaatctctgaaccagcaaactctgatctaatggagaagacacatattaatgttcgcaaccatcctcttttctttgggatcactttgagtttgctggctgaaattattaattccaggtaaagaatttctgtacattcttttattttttactatacatcattgtaaagctctatcatgcgataaattctactccgctgctaatactatagtgtcatggtgtatttactgtgccatggtacctttggataactaggttacaagtggtttgcttctgcaaaaatcttgatgatgcccctatttattcattttacactattaaagcaacatacttcgttacacatcttactaatgttccatgcctcgttattcttgactaaaagaacctcagttttcactttacactattaaacgagatacttcatgattttcaggacactgcatatttttgttggtctttacctaataggactaacgtgatgagatgcacctttttctctcaggctattcacaacagtacgagattccatgggattaacctatgatgtttcttttgaattaaatctttttgacaaactggagctgggttggtatgtgatcgcggtaacttcaaccccgagcaaggtatttaagttgtgatcttgagcttgttctgtgctctgccgctgctaatactatcattttgtgatctttgatgccaggtccataaagctgtggatgcatgcaaaggtgttctcagaggtttacatagtaacaaaattgttgaaagagagctggaccgggttagtcaaattttctttatattttccattatgtgctttaatattactattataccggccagtatgcaaataatactgccatcctttttaatcatgtctaagttttcataaaagttagtttagttcaagaaaaccgtgcattttgaagtattgcacatcttgtttaaagttcatgcacttaagctgaatacgcatcttggaaaatttttatgtgcttgtcgattgaataccaagctcaaagctttaagcataactgtactgttctaatgtgtacacttgactattggacattatgtagcatcatcattttctacttgttaatttggtaagcatttttcttgtgtttaggcaaagaggacattgctgatgaaacacgaggctgagacaaagacaaatgcttattggcttggtctgctagcccatctgcagtcctcttccgtgcctaggaaggtaaattctatatatgtgtgttataagcgctcatactctgtagaaaattggaaaaggaaatggactttggttgccagggcacttcggttgccttgttcttgtcacactttactatcgttaacactgcataggtactccggctagattttcttcatgaaagttttgtagacaaacttcttgaagcatccatacctgggaccatcctggtgacagttattctcagaaacttctgggttgagaagtttgttgatatagcaaaaaaaatcctaggggttgtcgtatgagcagcagatgaaaaataaatgaaaattttattctatgtatactccacaaggctcaggctgcaattataactacttcctccgttccaaattagttgttgcagctttggtctaggtacacatgtatctagacgcatttcaat

SEQ ID NO: 1094 - DNA, 1897 bp, Lolium rigidum
aggtgttaatttaagttcttgaacatgaaaagtgtaccccagcacatggatcctcagtaaatatggaaccatggttaattcatgtcacacagaaactttggccaagttggaccaagcaaaattactttgatatacatatgaaatatgtgcactatggaattctaactatttgagtttgcaggttcgaggctcacatggaagttcatgttggatcaattgacgaggaagaggatgagcagggaatcgcacatatgattgagcatgtttccttgggagtaaaaagcgcgagagactcttggggacaggtgcaaggtctaatgcatatacagacttccaccatacagtcttccatatccattctccaactaaaacaaaggtccttattttgcttattttctcaatatcaattttggaattggacattaactcctggtgattttttcgaggccatcttttgttttctgtttgcatattttatttgacaaggacttgcatgaaaataaatctggatatgtaccatatacacaacattttctaaaagaactgatggttcatgttagatttcttctcttgtttatctatgatctgacatattagttgggcaggaatacggtgaagccttactcccttctgtgctggatgctttgaatgaggtaagatatttacttaatcgcattattatttagaggaattattataggatgtgtggtgactgtaggccactttttaaaagcatatccaattggttggaggcctgtagcaattacagaccctgtcaactacccactatcattttttttgttaatttacaaccacacattcaaactggtagctaaaatatagatgtgtgctattagtctgtttgacagatctcttgacattattacatagatgtataaacaagttcttcacttcattcccttcagatagcttttcatccgaagttttcttcatctcgtgttgagaaagagagaagagcaattctgtcagagctccagatgatgaacacaatcgagtaccgtgttgattgtcaggcaagtctttttcccagtattaacacttcagaaaaattccaagaagggatattattttaatattcctggaacagtgctgaatcatttaatacttcagggcactatctttctgtactaattgtggctcctatgctgcagttgttgcaacatttacactcggaaaacaaattgagcaacagatttcctattggacttgaggagcaaatacttaaatgggatcctgataagatccgcaagttccatgagagatggtattaccctgcgaatgccactttatacctggtaggagaaattgatgatattcccagagcagtgcgggagatagaggtaattagaaattacatcctactaaacattgttgttgatagattagctgatgccagtatgattaagtagcaggcttgttagctgacccatcacaatgcaggctgtgtttgaacatacacttactggaaacgaagcagcccctatgtcgactgcaggtccgtttggggccatatcaagcctgtttgccccaaagctgccaggtagcttggctgcaagcctaagtggtgacagatcacctgccacagataaaataaaacctgtaaaaagggaaagacaggcagttagacctcccgtagagcataaatggtctcttcctgatgttcatcaagatgctaagcctccagtgatttttcagcatgagttaattcagagtttctctatcaacatgttttgtaaggtatggtttgctgctagtcgacttaatttatgttttgcaccttcgtgactagtttacccactaaaatgttaattctgatagtagttcatattataatagttggtagataaagaggccatatcagcattgctgtaatgca

SEQ ID NO: 1095 - DNA, 2963 bp, Lolium rigidum
atgaacatcaattgttgaaaagatcagatgataaacaaggaatgatttatgaacatcaattgttgaaaagattagatgataaggaactgaacagaagatattacagcaagattgtcctagcatgagcccttcctatgtcaagcctagcctggtctgaactgtctagcctctactattccagtctaatatggcatctaagctcgaatctaggccatggttttgaaggcgtcgcttaggcgtccaagcgctccccctctgccttgaaaaaaacgaccgcttcaggcgtcagagcccccctgcgccttcgctctaagacgccttaacgccttcaaaaccatgatctaggccaatccagccccagtgtgagctggaacaaaccgtagctgattcaggtttgacattaacctaggtcaaatccaggccaagcttgaactctagccaactagccggttcattgcaactttgcaagtgttcaattcctgtttactaacttttccttatgttgttttaggttcgaagactcaaagagtttggtgtcacaatgggagaaatgacccgttatatggatgcactaataaaagatagtgagcagctcgctatgatgattgatagtgttccctcggttgacaacttggacttcattatggagagtgatgcacttggccatactgtcatggatcaattgcagggacatgaaagtttgcttgcagttgcagaaactgtcacgcttgaagaggtactacatcatgtcattatcatttctcttgcaaaggccatactcaaaataaatgacatcagtgcattttaccttctgctagtttttaatgacattgtaataaatacattttaccatatgcaggttaacactgttggcgcagaagtacttgaatttatttctgactttggaaaacccaatgcaccacttcctgctgctattgtggcctgtgtaccaagaaaggtccatattgatggagtaggcgaaagtgattttgagatacatccagaagagataaccgagtccatgaaggcgggtcttgaagaacccatttacccggagcctgaggtatgttggttatttttgatgtctttttcatgttataaaactatactaacctggcttagcaaggttcatgcttgaatttgttttcgtgccactgaaaactgtaaagcggcattttattgattgttgttgtgctgttgcagcttgaggtgccaaaggaattgattactcaatcagaacttgaagacttgaaattgcaacaccaaccatcatttgcccctttcggtaaagagcaggacgtggtgaaagtatttgacagtgaaactggtataacacagcgccgcctttccaatggaatttctgtcaactacaaggtacttagtcaactggaaccttaggctattttttttgaagacaaaataattatcttcacttcagtagccattctggatagtttagcttttctttcatgtttcatactaaaaacataataattattgatgacagatcacacaaaatgaggcaagggttggtgttatgcgcctgatagtaggtggtgggagagccactgaagattctgagtcgaagggatctgttattgttggtgtacgtactttgagtgaaggtggctgtgttggtaacttctcaagggaacaggtatcttccacattctatgatcaacatttaaaacagacgtattgcaagattacctcgtctattctgctaatgtagttctagccccaaattcttgttcattaaaaaaatttactactccctctggccccaattacttgtcgcatcccatatacaatcaagcatgcagttgaactgcagttaattggggccagagggagtaataaatttgaagttactgttgtttttacgtattgcatacaccatttcactttatccttccaattcattcccactggcccctgtattagtatgtgtaatccaccagtgatgttcacatatcgtctgcatattgtattattaactaatgctgataattgtttaacatttcatacgatctgcatatgatttttatttcaggttgaacttttctgtgtgaacaatctcataaattgctcgctggaatccaacgaggagttcatctttatggaatttaggtttgccttaagagataatggcatgcgtgctgctttccaactcctgcatatggtccttgaggtgtggcttttcagcttactacatagcatactcacctgtctcaccataggaaaaactctctgaaacatgaggttgcatttacacaatttacttctttgtgttacagcataatgtgtggctagaagatgcgttcgatagagcagctcagttatatttgtcttactaccgctctatccccaaaagtttggagcgtgccacggctcacaagcttatggtagccatgttgaaccatgatgaaaggtttgtagagccatctccacattcattgcaaaagctgactcttcagtcagttaaagaagccgtcatgaaccaatttgtgggtagcaacatggaggtttgttgaatagtttgtcatttctgagtttccgttctctaaacctcgttctaacatttcttcttaaccttgttcaagtttaatgttgatcttttttacaggtcagcgtagttggtgatttcacagaagaagaggtagaatcttgtgttctcgattatctcgggactgtgagggccgcaaattcttcaagcaccgcggaacatattgagaagatctcattcttgccgtttccatcggatctgcattcccagcaagtatgccttcattaccatcttttgaatattcatggcttgtgtaaagccaaagaagcaaagggatagttacattacaatcctcatgctgaagcattgtgggaaaaaagacacatggacattttgatactttcctgaaaacatgtgtttgagtctgaaagctcagattgttctgtcgtccataatc

SEQ ID NO: 1096 - DNA, 1093 bp, Lolium rigidum
tcatcttataatattggtagataaagaaaccatatcggtattgctgtaatgcatccaccacgtagagtttcatagtccatctatttttgggtaatattgaagtcttatgttaacatggtgcccttaatatggtcttctttaaagaatattttaatataccgatttctgcaactaatttacttgcttctataagcgcagttccttaatcatgctgcccatggctaactattgctttccattgtttgacagatccccgtcaaccaagttcagacatacaaagacctgcgcagtgtcctgatgaaacggatatttttatctgctctgcattttcgaatcaatacaagatacaaggtttgtgattttgagaaacattcatgatctgatgtcctatggacactattttcaaatcttgtagatgttattttccatttttgttgttgtatgagaatcttgtttttttttggtttaactttatatccttatataattagagcgcttcacattttcatatttatgtgtaattgcacatgttattttctcattgttaggagctttgtggctaccagtcttgccatggttcacataaaatgacattttatatgtgaagaggattcatatttgtttttgtctcttagctcaactattagctatttaggatcagttagacttgatattggacttgaatgcgagtcagaatagccaggttctcccagtgaggaatttgcacatgtttgcgcactacatattttacaatggaactggtagttacatggtttctccgactgagcgaagtcttccttttccttctttgatgcagagctcaaatcctccctttacatcagttgagctggatcacagcgactctggaagggaagggtgcacggtgaccactctaacagtaacagctgaaccccaaaattggaggagtgctatcaaagttgctgttcatgaggtttgtgctttcatggctcagttatcctgtatgtattacatatatatatatatcgttttagctggctgtattgcgtcattcgaagtatggaccaattatctagataacatgatccttgaaccagttcagtactaatatata

SEQ ID NO: 1097 - DNA, 209 bp, Portulaca oleracea
tcacatttcctctgcaatatggtgtggaccaggacttaacgtgcataaaagacctgacattcctttacgaagctgcaactattgaggatgtatatattgcatacgagcaattgaaggtggatgagaattccctgtattcttgtattgggattgctggagcacaggccggcgaagaaatttcaggtaaaaggattggatttgattgcctt

SEQ ID NO: 1098 - DNA, 1602 bp, Portulaca oleracea
ggggggggggggggggggctgtggaggcatgctcgtggttgtaacaaaagaaaggaggaactatgtaagctaaaatagctggtttgtgaagtacttaggtaatggtatcctgaattactaccttgtgattgttctattccatatcccttatagtgaaccaaccatctccagttaaatttatttgattgtatgaaaacaaattatatcatttagagaaactgcccgaagaatatcacagatatggcatcttctttcgctgagttctttgttctttcattctctttgcatgttcttctctcactagtaaaatgtccctgcccaactgtgcctctttggtgtctcagccaggacccctgaaccaagttgcatacgtccttgtaggctctagtcctcttcttgtgctcgcatatctaattactttctttgttttccaggtttgaagcccacatggaagttcatgtagggtcgattgacgaggaagatgatgagcaggggattgcgcatatgatcgaacatgttgcatttcttggaagtaagaaacgtgagaaactgcttggtacaggagcacggtctaatgcttacacagacttccaccacacagtttttcacattcattctccaacacatgcgaaggtttgttggtcctattccaatcccgttccttctgctgtatggtcctatggtagaacttccaagctgccgtcagtgttgattaggatttgctagcgttatgctgctttctttctaacccactttttagaggatgtaagcatatttggtaaaactaggacattgggatgaccggacaagcattctggaaaatcatagagaaatatgcagctgcatgacatgtttgtcttaattttgataatgtttatggatgtttataattgactattcaatttttccctggaaagtaaatatttcgaatgagaacaactgaatttgttctgtagacatatgcctgtgttgtaactcaaaactcgatgtaattcgaagtagatattaactcaaatgctttgttggagttaggaatctatataaaactttgcatatcattccgagtaggattcaattttgtgtttcttgccaacctctatatttgccagcagactttgcctattttctgtatatttctggtctcttctttatgttggttttctgtcatagatgtttgctcatgtacttttagatatttttcaggactctgatggtgatctgctcccttttgtgctcgatgctttaaacgaggtaacccataatatttgatgttgaatatgtaacaaatagttatctgatgattgtaaacctccgaataatactaagggcttgttaaaagtgatgtaatacttgtttcactttcatgaatacagatagcatttcatcctaagttccttgcatcaagggttgagaaggaaagacgtgccatattatcagaacttcagatgatgaatacaattgaatatcgtgttgattgtcaggtatggtcaaaactttgcttataatgtatttgtttttctttatggcagttctgtgtgtttattgttaaccttttatattgtgacaccgtttgttacgcctgagtacagctgttgcagcatt

SEQ ID NO: 1099 - DNA, 830 bp, Portulaca oleracea
ggccaaactgggttggagaaagagacggatacctccccacctcctacacctaatgcctttggtgctatggctagtttccttgtacctaagctctctgttgggcttgggggaggttctcatgagaagacatcgacttctgatcattcaaagattactaaaaaggaaagacatgcggtgcgccctcctgttcagcacaagtggtctctgcctggaagcagtggtgtggttgatccgcctcagatattccagcatgagttacttcagaatttttcatttaacatgttctgcaaggtggggaaaacattacttctggtgattgatcttaccagatttatgggaattctgaatagcttgtctgatctgctgtatcttgtgttccttttctaatcagtgggactttatttctttctcatgcatattctgtatcttatttctctcctttaatgctgctgatgtgggcgggtttggatagtttactgctgatgccactttattagcatgcctctgcaaactttcttttgtggcatggttttccgttgctttcagaaaactattcctagttgaatagttgatatgaccaccatctgttgcttgaaataaagggggaacccttagagctgagtctgtctttctgcttctcttgattttgggctggccccatgatgctatgcagttcatcaaggaagcagatgaaccttctggcattgatgcttgtcaatgcttctgttatactccctccggcccaaattaattaacactttgaaaaacttttgattgttaattactcacaaatcacaatgagttacgatatgaaattaccatcattagaa

SEQ ID NO: 1100 - DNA, 1117 bp, Portulaca oleracea
tttttttggggggggggggaataatcagaagatttactgacagtgacaagacattaagtatcagttcatttatgtcttgtgcttttgggtctgttgagtacttaagtagttaagtgcacttaattttccaaatttagaatgtttgtgtatgcttgtgtccagcatctgtaagtggtttatttttaatttcttttctcagctaaccaatggcaaatctacagagttcaaatccccctttcactgccattgagttggatcacagtgattcgggtagagagggttgcaccgtaactacacttacagtgacagcagagccaaaaaattggagagatgcaatcaaagttgctgttcaggaggttttgtgctctattttgactttggttcttaaacaggttacgtgttcattgttggtgtggtttttagtgatatttgttttgttagtgcaggtccgtaggctgaaagaatttggtgtgacaaatggtgaattggcacgttatagggatgcattactgaaagatagtgaacatttagctgcaatgatcgataatgtgccatccgtggacaacttggactttattatggagagtgatgctttaggacacaaagtaatggaccaaaggcagggccatgagagcttgcttgctgttgctgggactgtcacacgggaggaggtatatatctctgcattgtgcactcatctttggcagttgtgcgcttactgcaaactatcttttgcacttgctcatgacgttcttgttattattctagctaaatagtaactaagttcctgatgttgttgaaggtcaatgctatcggtgctgaagtgttggagttcatctctgactttggcaaaccaactgcccctgctcctgcagcaattgttgcttgtgttccaaagaaagttcatattgatgaaattggtgaaacagatttcaagatatcacctagtgagatttccgaagccataaaagcaggattgaaggagccaattgaggctgaaccagaggtgcgtgtctctgagcttatagctttttgatatttcatttgtcgtttgtgagactgaatacgtgaatttgttcagtaactctattattgttcctgtgtgtttgcagcttga

SEQ ID NO: 1101 - DNA, 1046 bp, Portulaca oleracea
aaacattacttctggtgattgatcatactagatttacgggaattctgaatagcttgtctgatgcttgttaatgcttctaatgatataagctttttatgatcttgtgtattatttttgttcgggccatttagactttttcttggtcacttcctcagtttgtaagtgtcatttcgttgcaggttcctgtgaataaagtacgaacatatggtgatttgcggaatgtactaatgaagaggattgtgctttctgctttgcatttcagaattaacacgcgctacaaggtgaactattctgaaattagcttgttatctgacatcaactgtgcaagttcaaatatatccatgtatcctggagacctatatatctagggttgccttcataagttatgtatttatggttgggatgcctgtagggtgggagggttaggtactgggttcgaatgtagcagtcttaccctgaatttgagacaagctgtgtacgtcggtttgtagattaagaactgttgatcgtctcttatgcaataacagaaaaagtagaggagacttattgagcaatttttctttactccaatatgatgtaggctgaaaagtatcctgccaaaatttgacctttttggctgtctgaaaagtaggcatttgattccctggcttcaaatgaagcacggtcctgtttactagtcttgcacgcagagataattcgttgagacttccatctaatcagtcctgtgcatgtgatagtgtttctcaatacatttcttctatcccttatcagaaagcatgttaatcaaatcaagagatattgggtgcatggacaatgcactttctccacattcgtcatctaaatatccctcattgacatgtaccttctccaaaaatgattatctttcctgaggcttacttaaaaccaacggaagagttaattttagtatccttgtatgatgctgaaatgaatacccctgtttttttttttttgttgaaatcaattttggtcctcacccattagaacatgttaacttttttttagttattttttttatagctttgggg

SEQ ID NO: 1102 - DNA, 300 bp, Portulaca oleracea
cctgagtacagctgttgcagcatttgcattctgagaacaagttgagcaggaggtttccaatagggttagaggaacagattaagaagtgggatgttgataagattaggaaatttcatgaacgctggtacttccctgcaaatgctactttgtatattgtgggggatgtaaataacatcacaaagacaatttaccaaattgaggtgagtgacacatgagactatttatcggctttgcattatgtagttacatatggagattcatttgctatgattgggcaacagtcctgttcatggcctactt

SEQ ID NO: 1103 - DNA, 4331 bp, Portulaca oleracea
  unsure (1)..(4331): unsure at all n locations
gatacacaaagttccaagacagacagtgcatccggctcatcgactagctagaagggcgattcgcagtcttggagctgtcacataattcttaccgttgttccagtgttttttcgtttttcgttgttggtctagtttgtttggttgtcttggtctcgtttagaaaaaaaaagagtatactgtcatgtgtactctgctatataaaaggttggtttgttttgattgtctacaactatgtaaaaggttgactatacgtaaaaggttagtttttcatgaacatttttcttaaaacgaaccaaatgcactctaaggcattgtcaataatggataaaatttggctcatccaccctttgaacataataaaagtgagtcatcacctacttataatcataatcaaagtgtgtttacaatgatggatcccacaattaatatttggattcattttttattttattttggcaaataaaaaaaatacatcaaacgacggcattgggtgtttgtttggcaaataaaaacccgacaaacccacttcttttgccctttgaaaatctcgatgggacgggtgagaatcaattccctcaatcgcctgttcatcatatatgctgttggtcacttattcctcactcaaaattgctttgatttctgtgtgcgtaatctttacacctacttttggtagtgacctaaggggtctatgtgacgaaacattcaacaataattcaatcatatcttttttaattagcacttcctactgattatataatctatatacgattttatttgtattttcttttttaatattttattactcatacaatatatgaagcaaagttaagctgttacaataaacaatttaaatattaaattaactaaccttaatttagacatagagtagtaggatatgattttttttccaattattatgtaaggtgttgtcaactctactacaattcacatatatgatatattccttgactaattaattaaacatgtcaataaacatctcctaaaataaaaacaaaagcaagacaagacaaagggtttaataaaatcgtcccagtcgcagaagatatttgtgatgatgaatcttacatttagaatgccgaccaaccccaatgcccaaccaacaagcggtccaaaattactctcttttctgcccctcgttaatattttctcccgtctctctctcctcaaaaattcccatccctatttatttaccaatcatttctcctttctcatttcttttctttttcttctgaaatcactcttctacggccaccaccattatccactctcctgtcctctctcatcgccgccggccgattttccggtgacctatgctctcgaatttacattctcagttcaccggcgattacgaatttcgatttcttgttgaatgaattttcgttactttacgtttgaattgtgattgatgtttgctgcgattgtttgtttttcagacaactgaattcaacaagatagcgtggaggcttcgtgttgagttcgtcggagaggttagcgatggcggcttcagcttcggctgtggtcggtggcgttacaaagatctgtatacctaagttgaataatggggaagagaatcattcgaaaagtcgagttaatcttggtggtgctaggttatgttctcgaagtgtgccgatatactctcaattgagttttaggcggtctcctctcaatctttcttcgtacaggtatcatttcgaaatgactttcttggtcaacttattctgaaattataaagatgagaaacaagggggttatgcttgagattgctgtttggtttattagtttagcagattagggttttatctttttgttgctaagttttgcactctcatggcttcaagaagtgtggcttatcgtttcttgttgctatgaatggatgatggacctctcatttggatttggaacaattagttgtttacgaatagttgctattcttgagtcttgacagttgaaacaaacatagtagtgcatttgactattaaggaatggatgccaggtactgtactattaatgtccatgtcactgttggtaggtgatgtgctttcataatactccgtagttacacttctagtgttgtaggcttgtagccgtaggaattattatctgcttccttcatttgttatatttggatgagaaggttgcttggggttcgtatgctaattggttacgcttgaatgacttagggaattgctccgcaccccattatactgttgtatagccaaatgttttcatattactgaagcgttttatttcccccatccttcttgaatcatctggacgaaggtgctcacatggcagtcgacatggcacatcaaaaactattaggatgagaaatactatgtggaggcagagaggttccatgctgaaagaaacaatgtccccggtgattccagcaggagatagcatgtttacatgttgcaaccacatccatcgcaaaaaggcatcatatgctaagagttctcgttgcagattttcaactaatggatcttcatttcctttgtcaaagaatgttgatagtgtgtttgtaagtaagcgcctttaagctattttattttgcttttccatctaggaccccaatcatatagagtgtgtcttattgtgacaagtttattggtcttctgtgcatgtatttatgtgtaaccttgatgcatgcacattcgtggttgtgctctgacctctgttagtgttcgatgtgtgcatgagtgctcaagaagtaaataactccatgtggcgtgtcaatgtatgggaaaggaaagaaagggaacattgttactgctttattctcctaaaaacatctgctcacttaacctgatggagaactgtagacaacatatttggaacaccttttttccctcaggcatctacaatggtaagttttacaagttcgaaagggacactgggagaaggataatggaggaggtttctcgaggaataccagaactttgctagttgcgctatctttgcttgtcagtactttttgagttttgacattgtaccagatgatataaagcagccaatctaactgtagattggctgcgtgaatttttttccccatacagcttcttgagtgaaagaaaattacctttcaaagtcttgaatgccttattgccttgttgttccatactttctagagaaggcatggcaccacatagctttagatgtattctgtcattatagtgtttttgtgattttagttaggttttggattgtcaatgaatgacttaatccacccgaataattaaactttccctgaaatctcatgcctgagggtaggatactaggatgggacattgacaaagaagactatgcttttgctttaacggttgtgcgagataaagcttacacatatttgggcgtattgtagctctaatttaattcttaatggttgcagcgtagcgctgcagccaaacttttctgtgttaaattgatgtaattgaaatggaatttttttgaaatggaattttttcaatatttttctttgaaggatgtttcataggtttacacttctctgttcgtattacagatatgttgacattcattaggacattctgagtcactttttgtgattgtttcataggtaaagaaacatcctgttcagtgtgctgctgttggtcccggggagccacatgcagttggcacaaattggccagaggaaaccgtagagaagccgacattagattttctggatcccgaagttaggagagtggagatagaggaagttttgnnnnnngaactcccatcccacccaaaattatatagaggacagttgaaaaatggacttcggtacatcattttgcccaataaagttcctccaaacaggtaaccggttcacatgctattttgtggtatttatgttcctttaaagagagaggggatactgggggtaaatagaggaggaagggatactctttgaggttgatacccatgttcattattagaactccaatttgactctttactctgtaagtatggggcctttctcgattagatcctcgatgcaatgcaattgatgactctagtctgttgcaataagggatgccctcttgtgtctggatgtttatagacggactttgtggttgtttatgaatgttaaattgtttatttttgttcacaatttgctctttgatcactcaaacaatgatggaattattgttttttggtgcccactcctaggagtgttcatgtggttagttaaagagcaatgctttgctctgtctctgactctctgtagacttctctttgttcttaattcttcaagcttatgctgctatgagaaaccttctttttttttgggatagaatacttgtagagcc

SEQ ID NO: 1104 - DNA, 4379 bp, Portulaca oleracea
ttatagggatgcattactgaaagacagtgaacatttagctgcaatgattgataatgtgccatccgtggacaacttggactttattatggagagcgatgctttaggacacaaagtgatggaccaaaggcagggccatgagagcttgcttgctgttgctgggacagtcacacgggaggaggtacatatctctgcattgtacactcatctttggcacttgtgcgcttaatgcaaactatcttttgcacttgctaatgacgttcttgttactatgctagctaaatagtaactaagtttctgatgttgttgaaggtcaacgctatcggtgctgaagtgttggagttcatctctgactttggcaaaccaactgcccctgctcctgcagcaattgttgcttgtgttcccaagaaagttcatattgatgaacttggtgaaacagatttcaagatatcgcctagtgaaatttcagaagccataaaagcaggattgaaggagccaattgaggctgaaccagaggtgcgtgtctctgagcttatagctttttgataattcatttatcgtttgtgagactgaatatgtgaacttgttcagtaactctattaatgttcctgtgtgtttgcagcttgaagtgccaagagatcttgtaactccttcacaacttcatgaattaagattgcaacgtagaccaggatttgttccatttgaaccagaacagaatgacattaaagtttttgacaaagaaactgggatcacacagcttcgtctttcaaatggaattcctgtaaattacaaggtataactttgccatatatgcattcacttatcatggatgtatggctccttgtattgtgtttgtatacttatctatggtataagggttatacagtttgcctaaattgtaaaatttatgttttcttgaggcattcttttagtgttatgttttctttttcccctcctgtgcacaggtgtatttgttctatgtcggaactaactcaatgcttaattaaggctagctcaattctttctctacaaaatatttccatgtttttggttttagtaactttgttggcagtcaattaaactcacctttatgcaaaattgccaatggggagggaactagttggctgcaaaagatcatggttcagaggttagtccttataatatattcttattggctgcttgaatgagagatttagcattaaaggaagaaagaggtgtggggagggtgggggggggggatgggaggaaaaagacagggataggtctggatagcatagagatcttcaagagataaaagacataatatcctcgctgtaaattaaaattcaatcttaatattggccatatgcttttatccctgaaattaaactcttgatctgaagtgccctttattcctctctgcatgtcttcttgaattccacaggtatatcgatttatttacctcttattttcagcttgtattgtcatttttcgtataagcaattgttggcaatgccattgcagatctcacgacatgaaaaccagagcggggtaatgcgactgatagtgagtggtggacgagctgtggagagtccagaagaaaagggatctgttgttgttggagttaggactctcagtgaaggtggccgggtgggaaacttctctagggagcaggtgggtaccatctattgttaatgttttccatgaatccattctaatattgtccttgtttgtggtgtgtatagctttgtttcgtgctagctgagcatcggttcttttaaattttaatcctattactagtttatatccttttccgatcaaaaaaagaatgtattagctttactatgctttggaacaaaatttctggcaaatgcaaatatgattcataggggtgttcattgggtcaaatgtggaccagaccggaaccggaaatagcaaaaactttggaccaaagaccaaactggaaacaaccagtctcaacccagaccaacccagttagaatttggaccgaactaacccagaccgctttggaatggcctaatttgggaagatgtttgttcttctatggtgtctatttggtggtaaaactggtccagctgtacttttggatgaatttcaggaagttctttttctgcacttctctggtttgatattgatgatattccaatattcaaacttttccagtgtagtattattacatgttatatgacatctttgttacctgaaggtgaatgagtgtcttatttgcattgcttttgcaggtagagcttttctgtgtgaaccacctcataaattgctctctggaatccaccgaggagttcatctgcatggaatttcgttttactctgagagatgatggaatgcgtgcagcttttcagttactacacatggttcttgaggtatagtgtacttcagttttttgatagagcaaggccataaagaatcacatgatggatatactgcacagttcttttgctgcctttgtttctcatttttgttgctacttgcagcatagtgtctggttggatgatgcatttgatagagcaaggcaattatacttgtcatattatcggtctattcccaaaagcttggaacgctcaacagctcatagacttatgttagcgatgttgaatggagatgagcggtttgttgaacctacaccagagtctttgcagaccttaactctgcagtccgtaaaagatgctgttatgaatcagttcgtgagtgataacatggaggtcagtacaaagaatgttgtaaatgaacaaaatataagtgtaaagaatgttgtaagcaacaaaatatatataaatgacttgtcgttaagttaccctccttttttccttgaaataatcaggtcagcattgttggagacttctcagaggaagagattgaatcatgtattctagattaccttggtacagttagagcatctcgtgactctcagaagaaaaatattagcccaatcacattccgcccatcaccttccaatttgcagtctcagcaggtaagaaatatccccatcatttccacaaatattctgaactggaacttatggctactatttgctaactagatcattggttgtctgctgttccaaatcatttgagagagttggtttccctcttgacaataatcaacgtgcttacctaaatgctttttcaccatttgcaggttttcataaaagacactgatgagagagcatgtgcctatatcgcgggccctgcgccaaacagatggggacttacaattgatggggttgatctgttccagtgcaataataataccctcaacaatagtggtatgtctactctatattcaattgtggataagggtcctccaactgtgtggtgcatatatcgatatctgaacctgattggaatctttctggagcgattattacttgataataacagttgaagtagtggatgtagaacaaggcatcagttagtttgtattttgcatggccctgtttgttgtttttcagcactgttttgtatttggggtatcagtgatttcaaacatgtgcttatatctgaacatgtactttgttgatttgttctcagtctcaatatgtgtggactgatatctaatgctgattactgtgtcgtgtgcatttacatgagtcgtctaatccaggaaccacaaatttacttgctagtgaatcttagcttgacgatttatgtatatcatgaactgaaggtttgtgttgtcttatcctatctacagaggagcaagggaagtctgaggtatctcttgtaaattctgatggagaggacgagccgcagagcaaaattcgcagccatccactgttttttgccatcacaatgggcctgttggctgaagttataaattccaggtattgcatcagatgagatgtagttatcatttaatgatgaagcatgaaataaatgtgccttttgtaatgccatacagacctgaaatagtcctatttggttacttctttcttcattgcattatttgattgcgttgcttctttgcccccctttttttctctcaggctcttcacaacagtgagggactctctgggattgacatatgatgtatcttttgaactgaacttgtttgatacgctaaattttgggtggtatgtggtctcagtgacgtcaactccagcaaaggtgggaacataatcagagtatgcaccttttcttttagggattattttgctgttctatgtcctaattgtggtgtattaacaggtacacaaggcagttgatgcttgcaagaatgtgctgagaggcttgcatagcaacagaattgctcctagggaattggatagggttagtagtcgttcaacttaagaaagttgtatctttttcaagcttgacttcatgggttgtagttgtatcgtgtagttattatctttgtccttttctgtt

SEQ ID NO: 1105 - DNA, 450 bp, Portulaca oleracea
gggggggggggcgctggatctgtcgttgatgatgttcatgtagcatagtatcatctgttttcaggccacatctatttagtgactcgccaaaccctagtatcttttggttaatgagcactaaaagcttggttgaatgattttaacaggcaaaaaggactctactgatgaaacacgaagctgagataaagtcaaatgcgtactggcttggattattagcacatttacaagcaaattctgttccaaggaaggtaaactcggctgctttgacctttcatctggcatcattccattccttgtttttgaacttctaaagaaagttttgtttagtttcctctacagtgatatatttttgcgatcctgtattttgcacattggcttataatatttgttgtgatccagttgaggacaaattatgtatcttagttctcacatttcctctgcaatatggtg

SEQ ID NO: 1106 - DNA, 3733 bp, Senna obtusifolia
ctgaacttccatctcaccctaagttgcatcgaggtcaactgaagaatgggctacgctacttgattctgccaaataaagttccaccaaaaaggtttgaagcacacttggaagttcatgtaggatcaatagatgaagagggtgatgagcaaggcattgcacatatgattgagcatgttgctttccttggaagtaagaaacgtgagaagcttttggggacaggagctcgttccaatgcttacactgacttccaccatacagtgtttcacatccatgctcctaccagtactaaggattctgacggtgatctacttccgtctgtgctggatgccttggatgagatagcattccatccaaagttccttgcttctagaattgaaaaggaacggcgtgctatactctctgaacttcaaatgatgaatacaatagagtaccgggttgattgccagttattgcagcatctgcattctgaaaacaagctgagcaaaaggtttccaataggattagaagagcagataaagaagtgggatgcagacaaaattaggaaatttcatgagcgttggtatttccctgcaaatgctaccttatacattgtgggggatattgataacatatcaaagacagttcatcatattgaagctgtttttggaaaaactggtgtagacaatgagaaggcttctgtgtccactccaagtgcatttggtgcaatggctagttttcttgttcccaagcactctgttggtctgggtggaaattctattgagaggccagcgaattcggtggatcaatccaaaatatttaataaggaaagacatgctgttcgccccccagtgactcataattggtctcttcctggaagcagcactgatgtgaagccaccacagatatttcaacatgaattacttcagaatttttcaattaatatgttctgtaaggttcctgtgaacaaggttcgaacatatggtgatttgcgtaatgtcttgatgaaaagaatatttctatctgctatgcatttccgcatcaacacaagatataagagttcaaatccaccattcacttcagttgaattggatcatagtgattctggaagggaaggatgcactgtgaccactcttaccataactgcagaaccaaataattggcaaagtgcaattagagttgccgttcaagaggtccggaggctcaaggagtttggtgttacccagggtgaattaactcgctacttagatgcacttttgaaggatagcgaacacctagcagctatgattgataatgtaccttctgttgataatttggattttatcatggaaagtgatgctctgggccacaaagttatggaccagagacaaggacatgagagtttgctggctgttgctgggacagtcacccttgaggaggtcaattctgttggtgctgaagtgttagagtttattgctgattttggaaagcctactgcaccccttcctgcagcaattgttgcttgcgttccaaagaaagttcatgttgagggaattggtgagacagaattcaagatatcatcaactggaattacagaagctatgagagctggattggaggagcctattgagcctgaacctgagcttgaggtgccaaaggaattgatatctacagaaaagcttgaagagttgaagatgcagcgcaagccatcctttgttcctgtaagtcctggaatagatggaacaaaacttcatgatgaggaaacggggattgtccaatgtcgtcttgcaaacggaattcctatcaactataagatatcaaaaactgagacgcaaagtggtgttatgcggctaattgttggtggaggacgggcagctgaaagttctgaatctagaggatctgtgattgtgggtgttaggacacttagtgagggaggacgtgttggaaacttttcaagggagcaggttgaacttttctgtgtgaatcacctgataaattgctctttggaatctacggaggaattcatatctatggaattccgctttactttaagagacaatgggatgcgtgcagcttttcaattgcttcatatggtgcttgagcatagcgtttggctagatgatgcttttgatagagcaaggcaattgtatctgtcatattatcgatccatcccaaaaagtttggaacggtcaactgcccacaaacttatggtagcaatgatggatggagatgagcgatttattgagcctacaccaaaatctctagaaaatttaactttgcaatccgttaaggatgcagtaatgaatcaatttgttggtgataacatggaggtaagcattgttggggacttcaccgaggaggatattgaatcttgcattcttgattaccttggcacagcacaagtcaccagaagtcgcagtgatcaagattttagcccacccttatttcgaccatctccgtctaatttgcagtttcaagaagtattcttgaaggacactgacgagagggcatgtgcatatattgctgggccagcaccaaatcgttggggcttcactgttgatggagaagacctactagagtccatcaataatacattgacacctgaaaatgctcagtcaacctctggtgctctacagataggtgattcgcgaagaaaccttcgcgatcatccccttttctttggcataactatgggactgctggctgagattataaattctaggctcttcacaactgtcagagattcattgggcttgacttatgatgtgtcatttgaattaaacttgttcgataggcttaaacttggatggtatgtggtatcagtgacgtcaaccccaggcaaggtgcataaagctgttgatgcatgcaagaatgttcttagaggtctgcatagcaacaaaattactgagcgggaattggacagggctaagcggacccttcttatgaggcatgaagctgaaattaagtcaaatgcatattggctgggattgttggctcacttacaagcttcttctgttccaaggaaggacatatcatgtatcaaggacctaatatttctgtatgaagcggcaactattgaggacatatacctcgcatatgaacagttgaaagtggatgataattctctgtattcatgcattgggattgctgggtctcaagctcaacaagatattgcagctcccttagaagaggaacaagcagatgatgcttatccaggtgttattcccatgggacgtggtttatctacaatgactcggcctacaacatgatttttctagatggtttttctttggcgtgattactatgaaatttaaaggagttatgcctggaagtttaatggtggtctatggatatcccacgaagctgcttcatccacttttaccttagtataaattaactactatcatatatttttggaccatcctatcaagtgatgaagcatattcaaagtacacgagtcgcgaagagtccgtaataatacaaaaaaacaggttgggttgatggtagtgaacccattttattacgttctcattagctttgcacctacgattgatttcctcatttgtgaaggcttttatattttaatcttcaagtgaaacaagcactaatgtggcatatgaatgctaccattaaatttgtaggagataataatggggaaaagaaaatatagaatctgccactaaggtgtatagcactgccgtaaattttttggacccttggccttattatttttgggtacattcattggccatgtagcataggaaagtagtgtaagctc

SEQ ID NO: 1107 - DNA, 229 bp, Sorghum halepense
ggccacactgtcatggatcaattacagggacatgaaagtttgcttgcagtagctgaaactgtcacccttgaagaggttaacactgttggcgcagaagtactggaattcatttcggattttggaaaacccaatgcaccccttcctgctgctattgtggcatgtgtccccagaatggtgcatgttgatggcgtaggtgaaactgaatttgagatatatccagaagaaatca

SEQ ID NO: 1108 - DNA, 2580 bp, Sorghum halepense
tgaatctaaagctatctactggcccaaaaacaaaatttgactgcttagtttttatgcatgtggataaaaattctagggccttttttaggatccccttggactgcatatgtttagattcatgctaatgttttccctgcaactagcggaaggaaaacagaaacaatattgttggccaactgacctggcacagttgcaagcctatcatgtggatgatgttaggtagttggtaaccttttctgttggaattttgggcacctgtcagcttcccattcagattgtttaaatcaggtggttgctcttgtggtttctaaactttatattatagtggatggagatcttctgcacattatcctcttcaatacctcaatttttccttaatttattgtcccaatatcattcatgtgctccaaacaaatgcaggatgtatcatgcatcaaggaattgacgacgttatatgaaagtgccacaattgaggatctgtatctttgcatatgagcatctgaaagttgacaattcttctttgtttgcttgcattgggattgctggcgctgaatctggtgaagatacaaatggtaataagctactcatgctaagttaatctttaaatattatttcttggactgggcttaataaacttaaaataaatggttactattacatatcaaactatatatatttatcacatgagaatggtgttatttgtgggtgtgttgtaaggattcatgtcccatgtgtatatcacttgagcaaaaccagtacagcactccagtccattatatgcatgccattttatatcattagttgctaacatgaggggtaggaccttttcacatgaaattgtagaagcaggccaaggcctatcaattgaggaccaacctggaatggagttctttgggcttgtcttttagttggtattacgttattacttttatgaattaattttatccactttttattggaacagatgaggagcctgatatggatcttcatggcatggctcccatgggaggccggggtttttcaacaatgaccagaccaaccacatgatcaccattgggatggacaagccttccaaggtgagacatattaaatgcttgtgtgttactgcaccatggaaaagatgtgctgaaaccttctactcgaaatggatgtggcgattaaccttgctcctgaagacaggagtcacatggccctaggagacggcatgttgacagtcgtttcccagcaaaactgtttaaagcattgaagcattggatctggtcagggagactatttaattatttcctacgaaccacagccaaaagcttggttgttgcattttttcccccgagaagcattgagtcaatgactccaaggtcgtgaaagggattcgaggtcatgtagcttcacatgtacagtaaagcaggttgattcttgcatacagttgttgtaactaggtcattgagggcattgaagataggacgacagtagaatcacagataagttgctgggctgcgaatagcataaggcatctgtaacgaaataatgaagcgtaggctcgtaacattttcttgttattcttttgatcaaatatttatagcctttgttactaataataaataaataggtccacagttttgatgctgatactgctaatcttaaccttcacatcgtgcagaccaggtcatgattcattccgccgccctgtgtcgaattaacatttggggtgttagaattagagctgtactgatggttcataataactggcagcattacgtcgctgtttcattttccctttcagcactagtcccccgtgtagtgtaggtcgactactctgttcagtctgttgaaaaagggccttctgcccttgttactcatgtggtcatgtccaagtgtaagtcgagtatcaaagctgccgttacagttagcaaatagcaatgtttttggagaggtggagaactggagtcttttacagtactggtttcacagtatggctgccacaacctgttgtctaccgattcccagtaacccctctgaatattggaacaaagggtgtgaagcaaccagctcgagaaaataaaaccaggttgaacaatcaactgatacaactcaaatcttatattatttccctggaaccaatgcaagatatatgttcatgtaacaccaatgtcttctaacataaaaaggtggtcttctagtgttcaaattgaagcatttgtatctgggagacccaagtaatttgaagaaagaagaccagaatctactaacaatccaatcaaatttcaaatcatcggtacctatgtaccattcatcatttcctttgaaaattcagcttcattatagcaacgccgaacaacagcgcaaagaggagcccaaatgccacaaccaccatggcgaccaccctgaggaagctgtggtcgaagccgaggtagtccctgacaaaatttgccacggtggtgttggtaacaccgtcaaagagcggagtatcgacgtcatcaccatactgcgacactaccatcccgtacaagctccatgcgacagggcagagccagtaataccatctccaccagataggaattttctgaatgtagtgttgaaaca

SEQ ID NO: 1109 - DNA, 2545 bp, Sorghum halepense
tattgcatgccgctggacctgatgaaccacatgttgcaagtccaacatggtctgatacttcccttgatacacctgacatggatcatgctattagtaaggaggagcttgaagatgttctcaacactccgcttcctgagcatccaaaactaattcgtggccaattgaagaatggccttcggtatcttattttgccaaataaagttccagcaaacaggttaggaaacttttttcttgtttgtatctattaatttttatggcaaaggactttgtacaattccacccttaatttgcatataatggttggaactttcatggttttctgtattttttaatttgaattttggagatacttgaaagttgacaattatgggtggagtcttgaacatctgaaattctgaattaatgtgaagtgtttatttgatttgttgaacatcagaattgtgtaatagtaaataaatcaagcaacaaatattaccctgatgcccatttcatgctaactatgaagcaaccaaacatttctatgatatctgtggagaatatgtgtattatggtttcaactagctattttgcaggtttgaggctcacatggaagttcatgttggatcaattgatgaggaggaggacgagcagggaattgcacatatgattgaacatgtcgcgtttcttggcagtaaaaaacgtgaaaagcttttggggaccggtgcgaggtctaatgcatatacagacttccaccatacggtgtttcatatccactctccaactaaaacaaaggtctttacttttctatcgtttattcagttctttgtggaacttattactgccatttgaaattggaaataaacttatgataatttgtatttgttggagcccaattttgttttcttgttagttgtccttggacaaaagtcacgcataagtggactgaatgatgtatttgttgactgtgaagttataatctttagaacttatgaccctagttagatgtgttcccttgtggtatttaatatttacatcttagtttgtcctcaatttgcaggaatatggtgaagacttactcccttctgtgttggatgcattgaatgaggtaaaatgttactaaataacattcctttttggagtgatcatgtggaaaatgtcaatttttgtcattttatgaatatttgaaattctgcatgtccaatgaatacctgaatttttaggtcaatgttgccagaggtgtttggaaatgtttataacaaattctttctattttaacatagaatatgacaagtctgccgttctatttttccagatagcttttcatccaaagttttcttcgtctcgtgttgagaaggagagaagagcaattctttctgagctccagatgatgaacacaatagagtatcgcgttgattgccaggcaagtgaactgttcagaccaacctagtgtcctttgttttaccatatgggacttcattttagaagggctatatccttattgctcctgaaactcgtgctaaatctatgtatgagggcaccatattggtatgctaattataatttgtttgctgcagttgctgcaacatctgcactcagaaaacaaactgagcaacaggtttcctattggacttgaagagcaaatacataaatgggaccctgataagatccgcagatttcacgagcgctggtactatcctgctaatgccactttatatcttgtcggggaaattgatgatattcctagagctgtgcgggaaatagaggtaatgagaaaatacactaaagtgttattgataattttggcagcctctaggatcacatagcaggttgatggtttgacttgttacaatgcaggctgtatttgaacacactctttcagaaaatgaaggaaaccttgtaccgagctctagtccatttggtgctatggcaagcctttttgcaccaaagctcccaagtggctttgctgcaaacctatctggtgaaaaatcacctgctacagataaaataaagcctatgaaaagggaaagacaagcagttagaccacctgtagagcataagtggtcccttcctggagttgctcaggatgccaaacccccagcaatttttcagcacgagttgattcagagtttctctatcaacatgttctgtaaggtatgctcaagttcttctagtcttaagtgatacttttgtgggtaaagtgtaacaccatatgtttcgttagtagttcctgttactttttttttggattaataaatcaatcagcctttggactaatgcctgcaagttttgatgtcttttgcatcttcattagctgtatcatcctttatgtaaacaacggtgcttggtgaaaatgttcatgtttataatattcaaatatggtactttctgaggaatgcagtgattgcatatccctaatgtttttcatttggacagatacctgttagcaaagttcagacctacaaggacctgcgtagtgtactcatgaaaaggatatttttgtctgccctacattttcgaatcaatacaagatacaaggtttgtgattattcataatcttgattgttgc

SEQ ID NO: 1110 - DNA, 1000 bp, Sorghum halepense
tgcactgttttattgccaggttatttactacagttcgagattccatgggattaacatatgatgtttcttttgaattaaacctttttgacaaattggatcttggttggtatgtgatcgcggtcacttcaactccgagcaaggtattttggtcctactgaatccaagtattcagtgtgcttcctacatctgactttctttttttaccgagcaatacatctaaccatctataattccaggtccataaagctgttgatgcttgcaaaggtgttctgagaggattacatagtagccgaattgtggaaagggagcttgaccgggttagtcgaactttgcttgtccttttcactctgtagttcatatcacagaactagtacatgtaggattggtgtgcttatggatctatgttgtcagtataataatattacatttgggcacattaattttttgtgtaattgcttcaatacctttttggttgaatacacatcttaaaaattaagtcatgcatctcatagattgagatacaacattttagctgtgtattgaacttagaatgcatctataccatctgaaattcataattttcaggcaaagaggacgctgttgatgaaacatgaggctgagacgaagacaaatgcctactggcttggtttgctagcccatctacagtcttcgtctgtaccaagaaaggtgagattcatttattgtttatcatctcatattcgcaagaatcaaggtcaaggaccaaacttttcttgtgctgcattttttttaaccatgtcatgaactcatgatagaaaattttgtgatttgtgaactcatgtactggctaatcttgctaaattgctggtaattttgaatagtttcttcatgtaactttggaatcctgtggacctgataccatctctgggtcatgctgtgacaaaatataatttctctataaaataaatcacaaaattatttatcaagaatgtgcaggagagctcatgtttgagatataaag

SEQ ID NO: 1111 - DNA, 1956 bp, Sorghum halepense
ttacatctattatatctccatacaagcacaagaaccccctccagacagaaagaaagagacgttttggttacctttcatcttctgaatttgcatcctaatatttgttcaatagtacttattattggttggctgttatcgtacttcatagaagttcatggatattgatttcaggttgaacttttctgtgtgaataatcttatcaactgctcactggaatcgaatgaggaattcatatttatggaatttagatttgctttaagagacaatggcatgcgtgctgctttccaactccttcatatggtccttgaggtatgcctttttattttactatacgtaatactcacctgccacattgtacagaactagttttctggaaataaaggaggtctaacatttataacatttctccttttgtattacagcataatgtgtggctggaggatgcattcgatagagcaactcagttatatctgtcttactatcgctctatccccaaaagtttggaacgttctacagctcataagcttatgttagccatgctaaaccatgatgaaaggtttgtagagccatcaccacattcgttgcaaaagttgactcttcagtcagttaaagatgctgtcatgaaccagtttgtgggtggcaacatggaggtttgtcaattgctttttccttcttgcatttcttctttttttctcttcaggtaccttgctcatatgcttaattaataattttccatgtttatttgattttgcatcatttttttcaggtcagcattgttggtgatttcactgaggaagaagtagaatcttgtgttcttgattatcttgggactgtgagggctgcaagttctccaagcacagaggagcgtattgaaaagatttccttccgaccgtttccatcagatgttcatttccagcaagtatggagtctcctgtggcatccattatcaatttttccaatttagcataagtatttctagttccacaataataatttattaatataagagatcgttacattgtcattacaatactgatgttagttgaggcattaatgtgtcattaaatcatcgttacagtactcattaattgaagcgttggtgaggcatggggaaaaatacatgcttaaggattatgattttcttctagttataattttgaaccatagttcttgaatcattttgctgtcttccatttatgatgcttgtgctttgaagacatgtttgttgattgtgctgcttcttcaccaggtatacataaaggacacagatgagagagcctgtgcatatattgcaggccctgctcctaaccgttggggatttgctactgaaggaaatgacctatttaatgttattcagagatctgatgctgatggtaattccaatttgatatgtgctaggcttgtaatttgtcacgtagttgattcaaaatatcttacaagttaggcctggtttatgcttctctttgaggaacttcctacttatgttagcgacttgcataaatgtttctttctatgctggttgatatttttcgtgctattgcagcagaaatatccgaaccagtaaacttggatctaacagggaagagacgcatcgatgttcgcagccaccctcttttctttggcatcactttgagtctgcttgctgaaattatcaattctaggtaaaaacatttctatttgattcttctatagattaatacaaagcttcttcaaacatgacagaggccagaatttatgtatcatctatgtaccttggatagatgagcaaagtagtatatcaagctgtggtttggtacttactaaacctgaatttgctcatataaattgaatgcacacatactgtttaatatgccagccacgccattcttgattagatcacaatataggtagtgtgtgtggtgatggatatgccagccacaccattcttgactagaagatcacattataaatagtgtg

SEQ ID NO: 1112 - DNA, 2052 bp, Sorghum halepense
gctgaaccccaaaattggagaagtgcaatcaaagttgctgttcacgaggtttgttttccaaatcttgttataggtcattgtattttaggtcttgaaatgtatatacagcgtctttgattgcaaaaatgctttagtgatataagctttgatctagtttggtactagaataaacctatttattctgattatatgatgaaaatctttgcaatttttaccattttgtttggttatagtgcacgtatggttcctgcttctttctgcacaagtaaatcgatttaggaactacgacttttgaaagcgaacacataacaaggaatgaaaatgaacgattttaaccaagattttgccagcatgagccatacccgactccagccagtccttgaacctatgtccagcttgaagctcactatttcatcctaatgctggatgtaatgcaagcccaattgcaaagtagcctaatactgcggcatgataccatcccaatctggggctcaacccatcccaaaccttccttaagaacatccatgagaaactgatgatgaacctagcccaaacctgagttggaaccaagaacatctaaatcatgtttgaagatgaaccaggtcaaatccactcctaaaccatggtttgctttcctcaagtaatattctgtatgcaagggacttcagttgatgtatggttattactttgtaatgaggtaatgaccagcatctagctctatcattacggcactaaagttgaattggttttacattcaattttatatgcaacagaaataagatgtattctgcacaatggcttgatctatattttcactagcaacaacttcataagtgttttgtcctttttagcaacatttctttgtgctatttcaggtgcgaagactgaaagaatttggtgttacaatgggagaaatgacccgttacatggacgcactaataaaagatagtgagcagttggctatgatgattgacagtgttccctcagttgacaacttggacttcatcatggagagtgatgcacttggccacactgtcatggatcaattacagggacatgaaagtttgcttgcagtagctgaaactgtcacccttgaagaggtactatcattctttttttgtatgtacaaactgctgtaagaatgatggcatcactccaactacccctacaaaggaactatttatgatattacataatatgtgtttaccatacgtaggttaacactgttggcgcagaagtactggaattcatttcggattttggaaaacccaatgcaccccttcctgctgctattgtggcatgtgtccccagaatggtgcatgttgatggcgtaggtgaaactgaatttgagatatatccagaagaaatcacagaggccatcaaggcaggtcttgaggaacctatttacccagagcctgaggtatgttggttagtttccatttgtcttggttttgaatttcctttggaacctctgtgaactgaaaacaggatacttcgaagcaaaatatggttttctgaggctgctgattgactacttttctctctattgcagcttgaggtgccaaaggaattgatcacccaatcagagctcgatgaactgaaattgcaacacaaaccgtcatttgttcctttaaccaaagaggagaatgtggtgaaagtgtttgacagtgaaactggtatagcacaacgccgtctttctaatggaatttccgtcaactacaaggtaattcctcaatcatttgcatcttgttattcagtggatagaagaatccttttcacattcatgttcctatttgcatgtatttaaagcctgttctcatgtcccttacagcctttctaaaaagttggtttatgatatcacagatcacgcaaaatgaagcaagggttggtgtcatgcggctcatagtaggtggagggagagcaacagaagattctgaatcaaagggatcggtcattgttggtgttcgtaccctgagtgaaggtggctgtgttggtaacttttctagggaacaggtatattctacttatgggatctaacttctatcatgatag

SEQ ID NO: 1113 - DNA, 37317 bp, Spirodela polyrrhiza
  unsure (1)..(37317): unsure at all n locations
atttttgtgctaaatcgtgaaaagtggtttttgattgattaatatgaatttttgnnnnnnnnnnnnnnnnnnnnnnnnnnnnttgttgagataaatgaaaaaaaagatttaaggaaaaagtaaaaaaaccgctggccaactaggctcgctagtgggttagaggcccagtcgggcggggctacagagcagctaaggactgcgagctcgaggctcgagcagctaaggaccagaccacgagcttcaagctcaaacaattgatgacgcggaccgcaagctaggtgctcaagcggctgacatgtgcatcactccccttccacatcaccagttgccaactagacatggggcaaggagtggtcgtaacatgcaagtgaattgtacctattgaagggtatagaagccgtcaacttatattcgtgtgaaaatcgcctagaaaaccaatgtgggactaaactcaatgctttaattttttcctgtaaattttataaatgccaacaatgcccctcaatgactattagaaaatgatccttatgatgtcatacattaagagcattttggtacttatttcatctctccctcctctctttcgtaggtagacaactggcaaagaaatcacaatttctggcgagcaattaaggtgcaaaaatcacaaaaaattcagcaaaaacttagtcaatacaattcgcggagcatcgtggccgaaattggtgtaggattctagacaaaacatcacaaattcaatgaaaaaatcatcttcgattgatcaacgaataagccattaccaagaagaggacgatctaccagaagatgagtcgtcacctcttgagagcgcactagatgcgataaatggcatcttgctgtgctgacttgaggacaaagcccctaagactcaccccacctccatctaccatacctccgtcgggtgacaactgctagagggccgcaagtcgttatttttccattccaccgggtgatagccgctaaaaacgattcggcaacatgttccaccaatttttgggcttcgaaagaagatctagagatcactcacatcgtctttatccaaggagagccttcgaggttgtggacattacacgatttcctttctaaacacgcaaaatttcgacgatcaccaccgagaagttgaaactctatttttcttattttaaactttattttcatttaaattagtgatctttggcatgatttcaaccttcaatatcttttttccttgagttatgattctttgggcttttatagaactaaatttgatcaattaatttaacggtaattgcttatgaaagaattgtaagttggaactttgtttccacccgattcatattcttcaggtgctgacgtcacctgacattataaccttatttccttttcgcatttatataatatattatatttatcattcagttaaaaaatcataaaaaaatcgtattctttaataaaaattttgaaatattacctgatattatattacatccttgtgatcgaactaaaaatttcccactatttttggaatcttttnnnnatttataattgatttattcattatgataaatatttaaaattctaagaattggtcttttctagttnnnnnnattttaaatttacatgatttattatacaatgattaagtcatatcatttggttagttctttatctaccctagaaaatttttacttaatgtaattcaaatgtttataattttactattgttgcatcatgattttcttcaacatctgttgaacttgggtcaatgtaatattgactagaattacactatctcattgtgtaaaatattagtacagtccacccatgggttgttctgccaaagtacttatgttatactagggttgttggttgcaagtatgaggtgctaacactttagtttgaacatgagtctaaaaatttgagtgatgccttcaattagaattataggtgttcgagtgagggtcataggtgggtttggagcatccttaagctatcttgtcctactatggtctaagagaagaatgtgcaagtgatgggtaattgaaattgtaatggtctatatatcctacctagaatccatcctggtttttggaaataagttcaaaagattatgtatacatgtattcaactaatcttgatgtgttagatctaggtgacactgatgatgatgcttttcttattttgaatttattgtattttgaaatttttacaatgtgtttctctctagttatatgatggtttatgtttggttagcaattgtatggcctgataaaaattgatcaaaattttcatgcaaagaattcaccttctccaactattgttttatcacaataacttcagccctcaaccctcatatcctcaaagtttataaattcctcaatttttcattccctaggccatctataattgtaaaaaaaatgatttgtgatccataaagatttcattaattacttcaaagagtcgataaatttcatctttgctactactcataaatgccccttcacatgttgtgtcttggatttgcctataatggtcaattaaatcatcatagaacactttattgagctgccacttaaacgtggcataatgtaagcacttcctaagaagttccttgagatgattacatgcatcatgtatgggctccccaagtctttgagaaaaactaaaagcaacttctcttatagtatgagtttttcccgtaggataaaacttctttaaaactttctactctaagacattctatgtgtctaattgcttctctagggtgaataaccaatgttcgactttttccttcaatgaatgaagacaaagtttcattctaatgatatctttagagagatttgagatcaacaaagtatcacaagaaattattgttaagtgttgatgcagttcccttgtggcattattgtaaaaatatggtagcatctaaaggatcatgtattatatattatggttttggtgtaaaataatctcacattgccttgggttggggattatcttgtgacgtagctaatatggcatctattaaaatagaatacatgaagacctaaagatcaactttctaattttaggactttctattttagatctttttatttttagaaccttctatttttagatttttttaacatctcgaccactttctatatttagagtaatttttatatttgatactttctatgtttaagtcttatcccatatctttcactatctttattccctttctattttagtcaccaccttctatattcagcacctttctaaatcctattttgtcctcttttaaacctcttcctatttgtgacactttcttaaatttatttccctcttagtttttaattttcatttgaaattcaaaaattggtacatttttcacaagctttgacctatttaaggacacccccatgtagcccaagggcattcaacttattttatcaataaaattttgtgagtttcttcttctttagagattctcctttctttttgtggactatagcatccatatggacttaaagaactaatttcttaattttgtggattcaggatcaacccttatggactctagtgacttgttttcttccttttgtggactcaaaataaggaggttcaccatatatcatgactttcggggattcatgatgtgatttcaacctctcctccaccttgttattagttcattcaagagagctacttgctacagtttcattgtgtcatttcgtaactccattgacattaggttttgttcacctctctgagccatctctaaattagatttttgggattcatgatgtgcaaatcattccatttctaagatgagttctagtaggtttggtttttgtgatcttctaccatgcatgcaaaaactaataatcgatgaatgtagttacaaatatcaaatattaaatcaaaaaataaaatcaactcaattacttttatcttggaagatattaagaaatcaaatttagcaaaatagggtttaagattgagaaaatgtaaaagaagaaaaagaaataaattctaaaatgaaagacaaatataatcatgaaaagataaacgagtataaaagaaacaatccaattttttttggaggaattaaaacacagccacaagaaaaaaataagtgaagcaattcaaataagttaaaattttatcattgattatggtaattttgtgcaaaaatttgaatgctttggctcatattccttgtggtgactgctctaattctttttgattcctcaccccttcttatatatattatagtgtttcctagacacaaaatagaaaccatatcaaaaaaatagagtcaaagaacacaattcatagtctaattcagaatatctaaaatcaacgcaattacttcctcaccaatgacaccaaaaactgatgcactagaatttgccattatttaaaagtttaagttccacacactaattttaaatttataaagttgaaatctgcactaagataaaaataaatttggatgtatggggattttgggtcaaatccacaagaaggaatataatccaaaaactttgaatctgtttgaattattctctaataatatatatatttaatcacatttccattggccgtagaataggggaaataataaaatggatgataaagcaaggagaagaaattcactatgatgctctttgtattgattatgtgaattttccaagagtttcctacttctcgtgacattttccagccatggttcacttgcaaccgatggcctagctgtctgttactaactcctacaattgacaaagaggaagagtgctgtaattgacacacttacatgtggccaaaaaagatgaaatttacaattggccaaaaaggatgaaatttatatgtggccaaaaatccaattttatcaaaatatttaatatctaatttatggaaaatagaaaaatatgattcattgatgaaaatagcaaataaactcttgactacacaatgagttctcttctaagttgtcacttggaagaacctccatgagcatatatacatagatatatatgtacatatttcaggaatattaaaaaatttataatgtttggaggttctcttcaacctaaaatatgatatttcttatatagtatattaaaatgtttatgacaataatatgtgaaaatgtgtaccaaattaacaagtattttatgagatatgtctaaaatatgtttgcacaaataaatccttaatatatgtaaatatgtatgtgataatgcatttatgctaaaatatatgtatgctatataaagactaaatgatgcattatcaaggacataattgaaaattcacaaaatataagtacttcatataaatctcaaatataaaattcggatgataagttatctgtaccaaatgcatttaattagatttgacatcaacaataaaattatttaactatgagagatgaattagtagttaaaatttcaaatcaatcaaataaaataaaaaaagtttcaaatcataaaaggaccaaaggttataattatatattctagaaaatagtaattttttgaatgaatttcttagtctctaatgaccaagtcagagaaagaaactcctgaagtatggcacccataataaaaaaaaaagcttaggaaagtagaataactctctctaacaatctacaatgcatctttctcaagttttgttcattgcagtcttcaataaaggacaaaatactgtacttgattttcttgtgactttgatgattaaggtgattaagtgttgataagagtagcatttggacaaacactagacattggtagtcagttttagcccttaaaaggtgtggtatttgaggagtccaaatttgagtgtttgggttgctaagtccatcaacgtcaacatatagtttttgagggaaataagaaaactatggtaagaaagaacatttaaaattgggagtagttaggtaaagtgagaactagtataaaaactataatgttattataagaaaaagaaaatcacaagaagatataaagaaacaaagagtttatgtaaaagaaaaaagagtcttaaaaaaactcatgtcaatttttaaatcataaaatatgaattgacaacaatctaaaaagacataattcaaccccatcttggtgtttaaaaccttaattcttataggttttcccaaaaatgacagttgattctggatttttttcccaaaaaatatttttttctaaattatttctattttctatcttagttttctttgtgcatgatcatttgtctcaccatttattcaatgatggagtaacgaagttccatccctcaaatatcaaccattttctaattttttatttacattaaaatattttatttttccttttaaaaattatgcacttcagaattatcttgtttcttattctacttctctacttttacattcttttggcaccgcacccaaaattccttatcttagtaatattttagctttactaatgcaagcaatgtgtaaataaaatattgcccattatagcatttttattttgaaataaaccaaaaatatatgggtcactagcttttctaaaatcccttctcccaccgcccaccaacccccgaaaacatttattaatttaataataatattaataataccaacaatgtggtattattagattattacggtttgagttatttttatttggaaaaagggcctgcggttgatcgagggatgctggaaaatgtcacaaagccccttcgggagagggagagcgcgggccacggacccggcgcggtgcagcgccaaccacatcctggcacttgatattctcacctgtgggggtttattcacaatacaaataatttatagggttttatcgtaaccagtcgtgatatctgcctccctcacctccagcgcccggttgctgaaacccaaaatgccgcctcgccgttgctactacttcaaagagtagcttatcatcacttctctctctctctctctctctttctctctctctagcgatggcgtcgctgtcctcggtcatggcggcggcgacgatcgcgcagatgtgcccgtcgcggtcggatgcccaggggcggcgacgcagtgtggctgcccagggccggggcttcctcctgcaccatggggcggtcggcgaattcgcgtgcaaccgccggagcttatgtctgcatcatcagcggtagttatctctccgagaagatgaagaaagaaccgaattatcctcgaattcattatttgaggctggctcgttcttatctttgtttatgacgcgatttctgtgcgtggaacggggggggggaacctattgagccgtggaattttgtctgaaactgttgcttatcgtataaaaaattggtacgtgaggagatcatcgcgttcgctgaacttgtgccgccgttgacgcatatagcagtggagctgcgtgttttcatttacgtttcgggattagagttcgggcactaaaatcgattggaaaacccatttctaatcctttttgtcccagctcctgttggtttcctgacagttaatcgcctattttgagatttagtgaaaaatttaactgggttttgaaaaggaccgtttcttatacatggaatcaagttggctgctgtcattttgattgctgaatgtttgttacctttttccaacttctgcaaagcattgagaatcgtcatgtcatttgtattatatattattcaactttggtaacttgaatgaacattttgacttcattgcgggatgaacattctgatatcattcaggatgaacattttgatttcattgagggctgcatggatgaacatgtactcacttttgtttctttttttacattgtttgcggataaagggtgccccattatggaaaattaaaatcgtgggatcgggatagatttcctgtcaagtggagaaagcaacaacattcttacggtggataccctgttccgccccctacctcggaactacgtggatgtacctcctgtttcagggctcatcgtatgcaccgacatctttttaagggttattcacagaggatatttctggacaagtcgtcatttccacttcaaaagcaatttttcagcggcatgaatgtatgttcaaaatagtagtttcaattagatatttctttattccagatagactatggatactcttctctggtcgcttaattttctgtacttttgagggacttatttagctgaattcctatttattgaaaaaatatgcgaaatatgatcttcatttatatgattaatcgacacttccctttcatctctctacatgggtgcttattaaatgttgaaattaattttttttaagcgatggacaattccaaggataaaagctaggctgtgatcaaaattctgcctttttttaggtcttgtgaacgtcttagcagacataataggctgcaggacaaggataaccaccttaaggatgagatctttaaggcaggaaaatgagttaaaaatggtaaattccttcatgttccaggtgcaattgaatctgggaaataagtcaatttttcctgtctgtagccaattctctctcatagtccctatcaagaggccaatactttgatatatactactttttaaaatctctttatactttagcgatgaaggcttgtgctttatgccaaaccatctctatagtctctcgtttttcttttgaagggggcaagcatgatgtttcctttaatattttcacttttttttggtggctgcatgtctcactcctcatatcatctgcatatttatatatgcctcttaactgccaaatactgtcttttgcaacattgctggtttccacagtcttttagacctttctattacgtttacattttgtagactattttaattctattaataactctgaattttttttaatccttgacaacaacgtgacttcgaaaatgtttatgttgtgtggatcccatgccattaaaggtgttgattccattatgactcatactgctatcctcaaactctgatcttaggtattctgtttcaatctagttgtataggataccttgctttcaagggactctctcattgaggcttgattagttttactctgtccttgcctttgtccatcaatactaaatcacctgtgtgagaaaacaggagccatagaaaagttcatggttagtacttttttgtcacttttggttcccacattccacataactgatctctataccagtataacaagatcatctctaactgtccatccattgacggtccatccatcttttttgtgtaacatactttgagtgtagatggtaaatataagatagaactattgaaattccaatgctgaactggctatggttcacttggctgtgaatgctgatctgtattcaaatagaacctgaggtatgcattcaaataattctgttactgaaatgtcggggattgacttttacatgtccatccctccttggtgttaactcgaaaaaatctggggtatctacaaattaagaggaaaaaaatctcaacccatttgtcacgtctttatatgttctatatacatgatctattttcacaaaatttgtctattccacatggaaaaatttatgtgctatgtgtgcatataatgattctaattggatgacttttggtgaaaatttcttttctccaggtggatccagctcctattcctcgtgcaaccattggtcctgaggagcctcatgctgcaaatatgacgtggccagatgtgatagtggacaaagacgttgcatgggatcctgaagtcgaaacaattgatcttgaaggctttttaagttctccacttccatctcacccaaagctacaccgcgggcaactgaagaatggacttcgatatcttattttgccaaacaaggttcctgctgataggtaaggcaaaaatatctaggttatcatgtaaaagaaacgatcatatttatttgtcaagccctcaactgttcaaatgagcaaatataatttttttcaaaggatttccttttgtagatgtatttttgcaatcaatagtttgtctactgataaagtgttctttatataacttaaattatgtcctcataacagaactactgtgtatggttatatcttttagggaactataaaagagctgattaatagagatcttataggcaatcctaactgttcttctaaatgaaatagaagcatgtttgagtttagtgggataaacttggttttaattattattcctctagtctttaagaagtcatgtcacccttgacattaattcaggattaagattcaatatttttaggatacttgtgccagaattcttacggtttgtttgtgtattttgaactctgttttaggctgttggaaggctgtcttttgttaccttttggatatgtattacaagttggactctatacccctgttcttcttttgcatcccatcatttgctattattcctttttcaatgttgttttggacctttcctctcaagccttctctcccacatcattgaaacagggttgtgatccatgcaattgtcttaattttcgaagacctatcaaattctttacaatttttttgcttcagtaaacataggagttgcttgcttgaaagggaagatgtcctttagtgatgattcaagtgaaaagatacaacagaacaatgactggaaaatcatcaatgacatggtccataggaatgtgaatagcagtacaagacatctttctgcaaaatggaaaagtaaaacaggaagacagtacgactcagtacgaagtgtaaaaaacctacgagatgaaagagttacctgaagaatgagaaccctattttaaacatgattgtgaatctcaggttgatgtcaagttctttttagggactcgagtgtcctcaacatcttggattcatcctgcactgttgcatgctttcacaggcgaaatttcctgttggcggtcttaatgctgtctcattcttgtaacaaaaacctttcagaatgttctaaattgtccaataggatgatacatgtgcacgtctaggatctacctttgtttccaatatgtttttgagatcatttatccggcaagtaataatatggtgtccacaatcaggtcggtatggcttaccaagtgagtttatggcatttaggtcttgaaaaacctgtactcatccgcataatacattgtaattgtggttggtgggtaagagagttctggtcggaactcttgctttcatgggcttaatgaaggtcttctacaagaattgcttggtagaaagctcttttgcagagctcattgagatgttttatagaaatgtatcaaataagattcacaattttgaaactaaacttgcagcatacataataaactttgacgatgtatagtcctaactttcaaggaaacaatgaaggtccaacgttttgctattagatgcttgctgtcatatttctgtgcccaattaatgctaaaatcacagaaatgaatgatgacaaaaatttccttaaatttaagtaataaccctcagaaaatgaaatccatgttatactactattgtggaatgccatacttgactcccctttctggaatgttatttgagttcatttttttgctaagagaaagtggaagggatgacagtctcaacagggaagggattccaacaaaagactggaagtagagtccaatgggaaagataggttctacacttaaattgctacagtttgaagacttcagatccagttttcctgatgagatataatataaaaatggtgaaagaaagcgtcctgttgagggatataggttccagctgaattcatggggtaggaaacagatgatcaattctcaaaatagtttgtgaatgaccgattgtggtggtgtttccaactgcacacatcgccatttaccgagtgcaaataggcttatttgactggccaaacagggcctgcgtttcagctgcacagatagttggttctgtttgtttgaatggatgcctgacaccgacccaggtgggcttcctgactccatgctgagttcataagctaggtggcctaagcacataccttaataggttgctccttttggtaagttagatgcctggatatttgggatgcctttttgcctaggtaaaaccttgatagccctagaacaatagtaaactcatgtctatgaataagttctctgaagactgatcaactctggggagtgctctgctaatcaagtctgtgacaatctccttaaaattcatgttgccagtgaagactgtgacaatcccttttattttatctcaaaatattatagcttcttttattaaaatgagggatatgagtgctatcagctaccggatttttcaagttgcaatggccctgggattatctgtctgcaaaaaagttaattattttgagttcactcatttttgttgcatggagttaacatgttctgttgcacattgcattaagagttcattcgtgaaatgaataaataattgtcaaccgggatagaatttcaagttttttcgtaatttctctttattattgacatttaggcttccagtcttatacctaaatgtacacattctctcattgatgcgtaggttatggaaacggttgtcacgtcggagcttttgtttaagtcttataaacgtctgaaaaccttggattatgaaaatttatctctattgctctaatttggttataaattctcccaagcattctgttttatcatactggccacatttctcttctaagtgaatgaatatccgcctaatatctgatgcctactgattaaaaggacacaacaccgaatattaggaattttactcaatttccctgcactttatcttatgttgacagatagaaaatgtcggtttaccttcaaattaatttttttgattgtatgataatggccgactaaaatgtctcccctcactttgatcttctcctggttccaacttgctcacactcccctggatgatgaaacatgcaacctgcctggctcctggcgatgtctgcctggatgtttttcatctcttaattcagtacagatcttatcatttcgttcatgttgttttccatagttctatactgctattttctatttagctgatctgagtggggttgtcagatttagggaaacgtgttgttaagctgttgtcaagtattccagatattccatgctgtcttgttgaattctgaagaaaagtgtaaagttttgacaattgtactgaataattgatataaagcattgtggagacagtgacatttcaatggatattggttgaatgctgtttttgacatttgagatatttttcattccgtcttatagatttgaagctcacatggaagtccatgttggatcgattgacgaggaggaagatgagcaaggaattgctcatatgattgagcatgttgcattccttggaagcaagaaacgtgagaaacttcttggcacaggggcaaggtctaatgcgtacacagattttcaccatactgtgtttcatatccactcccctacgagtgcaaaggtattcctaatgttaaatagtattttaatcattggctaacatcagaaaatttatagtgctttaatggtaattacttccgctggaatctttgctcacatgtcaaatgttgaagcattagttgccattttgtggcttgcttttgattagatatcagagttgatcaataatcgtctgttgggaatttaagcagagtcagatcctggtttttttgggtcagatccttgttgaaatcagatcccatttacaaaattttctaatctaactgaaaataattaatctactaacatcacaacaaaaaagatgaggataaccgaataactcaggtttatatttaagttttttgataaatttataaaatgataattttactgtaaaataattggacgataatttctcatgatctgtcctgtcctatcttcaggttagaacttcttgagtaagatcagttgacaaataccatggctgaaaggattgtttctagcttattaatatttctgtttctaatgtgatcaaaaaagtttttgaggttgagagaagctctcttatcactttacccaagctctgcaatggaccaaattcattcttatgttcttcttaagcataggtaaggtaggtgtctagtcaagttgaagactggcttgataatttctatatattttttggtattatctaaaagagtaaagtcacctcacgaatgctatcatccctgtcagtcattaacattttcgcacgtcctgagccagggggatggactttatttgtgtaaggtattacagaactgttggcggttaaagatcattttatgtccccttgatttcatctttttttcgccgatccattgttgcttaaaaggattagcttgctcgatgcgctgtcagatgcaaaaatctgtagaaggttgatttgatgatggtggggatactaatgttggcttgggatgaccatatcaggagtgctaggaggctgattggaactctttttcctgccactggtaactcctaggtgttagtagggaaacatattcagccctatctattctatttgttagagaagaggaaggtcagacaaaggtgctcacagcagttagctcttcagcagtgcattcccttttggttactctctagaggtggtgaatatgtgcctaatgaagcatctccttgccatgtggacgacggttagaaatttatttatgcttccttatggacgtacaaataatgacaattctgctgtatcttttctagacttggagaattacacttggtcttgtcaccgtatgtccctttggctaataggcatgaacaacactggggacattaactgaagcctgaaggaaatgcaaagggtaaacttagaggtcccttcagggaggtgggagcaggccttatgctaattgagatgcctgtaaaacatcattcgtgattagttcaagtgaaacattctaggttcaaataacaatatgttacgtgatagttcattaatttacgaggaagctttgtatgcatacttgtataatttagagggaaatataagtttctggtagccttatctgctcttgaattctggtaccaaaatgaccaaatccgtttttttaatctgattttataatatagtcaatttccacatgatgactgaacgattttcactcagacaacatgtaagcagcacaacttcacgttttccatgaccaaattttttgttttgaaaaatttcgaaggtgattggacctacttgcaacagataaatcctatgcgtgcgctgctgactagcctgaaacttaactctatgcatgctttttaattgtgtacattttattccgtgttgtcatatcctggtaaatgttatgagtcatgcaaattattcatcattaggttggattttggttttttaatgttatgttttctgtgatgaacctttcactaattggcatggatattctattaggattctgagggagatcttcttttgtccgtccttgatgcattaaatgaggtacctcatacaactctcttttctgtgtttatgttcctttatgtgatatgaatactgtgcgttgatagtgccaaagtttacctatgaatttccttcaattttgtagcatgtgatgctttgttctttctaaaaaaagaagacgaatttccacatagttaggaatgaagtccaaaccactgaatattagagtgagtaataatatcctacacgttcttagttttgaagaaaaggggaatcctgtaatcagctaaaaaattaaaacatagtatgatatcaatgggtcaaatcgatgatcaatctagacagagacaactaacttcgtttaggtattttattatttttgctaaaatgacaaatataaaagcatgactgattttccttcaaattctatcctttaaccctcaggccccaatgtttgtgcctgatcgtctttatttgaaggctttgggcttaggtctttatgagtatcatgacagagttgaaatggttgagttagggaaaaacagatgcagctaggatggaggtgtgatagggacagaagagcaagagatggaacccagtggcagcagtgggcgtatcaggaacccccatctggaatgggatcatccatagctgattccgatgtgatctggtcattctaagttagaagctagtttttcgaccatcattcattcctgagactgaatatcctatcttgtctgtattgttaagcaactaaaaaagaagacttatttttctagaccaaaaaaagatcggtaattctggatgtgattctgatactcagattggtttcactctggtgcagagactattgacctatatttgtatctgattgacttgtttctgtggtcgacctaaatgaccatctgattgaataatccctgttggtgacaaggcacagttgtgtcaaaataagactgaaggttgaaaatgaaaaatcatgggaatgggaatggctcaattggcttgtgattggcttcaatttccatggcactgccctggttttgactgtttctggtcatattaaaggctaatgatgaaacagttgattaattcattctcaaatttgggaacatcaaaaggagattccttttagatccttcgcggatttttatggcctctagtagacgattcaaaattgattctaaaataacctatttcaccgagaagtgctgatttctccctttctagaatggcttcatgactacatttaaagtctggttgcttggagtgggagacggatgagaatcttgaaattctaaaagtttaagctataagagacagaaaggcctgtcaagtaaatcattttgcagaacccgtgaatggtcattcggcacttagccgaccttctccagcaaggatatcgaaaagcacggatagtgtcacatgataatgttaggcaacttgcaattgcttctatactcttaaaagcactagttgccatggccaaaactaaagttaaaggaactctagctcatagttccattatgtctgtcactgatctctatgcgtgggccagaggatttggtctgttttatttgaactctagttttgtcagaccctagtgtcgattcatccaatgtggtcggtcaaaatgaggtaaagcttttccattttcaaaaaaggtagcataatcaatgcaaatgcaaggtataaattttttaggttatgtaaattttaattatctccaagtatgttagatggtaaagtaatgtaattgacgaatcctagcttaccttcattactcatctctggcatttgagacaaagtgccgccacttattacattttttttatgagtaagatttaatcttggtgaatgcatccgaaacacatcatgtagtggaacttttgtagagattaagattcaacatatatgggtggatcaagttgatggttctgagaaaattaaaaagctgatttagatattgtgcatttaattgctgcaacagtccccccgacaccctggaaatgggttagctcactgaatgaaaaaaagagaagggggtcaagttggatgctggacaagttgtattccggtgtagagtcttgtagttctcactgacaagaacaatctgacctgaatatcctaaaactgaaccatacatggacctttgtcagtctgaaactctgtcaatgacaatgctactcgtatggtggagcatagtggtcataatccattcggatcacctgcgggtctggaggttagtggtaaagaagatctgatagtcttttgtgacactggagcctgggataaaaaggatccactgcgaatttttgtgggccttaagcacagggttaaaagatctgagcctaatggtctatgtgtatttagttcagtggaataaaactttgactagccccatcctaaaaatgtgtgaaaatttttcgtcccattataaacgttcctcttcttaaaaaaatgttgaataagtttcattcgactaatctactgggctgcttcatccccagaaatctgactgtgcatatcccatgcctttaagtaaaacttcatttcataaactagtcaaataggatttatctcataaatcttaattggactttattgttgtatcatgtcaactacaatgtcgtatagacccttgaacacccttcatgtcaaaaacttgtgtggaatgtgctttttgttgtagttgttaaacgagaattcattccatgcacccatttcagttgtctcatcctatgaattcaacattatgtgatgaacatctaagttttatgtgattcattatgaataaattaattattttttgtgacataaatttatagcggttaatgaaggtcgctcttacacccagaaatgtaattaatactgatgccgctatcaatggatatgatgcacccagaacgccaactaatggggccaatatgcgacgattttctcaagtgtctattgaaaagacaaaagatgagagttttttcgcttgaaattaagcttgtacgactcatgtggcaaaacgcaatttatgttctctagagcctcttgccatttttttaatttctcttttgatattccgaactttaatagaacgactatctccagggcctgaaacagagtttttggttgacgaagagcaaatagttgatactatcatttatggacagatgtacaatataataaatttctatacatgcatacactctctttcttttgatgggctccggtagaaaatgtgggcatttagttattatcatctgaactttatctttgatgattcagataacttttcacccgaagtttcttgcatctcgagttgagaaagaaaggagagcgatcctttcagagctccagatgatgaataccatagaatatcgtatcgattgtcaggcaagggcatttttaattgtaatatttggcgatttcttttgacagagaacaaatgcttgtggtgctatcaccttgtccattgccagttattttctcaattgactttttcttttcatgcttttaaacagctcctacagcatttgcattcagaaaataaattaagtaaacggttccctataggattggaggatcagatcaagaagtgggacacagagaaaattcgtaaatttcatgaacgctggtacttccctgctaattgtactctgtacatagtaggagacattgataatattcctgagacagtacgccacattgaagtaagtttaactctgatattttccaataatattttctttgttatgttaaatccttggtaatgagagcattatttgaggcatggttccctgtctcgtctgacattgtcctttatttagagtgtatttgagaagacaactttggaaaatgagacacccatacctaaaacaaatactccaagtgcattcggtgccatggcaagttttctcgttcctaaactgccaagtgggctagctgggagtctcgccaatgaaaagtcttctacttccatggatcaaccaaaagttcccagaaaggagaggcatgcagttcgtcctccagtgaaacacaagtggtctcttccaggatttggaggtgatgctgaggatccgcagatattccaacacgagttgattcaaaatttctctattaacatgttctgcaaggtactggaaataaaatccaaaacttctttcttttgacatacatttagttattattcgaattcatcagtttttgagtgcaatgggcagatattgctttaacaaggatacatggtttacctgcgatagtgtcaagaacaattttgatatactctgattgccttatattttttttcttttgatcgagtggttggactacgacaaatatgttcttttgctttgctacatgtttgagtactaagataccaatgagttgctccatcaagcgtgtgaatgcttactcatggactacaacatatctgaatcaggaggacaatatacaacttgtttcaatgattttgatcatgtttttgcaatgcagattcctgttaaccaagttcaaacatatggaggcctacgggatgttttgatgaagagaatatttctgtcagctttgcatttccgtattaatacaagatacaaggtgtgttccgtgataactgtttcttgtaagatatggtagaactagaacattatgtttttaaaacttctagctgctctgtttcatgaatgttttattgagagctgtctctatcaactttatattttcattttaatgtaagaaatacggttcatccacccaattttgaaatatctgacagtgggaccctggttgggacgggtggtaattagggcttgggaacctggtttcaaagttcttttactggtttactcttccaaatttacgcatttagttcataatttgtagtcagatattttttattgtagttattgttattttgacgtggttatgttttttttaccttaaatcagttattccaaatgtactcagacttgttatctgggggctcgattttatttgtaagtttatggtggttggtttgacggggaaacggtgcacatactgaaagataaaaaaagagacatctgggggaggcaggtgactgatgctgcttaaagactattgagtgaaggcttaaagttccttgggtattttatgcatttacacccttatgatttatgtacatgacgatcatgttgccttttttttggaaaagataaaggcaggagtgaatatctactggtcacatatactgagcgaatatctactggtcagatcgactggtcacatagaagaaccatagactgaactcaaaacgattatgagcaagtttgctacactcgatatttctattttatttttgtacattgtcactgtggttatcaagatttttttgggttttgattgtcaaactttcttggtttcatttatttataagattaaaatttattcctctttatgatgtgtggttcattgatttccattgagaacattgcagagctcaaatccacctttcacgtcagttgagttggatcacagtgattctggaagggaaggatgcactgtaaccactcttactattactgctgaacccaagaattggcagaatgccataaaagttgcagttcaagaggtttgcttcttgagttttgataatcattgatgctacctgatttttccatattttttatcttataactagataaagatgccacagagagtataattaattttgcttaagcttgatgaactgctttcttgcttttagttctatggaaacgtgcacttcttctcattgtgagttcattctgaagaagcaatgtcctatggaaaaagcatgtttatctgaccctgagaaaaaatacactttgtacattatattctctaatttgaggggacattttggccactacaatgcatcgttttaatcttctgttttgcggtactctgaaatatgctatagcctcaaagggagaaattgcattactgagtaatatcgaactgttttctacgtgtcttatatcgtcacatgtgggagtaattccctgtccttgttgtattcttttgattacatttttttatgcttttaatttgattcattggatgttcctttttctttggtcagtcgtttctcattgtttgccctgatctttaactctattcactatcctgtaacatacggtattttgtactacatctggcaatattccttagtctcaacctcgaattgattcatgcaaatattcggattagatgttctttgatattattcgttctgcctttcttgtgtgcgtaacatttcaatttatctcatagtagtcatttggacagtttttcctaccgtgggactcttttccaggaccatccattagacgccctcatgtcgatattacagggaaattggttctttcattgtcagaagcttttgtcctttcatttggaatgatgatgcacaaggcacatataacaataatgaatggttcttctataagttttgagttcagtctatggcttaacagaaaggttccattccttccataacaggaataattgcattggtataactactgaggtttatcttacgatgcaggtccgtaggcttaaagagtttggtgtgacgaagggagaattggctcgatatatggatgcactgctgaaggacagtgagcaattagcagcaatgattgacagtgtaccctctgttgataatctggattttataatggagagtgatgctctcggtcataccgtaatggatcaaaggcaggggcatgaaagtttggttgcagttactgaaacagtggcacttgaagaagtatggcttcctgcttttttaaaattttactctgctgcagttttcggacgagcctttttttcttttatcagttttccgataacttttctggttccattttgttcagtaatgcctggaacatgggctgttttttgtagtgcattgctactttttctgctaaattttaactcttattatgtaacatctgataaggaattttatctgtttgaggaatttatctgtaccactttgttagaattgagcttgtcctttttcaggttaattctactggagcaaagatcctggaattcatctctgattttgggaagcctactgctccccttcctgctgcaattgtggcatgtgttccaaagaccgtacacattgatgggctgggagaagctgactttaagatatacccagatgaaataactgatgctataaaggcaggcttggaggagcccatagaagctgaaccagaggtctcatgcctagacattatctgacagccttacccctattatttcgttatatatttttattaacctgtttcctttggattatattgtcagcattattcctttagcttgattgtgatatttgcgtgtcttgaattttgggtgccgagttaacaaaagtataattcttttgatcaatttttcacacttgtatttccgtgaatatgtaactatgttatatttcagaaatatctttaaagttgtatttcctaccttcatgaagtcaaagcagtggacaataatatcgcttttaataagtaacggtgccaacaagcagaattcttcaatacattttactttccaaggtggcttgtgccttggatttactctgatcttaatattccttttttcccatggttgaatgttggtggacgaacttatttgcgtttacaaaaggaacatatctctattttcaggaattttctaattcatgaataatatgaccgtattttgttggctcatggattgagaagcaaccaatgattttcaatagtactcaaattatggcctacaattggtggccatccagggcaatttgaagagagctctttcattcttcattgatgctatgagtgactatgtgggcacttcctcgatgtcagaagttgtgcatttaagctcagcgatataaattccatgacattgaaaggagcctatgcatttttttaattgattcccaatagtctgcttgattggttatcagctcgtatttttacctcattccatttccgtactcatgaaataaatctttctgttaatggcattttgatcatgcctgggtttgatgtactttaaacaaaatttccttgtaatgtatttttccatctggtatgcatgacccctttttaaatgccttttgttgcttcatcttccagtatttttcctatgtataaatactcaactacatattgcctgttctattagcatgcaggattctcaccatcccattttcgttgcaagcatttaaaactgcgcagaagttccgaaaatcatcttgaaaacaatccttgttatcctgtgtgaatgagatgtgctccggttgcctaacactacatgttgggcttaattttcccattttctactctggtgctgattacatctgtttcgtatctgtagctggaggtcccaaaagaattgatatcgtcatttcaactggaggagctgaagtctcaccgtgaaccatctttcgtttcgttaaatcaagaagtgggtgctacaagaatatttgatcaagaaactggcatcactctgcgtcgcctttcaaatgggataccagtaaactacaaggtatttcttactcttttcttaggctaggtgctttacttaacactgtgaaagataaatggataaattcatctagagcattaccggatttgtagattttttaatgatcacctttaacatcttttgtgtgggtagggttcatgctgtcatcgattacactatatataactctacattgtctgatcatcttccctcctaagtaatgatggttgacatccagcctaaaatgattattatgggtacagccaaacggacagatagggttaatagaacatttgaacgggaaaatagtttttccgtgatagaaattctttaaagagcttttgcaataatccttttgagtgtaaattaattttcataaatatattttccttttcgtgcatttttgaaaaacggctgcacccgttttctatgttgaagtaaatgtaaatgaagccatgtatttctcaaagggaaaacattcttgagttcagtttggtagatcaatcagtgagaaaatttcataacatatttgattttctgttggattagctctctagcactcttcacattgaaaaaataaatgaaagattgaaagaaacaaagtcaatgtcacacagcctactgatttttcattcagttgaggtttttgtttcatatatgctttggcattaaatataatcttaatgcctttgtcatactgtttggtacggtatacattgctatctcgttctcagtattgtccatgtgaaaattagatgggaagagacatggaattgcctctgtcatccagcaaaccatgcaaaatttgggtttcactttatcacgggtttgtggcacgtgtcctgtggggacatgttaagtttaggcgaagaactgtatagcttaaaaaattttcgtgcatgttttctcagttatcctctatgggggtttatatcctttgatggactgcattttacttcatatttgttgaacttaatcaacagtcctattgtgcacttttatgtcccattttcttttcagtgtatttaaaaattgacatcaattcagatcacaaagaatgaagccaagggcggtgtcatgcggctaattgtgggcggtggaagagcagctgaaacctctgattccaagggtgcagttgtggtcggtgtgagaactctgagtgagggtgggcgggtcggcaacttttcaagggaacaggtgcaccaatatccatttagcatttttggtgtccaatgaacaatttcgtaaatcattcctttttcaatttaaaactattctgtttcattcttgaagagtcttgagtcacaactgtcttgttcaccatgtgtttcgtatgcacataaggtatggttatgttttatgatcattgcttctattttcttccttctttcctgaaagcagtttttgttccttcctctcttggatcattaataaggttgtttaacgtatagttgagaagttcagttcaagagtgtaatgcttagctttcggatctcttttatcaaaactataatactgtttgagttcagtaaaagccacatttttactgaacgacagtgcattaagacagatcattaggatgattgagtgtggctgttgggggacacatgatgggataatcactactgcttggatgcaaagtatcagttaaagcggaaccttgagatctttggagtacattttccccttgtgcattgaatcaactcaaagttatttggatagtctatcatcgtggttgtaaatgactaatatgtacttcttttatatgtatctgtaaaagtaaatcagataaatacttttccataggtttttttggtgccatttctaatatcttgtaaggcacttttagatgtaagcctttggatatcaagtctctgtaaaaagcactacttaaatggaaatgctgttgatatagttatttcttggtgattgtcgtggatcgttcgcatatttgccaatggtctctttgtggcattttcttgtatcaccacattgtgtgaagaactgtgctgtttcccttttgattgtgaaaatggttaagcaggttgtattcattttcacttttttttcttttgagaatacaactaggcaaaattgagaagatattgacacattttgatcccctccaggtagagcttttctgtgttaaccacctgatcaattgctccttggagtcaacagaggaatgcatctgcatggaatttcggtttactttaagagatggtgggatgcgtgctgcttttcaattacttcatatggtgctggaggtatgatcttttagcaaataatgttttctttaattggtctctatcctgacgaagtattactgaagtgattttcatgtatctttccaattcatgctgtatggcaagttcccttaccgaaaggtcttagatgtaaatacttggcattgattattaatccattttcaagtttgtaattgataaagaaaagtaactcctggatcaagcaattttcctgaaaccattttttctattcaaaatttttttcagtaacattcttagaattccttgttctcctctctattgtgtttatgactttagcttgatattgtttccattgttgccctaggattcgactattattaattttgatagcaagatttgcattgttaccttctacattggttttaagtttatgattattggtgggttgcagcacagcgtgtggctagaagatgcgttcgagagagcaaggcagttgtacgtttcatattaccgttccattccaaagagcttggaacgttcaacagcacataaactcatgttagcaatgctaagtggtgatgagaggtttgtcgaaccaacaccacaatcattgcagagattatcactacaagcagttaaagatgcggtgatgaatcagtttactggaggcaatatggaggtttgtttgagtacttctgattttaatacaaaatttacaagttgatacaagtatccgtcatgtattagagtctacgtaatatgctctttatgttgcttttgaagtctggatgtaagtttcatatatttaatgttatcacagagagttttgatttcatttcacgtttaggtgagcgttgttggggatttcacagaggatgagattgaatcttgtattcttgattatctggggacagtcagagtgacggaaaatgctgccagtgtacatggtgcccatccaattacatttcgaacgtctgcatctgatcttcattttcagcaggtacagtctatttctacgctgtactggttcgttctatactttctatttgtttttcttacctacgacaggtgcatactattaaatattgatgtattttttaaaagatttactcctgagagtatgcttctttgccacagatcctaatacttatagtttatttgctaaaagttgccaactcgacgtgctgtactgctctttcttgttcattgttgaaggaaactgcctcttcttgtcctatatgaaggaacttctgtaatcttgtacaggatagccaccaattggaatatttgcacaattggacttcatctttgtagttggggggaagttcactgtaaagtgctatcttccgagtagatttaatagcatctagcagatgccgatacactaaataggcctttttctcagcagagagaaatgattgtagacgtactactgtcaccgtagtttgtgcccctcaataatgaattatacgttccttgatgcataatagataacatttgaaacggaaatattgtgaaagtatatttttattataaaagaatatcaaccttcgtggggaggagatgttcaatcaaaagatggtggaaatgaacatgctgaatcagaactttggaggtggagggtgacatgacatagaagatgcaacaaaatattgttcatttgtgcgtcttctggagtgtgttatcaaaccacactcatttttcaagcttgtcgttagcatgaaaaataatagaagattccagatgggactgcaaaagatgaattgatacttttggactgcacgaaatgataaacatatgaaaatgtcgttgatgggagatgatttctcgattgattagacttgggccagacggaaagtaaattagtgggaaaaaggattctattaatcactaattgaagagtagttcatatttagtggacctgcgaagacggaacctttaaggtgttatttcggggataacttctactttttcgagagcatgaattaaaacatctgaaattggatctaattcgatttcggaatccttaacgcatgcccaagacaaaagtgtcctacacaaacgtaaggaaggatacaagttcttatgggttatgatgacttcccacatactttctgttgtagtgcaaaaccatttgattgcaaccaatgcaagatagtttaataagaaatctctacggttttctctttttccttttagtgttattttgtgtccatgaacgggagttaccagtagaattgcattttgaaccattaatatttatgtccatgttatatagtgtaattgtcattactgctccaaaagattgaatttatcatcgttccaagatcgtttggaaacagcaaaaaaacatatttctcaatcttgtgtccattaataggtattcttgaaggataccgatgagagagcatgtgcatatatagcaggtcctgcaccaaatcggtggggattcactgctgacgggaaagatatgtttgagtctatcagcaatggctcagttgcaactggtaaatttcgatcttttttaactttgatgaatacatcctgttttagaatgctattatcttgtgctgagatatatttttgcgagatgggatatatgtgcatttttcagatctctgcttcatgtaaatgttaagattttattaacatgtactgaatatttacttatttatgggttcatctatcgtaccttagtgattttatgttatgctcgatcatgtggtctatgtgctagctggtttcattgaacggccggggcacactacaatctcgttcaagaatatgcgttttttgccggtttcttgatgaatatatgccctctcattcatgtttttccttccatgatatgcaattgagatcctttcttctccattctcttaagaggttggcctgctatcctgttagggttgcccactagcaccaattacatattggcgactggtaactttctactgggtatcaattgaatgtctgtggatatagtcttctaaagatgatcattctttgggttttgtacatctgtggtcctttcccatgaagcctggaggtttaagtcatatctatgtgtaaatgtaaattatattcattagatttcacttttcgtgtcgtcatcttcccaccaatgcgactttcagcaggttgtatttgtatatttgctaaatattcaagcgaaacacgaagttgatttttctagaattccgttaggcttcagctgggatggtgttctacagtgttgctattatcacgataatttttaaacttagcttcttagttagctgtatttccggccaggggagggaaactgatgcctagagacagcgtgttttaacactttgttcattgcaagtctcaacagggcccatttccctgtcggataccaaatttcaactatttcaactagttaagtaaacggtacattgtgatgccggtggaactatcctgttatctgtgcagtatttactgtgatgttgagacatccacgtatgtatctggtagctctgtgatatagttgataaggaagttattacatatctctcgagtatttttttgttgctagcaacttgattcattggatccatgaattcgtgttcttatttggtacattgctatctcgcaaagctggcatcctaatttattatccccacagaggaaacaaaatgctacttgaaagttttcttatattttattaagacttttacagtctggtataattttcagaaatagtaccaatttattggatacattgaaaccgatgcacaatttctgtgcagatgatcaatcaacttctggggagtctcctacactggaatggaaaaaagtaaacagcggccttcaaagaaatattcgatctcatcctttattttttgctgttgcactggggcttctggctgagataataaattccaggtaaaaatttttagtattgcagtacatcaatatctttgcgggtatcattttattaatatcctcgtttcccttttctgaaatgaaagcaatgttctcgataatgaacactgaaaattcaatacatatatatatctatctatctataaatatatgtatgtattaaagatagcaactggtgggcatttggtaacaactttaccttggatatgtcgattgtggattctcacctgtggctcatcttgtcctgacttctgcagacattgtggatggtcgatttatctgcgacaaattaatttagggagatttaaatggatgagatgctgagagaacatcattgggatatcatctcagatgtgggaaagaatgttcgcatcacctagatattgcccatgtttcaacataatgttcagccataggcatgcttcttctttttccagtttctacaacatgatttagtcagttctttctgataccaaaacttctatcctctttggttttacaaaataaataacaatccaagacccgagttgctagtttatatgcatatatgtgctccgctaatttgcatgcccttttaccgtcttgtgtgccctatagaaggcccccagcaaatcgactgataggagtagatgaacacaaggtgtttggtccttccaaccatacaaccgttggtcaggtatgtgtgcgtataggcacccctatcggtcgaaatgttaaggaagttatcacttctgcgtagactgcaaactcaaacctaaacatctgagtggaagaagagagaagttcaggtctgactctcgctcctgtagtcctttgaccaaaccgtcaccaggtctcatggggtttacattgtcttaaactgatcatgatcttcattcgtaagtggtttagcatgacagaagtaaagcatttccatgacctgtaggtgggaatggagaagaggagaagagatgaaaaagggagagatgaccacgctcataatgcacgactttatgtggttcagatttccctgtgccgatggccgcattgagcccagtatgtagagaaagagttggattatataagagatgaactgactaaatatgaggaggctagggcaagatatccggtataaaacattgccgtggaaaacagactccatggtcaacatatcactgtgcattgggtttcctttgcttcctgattgagagttcgtggatctctaacgtctgcttttgcctatggctaagttccgatcaacatctgtcctgcaagacattcaactagtgtcaaccctatttctgatttggggtttgtttggggtttcctccagggcctccgattcctgtcctgggtcatcaagattgatgaacatggaataaatttcaaaagatcgaagtaggggaaacttatattccatgattcaatagttcaaagcagtggaaacttcgaaacatgaaaagggcagcgtttccctaccttgatagtttcacgcgccaattgaccctctcatgcccttttattgtcgactggaaagcaataagattcaatgtagactcacacgataatctccctcgttgccactggatttttgaaatttgctgcagctgtgacgtggccaacagaggagctttctatctggaatgacaaatgtaaattaggctttcgtgcagtttctgcaaagatatgctaaaagctatgtactgtcttgcattcagagaagttgaactaagtatcccaaaataaagtcagaatggttcttggctcgttgaccaaggctgtcatgaaaaatcgtgcatggagactgggagcatgcttttcttttgttctctcttctcattctgtagatgcctgtcaatatgcaacttactacccacggttacctgtcaaagttaagccactttatttagattgttcatcaactctgttagtgtagattaactgtaatgatttcttttcttattgtggcctcatttttcttcagttaatctttgattatgtgaaaatcaaaattccaaattattactagtttcatgatgttgattctatgttagcgtgaactattctccaaagtcattgtgatctgaatgtgccatgggattttattgttcaaaacacagactcttcaccacagtcagggattcgttaggtctgacatacgatgtatcctttgaactgagcctatttgataggctagatcttgggtggtatgtggtctcagttacctctactccaagcaaggtatggtttcaggttcataaaccattttcttctggtatctaccattaatgttttgatctcatccttactttgatcctactgaaggttaacaaggctgtagatgcatgcaagggtgttctcagaggtttaccgagcaacaaagtctcccagcgggaacttgatcgggtaactactccttccaccctcgcccccatgaaaaaagaagagtatggaaaattaccgctgggaaacatgcatccaaatgttgtgaatatgcatgcatcggttcgaaccagattccagtggcttatctcttggtccgttttttcatcacagattttcagtttgtagttctgatcgttgcatactaatctattaactggattttttttaaagcattttggagtaaaatctttttcagtctggtgcttgtgtattattttagcgacacttgcatataatcccatcagtttattaccaaaacatggtaaacttgagtcataatgctcttagagccgacttttttcttatcccttgtatttcctttaatactaacaggccaaaaggacccttctgatgagacatgaagccgaaaccaagtccaatccttactggttaggattactggcacatttgcaagcttcttctgttccaagaaaggtgaaaaaggcttcacatcttgttgattattcttctatgccctcgtaaactgtttgctaatttctccttccatccttcaattgggtgagattgttctgtatgaatttaccctaaaatttagggcatactttattttcctaggatttgaaactgttaaactactacttttttgaattttagaacctgtttttgaatggtgttttcttctgtgcatggaatctaggacatctcatgcatcaaagacatgacttttctatacgaagccgccacagttgaggatatacacgtcgcatacgagactctgaaggttgatgatgaatctttgtttgcctgtgtcggagtcgctggaaaccggggtgaagatattgccggtaagatgcctacgcaatcagtctaattaaagaaatctaatttggagttttagttgcatgatgatgaatggggcattatgcctgacgacgactgactgcttagttttgttttttgctgcatttgtcaaaccctgtattatacagaatgtccctatatagcagagggagatctatatatagactgtccctctacagaattactaaaacaagtaattattataaaaaaaaatttaaaaagaaatgttacatcttagatgaagactctctctgttatatgtggaatgtcccacttttatcctaaaccgtccccattctgatatgctaattataatctaggaaataagaataagtgaagatatgcacattggcttttgtttttttgtgctttactgtcagatccagagccacttcacatcagcctaacatcatctaggatcagaaaaagtcattattttccaaattcggatggtaaaacgtccaccctgaccttaatctgtgctacttgttagcggcggctgaagaggaggaagcagagatggggcagcatgggatgatcccagttgggcgcgggctgtcgacaatgacacgacccacaacatgacctccattttctcatgcggcgatcattctaggaattcacacaacgtgcaggcgtctgcaccctgaccaccaattcatcaagtcagagcccagatggatcgtcatccggcagtaccccgtcttcttcatcctgctctctacttggatcaaccccggttttttttttcttttcctttcccttggcgcatgcttcaagatcagctcactggcctccgttaacaaggtatttatctgcttctcttccatttttgctggttgtggatatttacttttttcttcaactctggaagcgagtttattgagtttaattaccttttaggggacgtttagaacctatcatatcctgtgctgagacgctgctgctgttctaattcatgcacgctttccttgtatcctccaaaggagcgtttatgatctgaagtggccggggtatcagagaagccagcatccgggaaatcaagatcagtggtactccatatatatatatatataaataatatatatatatatatatccaccaatctgacagacgaagcccagcccatgattctttttttttcttgccaatattaaggtgcattatttctgattatattgtttcaagttcactgctttcccatgattatgctggttttctgtaatgatctcagaacatttcaaggaaaagatgttgcccttctcataatgacactctcccattccatcataagtgctgctgcttcatactctgatgctgcattactataaaagggctctccttgctcaggttaggggggggacaatgacagtctcaagtgtttacaggcttgtcatgtggctgcctttaatggggtatgtctgaaacaagtgctttagtgttctgaagagcatcagatagtcaaccccatgaaaacgtgggaggaaagattgtcatcagaggtttatggcgtggacttgatttctttgagactgactttgcttggaatggaggcagttcttgggcagtgagagagagagagagagagagagagcatggagcacccctgctgctgcatcaccctctgtttcccagggtttccttctctgaaggatctgtagtaaatggattcttctaggttacaaggcgttccttgctaatcccaactagcagccaacggcatattttcctcttccttttcatcttaattagaggaaaaagttagcatctcacttctggttattgacactatttaccagaataagtaacaatcatatggcctagacgagacattaagtgaaaaaaaaatatccaaaatgctgaactactccggcattcctctgcttttgtttatccaattattgaagaaaagtgagtgtataattcaataaaaaatacttcaaattatcatcactctcgcaatgaaattgttcctgagaattcaacccctaaggatttgataatgcgtcaccataaatacagatataaagatgcagggatcgtcctagcttgataatccaatttcatcaaaaattaaggttcgataattcaccaactttacaactctaagattgcatgaatctcccataattttcaaaccatacgtgacaaaaagctctgatcatctccgaaaagggttcctcatatttatctcaagcaaatccagatcttcccattttatttttcttggtgaaattggatcaggttttaatgtaccccactaaagggcaacgataagcgctgatttactgaaaagagaagaaattttttgtaagttggtctctgtggaaagagaggaagatcgctttgaaagccttcaacttctgcaatgaatgatttgctgtgcttcttcaaaagtctcatgcacttgaatgggcccatccattcactctacagccgctctgtcatctcctcatagtgacgatgactttttctcctccacagacgccttgctgtgggtgggtcctctcttgtggcaccttctcggagaagtcaaacatcatcatcatctctctctctcnctctctctctctctcccatccacccatatcttaatgcccttagcatggccaaaagccagcacctttctgagagacagcacgtgatgagagcctgaaatcacctcaatgagttgatgcagttgaaaaaaagtcaatgacccatttgggaattattgggttagatgaagaagaagacatcattgatgccttcttgggcatttcatgtgagagaagaccttcgtatatatttccttttttttaatgcaataatttgccttccaatttgttttcttctctctgggtttgcctctcatgggggtgagagtcaactccacgagtgaatttgcttacccaaaatggagaattgagcctcaggcagctcgccgttgaccccatgctttatcttacagccgttgaacggaagtcagttgtaagcgggggagaaggtggagctcggcgccatgttgtagtaggctcaggcaactcttgtcgagagatgggcagatgaggattatttgtaggagagaggtttgacgcagcgaaactgttggcgatgaccctttgagttgagcggatgttgaggttggtggaagaggagttgaaaccacgacttaaatcctcaaaagtcaagatttttagtgaagcctccttgtcttgaatccacaaaacgaagaagttattcctttggtgctaaagggcggatcttgaatccacagaaccaacgaactaacttcctaagtccacaaggatgctggagtctaccaatagaggggaaaaactctcaaagaaaagaaactcacaaaattctattcataaaataagttgaatgcccttgagttacatgaggcatctttaaataggccaaagtttgtgaaaagggcaccaactttaaatttcaaatgaaatttaaaaattaggagggaaataaatttaagaaagtttttgaaataaaaatgagtttaaaatagaacaaaataagcttttctagaaggtggtgtaaagacaagtgacagttatggaagtaaaatgaatagaggaaagagaagaaataaaaagaggttttaaatagggttaaatagattttagaaggtggtgaacatagaagctagtgtctaaaatagaaaaggaataaagaaaggatgagacttaaatatagaaagtgtcaaatatagaaagtgatctaaatatagaaggtttaaaaatagaaagtgaataaaatgttagaaggatctaaaaatagaagggtctaaaaataaaaactttaaaaaatgaaaagttgatcttcaagtcttcgtgtgttctactctaataaatctcctattgactggttgcatcaaggttgacttttagttagcagccaagagcatgctgtggagagaacacaccagaagggtgacaagctcagccatatagagtgcagctcactccgccctggtgaaacctctcttcctc

SEQ ID NO: 1114 - DNA, 2503 bp, Taraxacum officinale
ggggggggggggggggggtgccagtgtcggtggtgtcagacatgcatgtacggtttacttctaggttttagaagaggttttatgaggatataggtacacaacttcacttcaacacaacttaacatccacatgctgacggacatagcaaacatatattaaccatttattgtttaataattattaggtatatattttattttgatgttttatgatttcatcacattctgattcaataacacaaatatattttcccgtgttcttaatctactaaaaatgcttacaatcactattgttgttaatatattacttgtcttatccgtcaagacaatgacactctaacatgggtggttattgattacggatacacaaaatcatatcaaaacctttgtagtctacaaaaggccatacaaaaaaacttttaattttatcttgtaaaacatggacatccacattcaacccattttattaacaacaaagtgtttcatcaccagtgacataacagaaaacccaacctctctcttgactacccatcgcaccacaatgataaacacccactccctcttcaaggactccaagcccgaagctaacacacatcataagtgtaagaagacaattactttgcatcaacaaatacatatcatctaatttatttaaaaaaacataatcaaaagggctgcaacaaagttttagcaaccacaaatatacatttgtaagtttcacaataaggttgtcacttcctggtgtgaaatgtatgagttatacctcctggtttggagtgggccgggctggtatttttagggccggaccatatgtgcagctctgtcccgttattatccatggttcaaaaaattgacttgaaccgaatttaactgaaccaccatacaaagttatgcaaattaaaaagagagacaaatttgttgccacaaatatcaaatttggccttcaatagactcctcttttgtgaggatagaagtcgccccctcaattttcatctctgcaacctccttcacaagcaacaatggaagcttcatcaatcatatgtgcttccgctccattacaagtcaagtctaagtcccccttctcttcgtcttcgaacaaatccagttatgtggtacacaatcgtaacctatcgagtaagaacaaaaagactgttactttgcggtgtttccatacacaaggccgtcgggcggccgcccctgcgcctcgttacttcacttctaaggtgttttttttctatctatctccgttctcttatttatcgattgatttgggaaacatacaaaatcattggaatcttgtttggcagctgttatttctcgtatagtcgtatctagagtgcaataaattttgttttggatgggcttctttaacctggaattaggttttacaacatgtcgatgtttacaatattgattactgtaatacacacaaatcccttgtttctgattcatgaagtttatttagagaacttcgacagaaaatcagaagatttttgtcgaatatttggtcaaattttgcaatttccacaggatcagatgcaataatcaacgactgtagctgattgtattagtctacgtgattgtaaattggaaataaatgatgaaatatggaattgccccattttgtttagtttccactttccatatctgacaaaatcctgtgtcctctactctagattgttggcgatagattaacttctccattggacaaaccattgattcaaaggccattgttagatcaatgcacacgattctcttgctttcatcatggaagaagaaaacggacacctatatgcaaattttcttcaagaatgctctcagacaaatctgtattccatatctcaaagcatggagtaaacaatgcatctgtaagttcactaattacagtcactatacatacaatcatgaaatctttctgatctatatcttacacacttttaggaaaaacgtgtacaagttgcatgtacagctgtgggtcccgatgagccacatgctgcagcaagtacagcatggccagaaggtgctttagagcagcagtcttcttctgatcttttgtatgacacagaaagcagtgaatggagaagggagttagaggcgtttttaggttctgaacttccatcacatccgaaattgtacaggggcaaattagagaatggacttcggtacctcatattgcccaataaagtaccacaaacaagatttgaagctcacatggaggttcatgtggggtccattgatgaagaagatgatgaacagggtattgcacatatgattgagcatgttgcgtttcttggaagtaagaaaagggagaaacttttaaggactggtgcaagatcaaatgcttatactgatttccatcatacggtttttcacatccactcacctacttctatgcaggtttgtaactccagattttgttttaaagatttttttatctattcaactattgttttataatccgtttttttggataggattcggatgatgatctacttccaagtgtt

SEQ ID NO: 1115 - DNA, 776 bp, Taraxacum officinale
ggggtacggacattaagtgaaggagggcgtgttggtaatttcacaagagaacaggtggagttattctgtgtaaaccacctcattaactgttcactggaatccacagaagagtttctttgtatggagtttcgttttaccacaagagacaatggtatgcgtgctgctttccagttactccatatggtcctcgaggtaaaattgtatatatatatacatatatctatatatatatattaatgtattttttgataatatgcagcatagtgtatggcttgaagatgcgtttgatagagcaagacagttatatctatcatattatcggtcaattccaaaaagtttggaaaggtcaactgctcacaagctcatgatagcaatgttggatgaagacgaacggtttgtggagcccacacctcattcattacaaaatctaactttacagactgttaaagatgcagtcatgagccagtttgttagtgataacatggaggtacgtgttatttaattttatatttttttgtttcttttaaaaaccttgtgatttgattttttttttaatgtaatataggtgagcattgtgggggattttacagaagaggctattgagtcttgtgtgatggattatttagggacaattagggctaaaaaaggtgctgaaaaagcactgctttataccccggttctctttcgaccttctcctaatgatttgcactttcaacaagtgagtgaaaataattcttttttttttataacttaaatgattattttggagtattttt

SEQ ID NO: 1116 - DNA, 1634 bp, Taraxacum officinale
ttgcttcacgagttgagaaagaaatgtgtgccatattttcggagcttgtaatgatgaatacaattgactatcgtgttgatttccaggtatgtatttattcttgaaaagttgcaaacgatgaatattatttgtaaactgttttttattttttttaattacagttgttacaacatctacattctgagaataaacttagtagaagattcccgattggattagaagaacatcttaaaagtgggatgcggataaaattaggaagtttcatgaacgttgtaatctgttgattgccaggtatgtatgtattcctgaaaagttgcaaacgctttttattttttgagaaaaattaatttaaaaaatgtttcctataggctatttttggacataactggtctcttcctgagagacatgataatctcaaatctccccaaatattccaacatgaactgcttcaaagttattttagtttcaacgagttggttcccttttttgtttttgcaataggatcattattaatcatgaaaactaatgttttgcttattatgtaggattctaaaatcttttactattttccgataaaacagaaacaagtgattatttgaataaaaaatattcttattggttggagcaaagcttaaagccattacaggtctataattcaatttgccaatcgccaaccaatgttttttgtttaaagatcttgcactaattatttattttatttatctcacaatcttcatagtagatgttgtcatggttgaagataacgaacctaaattaacatgaacaattttctcataccagtcagatgatgtttatgaggtctggttcttaacataaatgttttattgtatttctattaattatcagatttcccgttgtataattattcctatggggaaggttatttttgtaattatcaggaatacgttatgtttgataaaggagatttaaaggaacttgaagacaaagattttagtagtgatttgaacaacctttaaatgtaagttatacgctatcaatgttgctatatcaatgttgtttactgtttgtaagttgaagttgcaggttgtgatattattgcaggttaacttgatcaggagttattgagccaagtggtcttgaaacatatgaagaacattgttgtaacttgtacgtttgtaattttactattgaataaaagaattatggataataagttattttattggttatttgaggtaattgagaattttggcattacattaatcattaatcagaaagttgatagtcttttaagttgaaaaaagtttgtaacagaatatgattatttatattagaaaatttctgcattttaatatgaaaattttggatagttttctgttttattttgatttaaaaaaacctcgaaatccctaggaaaagcctaggaaaatcatattcgtaggaaatgcctagtaagttcatattccaacgaagttcctacgcaatacatttcctaggaaaaatctaggaaaaccgatttctgggaagtttgtaggaaaatatgaaaaaaacaatgcgtgggaaatttctgggtatttccgacaaacaatagtccgtgggaaaagtgtaggaattttcgtgggaaatccggggaaccagtttccctggaggtg

SEQ ID NO: 1117 - DNA, 1021 bp, Taraxacum officinale
atgtagatagctttttacccgaagtttcttgcttcacgagttgagaaagaaaggcgtgccatattatcagagcttcaaatgatgaatactattgagtatcgtgttgattgccaggtatgcatatattttgaaaagttacaaatgatgaatactatttgtaatccttttgttttttttaaaattacagttgttgcaacatctacactctgagaataaactgagtagaagattcccaattggattagaagaacagattaaaaagtgggatgcagataaaattaggaagtttcatgaacgttggtactttccagcaaatgcgactttgtacatagttggggatattgataacattggacagacagttcaccacattgaagtatgtacaatgattattcactttcacatgctttttattttttaattttagataaaattaatttcaagaatgttcctgcaggctgtttttggacagaaacatgttgagattgagactcctgtagcacctaaaaccagtgcatttggtgcaatggctagttttcttgttcctaaattcacaggaggaatatcagctgattcatcatcatctcctccagttgaccaagtcaaagctgttaaaaaagaaagacatgcagttcgtcctcctgtagaacataactggtctcttcctgaaagacatgaaatcaaaactccccaaatattccaacatgaactgcttcaaaatttctcaattaacatgttctgtaaggtaaaaaacaactcataaactcccaatacatgagtttttttttttacgtgtttacccttttgcagattcctgtgagcaaagtccagacatatggtgacttacgtaacgttcttatgaaaagaatattcctttcagctttgcattttcgcatcaattcaagatataaggtattgtatatttgtatgatatctctttatttacaacttgttattcgtacaaatatatttttataacaaaaaaacgtaacttttacagagttctagtcctccatttaca

SEQ ID NO: 1118 - DNA, 970 bp, Taraxacum officinale
cagagttctagtcctccatttacatccattgagttggatcatagtgactcagggcgcgaaggatgtacagtcaccacccttacagtaagtgctgaacctaaaagctggcaaagtgcaatcaaagtggctgcacaagaggtttgtacttgtttacttttgatcaatattcaataacaataatagtaattattataattataacaataagaacacatgttaatcttttttggtttatattttcaggttcgaaggcttaaggagtttggagttacaaaaggagaattagcgcgttatcttgatgcattactaaaagacagtgaacaattagcagcaatgagtgataacattccatcagttgataacttggattttgttatggaaagtgatgcacttggacacaggattatggatcataaacaaagtcatgaaagcttgattgctgttgctggaacagtcactcttgaagaagtaacttcaatctttttttcaagattatgtttctttaatgattgagataatatcattattctgattttttgaatataatggcaggtgaattacattggtgcacaagttttggagtacatatcagattttggaaaagcatctgcacctgtacctgcagccattgttgcatgtgtaccaaagaaagttcatgttgatgaagtaggtgaagttgaattcaagataacaccaagtgagatcacaaccgccattgaagaaggtttgaaggaacccattgaacctgaagcagaggtatatatttaatcatcatctagttctttataacattaacttcaaattctataactttataatttgtgatttacagtttgaggtaccaaaggatttgataaccatgacagaattggatgaactaaagttacaactaaaaccatcttttgtatccattggtaaagattctgcttccattaaagttcatgaaaaagaaacaggaatcacacagtgt

SEQ ID NO: 1119 - DNA, 5383 bp, Trifolium repens
  unsure (1)..(5383): unsure at all n locations
cttcttatgagacatgaagctgaagtcaagtcaaatacatattggttgggattgctagctcacttgcaagcatcttctgttccaaggaaggtgagatcgaaatatctgaattttgacatgcaatcagtatatttagatttttagtgccatctaaacttggtttaaagtttccagtcctgccaaagtctcaatttctgttatatttttactttgtcacatgattctaagttactgcattgttgtgatgttgactgtgggattcaggacatatcatgtatcaaggacctaacttctctatatgaagcttctaatattgaggatacataccttgcatatgaacaattgaaagtagatgaagattctctatattcatgcattggggttgctggtgctcagactgcacaaaatatagaagttctctgttatgtgttggtttcactatgagctcaagcgatgcgagtatacaacgaggttcatcaacgatggtaagtttttttttcctccacaattcaaaccctaacataaccagagtcgattttaattatttttaatctttctagatttcgatttttatggctttgattcaaaaccttatgtatgaatgaatgtttaattcagtaactatcgatttagtatcattttattgattttttcctcaaaaggataattagtgaaacggaaataagatccgttgtttgtttcaaactcgatcctcgacataaacatggatcacagttttgcggtgtttgatttataaatttatgaggcatggaagcgatcacattgagcatatgatgtattttgcaatgcggcgttttatgtggagaatatatacgatattagtagtaactagaaattgcttctgaatgtgatattgtgcatttctgtatctgatactgtctttttcatcatatgaaaaaatgagcaacttattgaagttctatgcatgtacaagggaaacaaaaaagaaaaatggattttttttaataccttactttttatactatcctggtagtgttcatgatttactttatatagttgttcaattccatttcctctttggcctgaagtttgttttattgaaatagagtttgtttcttttatgtaagtgtgtgtttgtaatcacttttggggtgagttgaaagtgattctgaagacttaaaactgattttggtatgcttgaggttcctaattagaactgattttttttttctacaattgattctaacatgaaaagctagaatttgtagcatttgcttcaaaatgtaatttttacggtcaaatctattgttcaacttatttatctattgtcataaatctattgttcaacttttgggaatttgtttatgagttgttgttgttgttgttgtttcatgataatatatgcttgtatgattctagcacgaaatttcatgatcaataacatgtttctacttgtttgttgttgttgatttttgaataaatgggtttttgaataaaatgataaaaatccttacttttatcatgaaatgatgtttgatgatgttaaaggttgtacttctaggtttatatgagttatgtatgcttaaagttgatacctttaggaatttgtatgatgaaagttgttgtttttatggatttctaagtgaaacccgaaaacaggggtattattatgggcttgctcgcttgggcgagtgcccttgaagcttgcagcgagccttgaatgttcttgagcgttgcccagaaaacgcatagctcgcttaagcgagcagtagcgagctctggcgagcctgctcgctaggcttcgcttagtctcgctggctagcgaggatcccctggaactcttcgctgggtctcgctaggcttggcttgagcgagggtcacctgacccaactttgttgtaacttcattttaatgatttgtatgcttataacatgattgaattatgatattataacatgttatatgattagattgattatatcttgaggatatgtgattaaatgcttatggttgcatgattatctatataattgatggtttgaagtatgaaatgaatttgataaagtgaatgatgtgtgtgtgttgtatgtatgacctagtgatgatatgatgaggcgaattgagatgaatataggttgtgtagtactatatttcatgaggtgattgtgagtagttatcatcaaggtatatgtacatacatgcatcataagtctatgtggggtgagtcattcatgactcaaaactgaaaacgaggtgaatgggatatatgtttatcctaanacgaggtgaatggtaccgcatgcatatagttatgtctagggtgacatgacatatgtaattgacattagttgcattagggattatgtgattgatgtggtaattgataattggcattatacccttaattgtacttgatcaattgaatgtggataagattgtatgtttattaattgagtatgagtttaccattcttaatgagtattggatgcacattactagttgcttgttttgtggttatatgagtattgcttccataatataagtgcaccttatgcttatgattatgaacttgaattcgtaactaactctcttattttgtgtttgtgaatggtttgggtctagattcttcgcttgaggagtcatcttgagacttaggaggtttgcttggtggccaagttagtctagcttggtaaggaaggatggcgtagggttatcctaggttacttagagtctaggattgctctgatattgtaacacttgggattaggatttggatgcttgtcctatgctatgtattaagatcttgttattattgctatgctactttatcttgagacttgtggtgtgtatgaataggtcttcgtgtatgaagagccatatttaagttgtaataagttttacgactatgcatgcttgatttatgactattatatatatctatatgattgctaaattcttccgttgcgatataatgaatatgtatgcatgctttgtgtaacgtttcatttcttgtaatgtcttaattgcttgtattgtatttgttttaagttaaataaatagtataagtgggttagggtgttacattatgagattgcttggtggccaagttagtctagcttggtaaggaagaggtgtaggttcatcttaggttacctagagtcctaggatttgctctgatattgtaacactgttgggatttagtgttggtttcgtttgtttgatgttaagaccttgctattttatttatattcgttaacttaagaattgtgagtagtatgaataggtcttcatgtatgaaggaccttatttgaagttataatatggtttataactatgcatgcttgtatctaactattatatatatatatatgattgttaaattcttccgttgcgatgtaatgaatatgtatgcatgctttgtgtaacgttttatttcttgtgacgccttaattgcttgtattatatttattttaagttaaataaatcgtataagtgggttagggtgttacaacggtcaatgtcacttttagctacggttttgaccatggctaatgagcgtgttttttgtagtgcttgatgagaaaatacctttcccgtgaatggagaaagttattctcgtggagagctcctccgaacaactctagaagtactagagaatgttctacaatttctgaatgaataataacgaggaaaatgagctctatttatagttttctaacggacctcaacaaggtccattgtgctacaatgagtgtatagtgctacgatggatggatttccttcaaaattataactgaaatatgcgctttatcaccttgttcaccaagcaagctccatcgtaccacgatacactcattgaaataaaagtgatttttaatttataataattatttttggttgggcaacggtgggcaagcgttgctgtagcaaaaaatcgtagtcgtattcactgaataatcatataataaagggtctactagaacaatttttgattgggcaatgatgagaaaacattgctgtagcaacaaaaccgttgttgtatctaccgaataatcttatagaataggtctaccaaaacggtttttgattggccaacagcgagaaagcgttggtgtagtagaaaaactgttgtcgtatctacttaataatcatatagtaaagggtctactagaacgatttttgattgagcaacaatgcacaaccgttgtgataggccatactaaaccattctcgaaattcatccaatggcaacggtttttgctgagaacggatagaaattgttgttgttgtgaactttgaaaaccattctattagggactctaagacaacggttatctacaaggtgttgccattgggaaataaaccgttgtgaaatgtaagacaacgcctcagttcacaacggcctgaaaaccgatctcgtagcctatgacaacggtttttttgcattacacaaaggtttttagacgttgttgtagaatgaaaatgttatagcgcgtcattcaaaatcgaagtttttttttttgcatatttgtaaattttcagaaatataaatattcaaccgttataactttagaagatgaattgtaattttctccacatgttatggtgactatatattttgaagactaaaagtatccattttttattaaaaaaataatttaaaatagaaattattcttacaaactacaatattgtaggaactaattattttcctactcgttttgatctattaattaattcgcaaaggtgtgagcctatatgtggcaaaaaatagtactatatattgatcatataatatatcaagagtgtggggatttttattcacatgaataaattaacatttctaaaaatgtttgaagaatgtttatgaaaaatttaatattggaattgtaaaaaataatataaaaaattgccatggattatataaaatataactcttttgattgataaaaatataaacttttggttgttgattagaaagtgatccatattcttttttaagcttatgttagtaatactagtacaaaggtagttttggtttgaacaaaaaacaaggtagttttctctttaataaaagatagttttccataaattattataaaaattggattgtgtaacatttgaaaaaacatgacacacaaattgaagcaactaaaagaaattttagattaaatagaataaaacatgacacacaaatgattataaggggtatatactccttaataatcagagaaaaaacaaaagttaattaaacacaagaaaataatcatccctaaataagaattgagatcatcctggcctactatagttttggagtgaataaataaatgttatgcacacattttaataattgtgacatacttagaaatttatacgttaaaactatagtaattgatatctc

SEQ ID NO: 1120 - DNA, 828 bp, Trifolium repens
atgctttctgatgtgataagaaaagaaatgcatgatatttcaatcaatttttgaaattgcatccaaaaatagatcgtgtttttaaggtggaattgtggatttcacggatttatcatccttcagtgttttttagtgtgccgttttaatgatcaaattaataaattgatgcactcaatgtgtatatagttttaggttctctcttttaaacattgttttgctgtaatactccgatggaaagaaatccaaaataggggctgtgtatgcagtttctctagaatccactcgtggctgacttcttagcacccgcttgttgctattttaggtttgaagcgcacatggaagttcatgcaggatcgatagacgaagaggatgatgagcaaggaattgcacatatgattgaacatgttgctttcctaggaagtaaaaaacgtgagaagcttttgggaacaggagcccgctcaaatgcttatacagatttccaccatacagtgtttcacatccatgctcctaccactaccaaggtttggaccttttgtgggtttgtgattatttgtctagtgttcaagtattaggtcagtggtagtttagtttttcgtttggaattttggatgtttatgaaacgattctttgttacaaactttcaacacactaattcaaatcaagcggatgtgaacagggaaaaatgaagtttatcatgtatctctgaccaagcagtacatggaagttattggtgttgtagtgaatatgattagtttacattttgagcagcatagtaccaactaactctagattttttaactgaatttgtcatgaatattctcaatgttc

SEQ ID NO: 1121 - DNA, 1699 bp, Trifolium repens
tcttccattttctctattggctgagtctcaaactattttttgttttgtttttaaattttgcaggaaaatatttgctctgctttttatgaaggaacaatctcttttttcagtcgcttaaagatgaatgtgaaatgaagattaaagccttggaaaggtaatgaaaattttctgcataatttgtttttattcatcattaatctttttaaaagttgtaaatttacactcacagtggatgtgaatgatgaatgttgttgaggttgaagaaaatctatttgctgttagtgatgccaaagtatgattataatatatatgtttaattgttttgtatggtgttttggaatttctaatgctttatgtatagtgaattaataattgcctttacattatgcatagtcactattttaatgtattggtcctatgttaagagtctgacatgatatgagtttataagtgggagaaattcttacaattataatgcattcaaagtaagaatataattttagagtatggttaattgggttccgccactattatttgccacttgatttggagaagcgtcccctgcgggagtaattaatgaatttgttttctacactgttaacaaccaaacaataagttattgtgttcattttcctaacaaaaatgagataaaagggcactaattctagagaatcagtaaagtataaggtgcttaaatgcttaagaggatttgctgcatagctaagttttgtatattctagagaatcaatagagtatagggtgcttgaatgctttagattatttagtagtttagttcattggctttgaatattctattatgattatagtttagtattttggttcattggctttgatagattcaagttatgataggctcaattgatgacaccatatttatccaacatatttaggtgtgaggcaatgactacttatccaagaacctatgatttaattcatgctgattcactgttcaacctttacaatggcaggtaaataagatgttgctttagaagtgtttttattagacaaatagtaacaaataattttatatgaagtaaacttgcaatcaatgctttaacaaatatatttagtatttctctcacgaagagaccaatatgttattttttaatagtatacagtaagaatagtgtctataacattgtacttataaactttaagcatttatatgatatattaaaagttttgtgacatttggattttgtaaaatgttaccaacatgcttttttgtgtgtttttagatgtgaattggaagacattatgctagaaatggataggattcttagaccttaaggagcagtaataatcaaatatgatgttgatgtattgtggaaagtaaagaacattgccaatggattgggatgggatagtgttattgtagatcatgaagatggacaacttgaaagggagaaggtggtgcttgaatgcggaaatattgatgtgtttttacctataatttagtgttgcacacacatgaatgtgatttaaacttttatgaactttcacctatgatttagtgttgcgcacacatgaatgtgtttcaagtgtaattgatttgcaggtacacaaagctggtgatgcatgtaagaatgttcttagaggtctgcatagcaactaaattacagagagggaattggacaggttagtacctaaatatactttggttgtttttaccttacaa

SEQ ID NO: 1122 - DNA, 592 bp, Trifolium repens
aatgcaccgacagtcaatggtgtgctttcttgatttcattttatgatgatcatcagatcctgtattgtatttcaaagtaattttttgagaattgctattagttgttaaatgctaggaatgacttgtgcagataatgggacaagctctgatgctctacaaacagaaggtggttcacaaaagagcatcctccgtagtcatcctcttttctttggaataacaatgggactgctttctgaaattataaattctaggtatgtatttctactaacgtgctatttggcttagtttgaaaattttggacagcatgcttgctgccaggctggaaaaaacagcctagcttcaaatgggacaaccccttactttggagatgaagtcttaaaaatatccaagacttctcctattaccctgaatataaaaatgttaattttaaaatatttgaatgaaagaaatctccaactaggctaaaaagcttcactgcatgttttctgcataggctcttcacaacagtcagagattcactggggttgacatacgacgtgtcattcgaattaaacttgtttgataggcttaaactagggtggtatgtggtctc

SEQ ID NO: 1123 - DNA, 1051 bp, Trifolium repens
tcttcttccatctgttctggatgctcttaacgaggtacactttatttcttatcgtgtaagctacatctactttgtagaaatgccaatattagatttgagaagatgtttcatctgatctcggtatatacttttgatctgaccctacttgagctatctgtaaaggcatttaaggggacacctggtaaagatagctatggcacttctagactagcattatctcacaccttatggtaattgatgcatgcagatagccttccacccaaagttcctttcatctagaattgaaaaagaacggcgcgctatactttcagagcttcaaatgatgaacacaatagagtatcgagttgattgccaggttcagaaaataacatcttctagaatcaacttgattcttctctagaatactgatctggtctcttttttcagtatttgattttcttttaattttattgattgcagttgttacaacatttgcattctgaaaacaagctgagcaaaaggtttccaattggattagaagaacagataaagaagtgggatgctgataaaataagaaaatttcacgagcgttggtatttccctgcaaatgctacattgtacatcgtgggggatattgacaacatcccaaagattgttaaccagattgaagtatgtcaaatataaattttcgaagcatttgttgatcaattttacagttcatatgagtattatacaataataactatggttatgcaggctgtttttggacaaactggtgtagacaatgagaaagcttctgtggcctcaccaagtgcatttggtgcaatggccagttttcttgttcctaagctgtcggttggtctaggtggaaattctattgaaagatcaaccaatacaatggatcaatcgaaaacatttaataaggaaagacaagctgtccgtcctcctgtgaagcataattggtcacttcctggaagcagtgcaaatttgaagccaccacaaatatttcaacatgagttgcttcagaacttttcaattaatatgttttgtaaggtatgaagaggtttagtta

SEQ ID NO: 1124 - DNA, 721 bp, Trifolium repens
aatgacaggttgaacttttctgtgtaaatcatctgataaattgctccttagaatctacggaggagttcatatctatggagttccgttttacattaagggacaacgggatgcgtgcagcctttcaattacttcacatggtgcttgaggtaaacatcttgtcagttgttactgttatacctcttatggtcgtatgatgtatctataaatttctcgttgtcttacattaccattgtttctgttgtgcagcatagtgtctggttagatgacgctttcgatagagctaggcaactgtatctgtcatattaccgatccatccccaagagtttagaacgctcaactgctcacaaacttatggtagcaatgttggatggagatgagcgatttactgagcctacaccaagttcactagaaaatttaactctccaatctgttaaggatgctgtaatgaatcagtttgttggagataacatggaggtctgctactattatattgaatgaatatagctggccattatattcaaaaactaaaatttgttttatgtttttcaggtatcaattgtaggtgacttcactgaggaggacattgaatcatgtattctagattaccttggcacagctcaggccacaagaaactttaaaagcgagcaagaattcgtcccaccatcatttcgatcatctccatccggtttgcagtttcaagaagtgagaaactaagcataag

SEQ ID NO: 1125 - DNA, 2037 bp, Trifolium repens
tgtattcttataagctgtctaattttttgaatttttttttaatttacttatgataaatagaacatgtttagtgctaagcaacaagcttaatagataaggtggaaaactgcaccgattcatatgcaagttgtccctgtcattctgaaacaaaaaacctgcaggcacatgtataagttatttgtgttatgtatgattgcatgttatgtcatgtttccaccagagtagttaatagtgtcaaatcattctgttatagtggtaatgtgtgttggatggtggcattttgcttctaaacactttgttttgtcagtggcctctagctgccttttaagtattgccagatttgtgacaatggttgcagctttttgcagagaaaatccctcgtatagcggccctgattcttaacaggcacaaaatccctgtttgcgcagccttttccccatttttctctcaatctttcgggaccacttaatgaatttacttacttttgctacactattaattatataattattccttagatagatggtgattatgtataggacaaaaacttttgattgattaagtgtcttccatttgggttactattttattttttgagtttttaccatttttatgcttgaggtataaactatatttagtatctataattattggtaaaacaacgatcctgtcatatatttttggagttggatgcacaatgctactgtctgggattggcaagagatatcctcacttttgtttcctttcatacttcttttttaacatgtaccctctattgtgctagttaatacttgtagacatgattagtgtttgtgttccgtctccctttattcattatcttattgaaatcttatgcagattccagtgaataaggttcaaacatacagagatttgcgtattgtcttgatgaaaagaatatttttgtcagctcttcattttcgtattaatacaagatataaggtgagctgaggccctttttatctgctacagtgccatattattcacgtctttctacatgtctactgcaagaatttatttggcttccattatgtgatatatgagtatttgtgcagttttttttggcattagtaaaagatggttcaattgctctgggcacaacttctgttttgtgcctttgttgtttttaaatattcctcctacccaatggtgctgcaaaaattgttagtttttgtcaatacatcacaaaggttaccagtgtgcaaacagtcaaggctcagatcatagttcaatctaaatgtcactctaatttattttttaatgtttggtggtttgtaattctctgggtactctatcctttagcttctaaatatgttgcaatgctgatgaatgaaatttacagagttcgaatccaccgttcacttcagttgaattggatcatagtgattctggaagggagggatgtactgtgaccactcttaccataactgcagaaccaaagaattggcaaaatgctattagagttgctgttcatgaggtttgttcctctgctggtcttcacctgtctttgcaatagtgcaatttttaattttctttcgattgattgtttcagtttgtttatagttcaactgctggtttttctccttagtttaaccttgaaagatatttaaaacaacttgaatttaagacaatgaattgaaaatgctcaattgtcattatgattattttttaatcttacaattgtccccgctatccatttggttgcaaatgcatagaaaaaactaaattgtattaggtttcaaattgctggaatgatggcctacctttacagtgtttaatctattatcataacctaatgtaaatttgtatgatgtaggttcgcaggcttaaagaatttggtgttacccagggtgaattaactcgctatctagatgcacttctgaaagatagcgaacacctagcagccatgattgataatgtttcttctgttgataacttggattttatcatggaaagtgatgctctaagccataaagttatggaccagagacaagggcatgaaagtttacttggtgttgc

SEQ ID NO: 1126 - DNA, 467 bp, Trifolium repens
tagggtcatgctaacaagcgtcgttccctaagggtacttgttaagaagtaataaaaagaaacaagtgataagttttatgtagaaaaagtcaatttttaaaatttcaaagtgttgagtgcacaattctcaagataaaatttcctttttgaacttcttaacaagggcatttgttagcatttccctttatattgtatgcttttggtttgattggatttaggcaaaatcactgttctttttttcatatgtagttgtgttgctgtattttttcaggttaagcgggttcaagttccgcatgcaactgttggtccagatgagccacatgctgcgagcacagcttggcctgatggtgttgctgaaaaacaagacttaagtttgtttgattctgaactggaaaggatagaggagtttttgggttctgaacttccatctcatcctaagttgcatcgaggtcaactaaagaatgggct

SEQ ID NO: 1127 - DNA, 1564 bp, Trifolium repens
tttatacttattttgctgttgctgactcttattttattaaaccaacttatagatgcaagtctctgttggaggcatgacttgaatgaatttatgaaaaattaattgatataaagctgtgcatcagtagtatgtattggctagactaaataattactaatcaattccttttctaaaataagactccatatcacattaaataatgacctgcttcatttggtcgtaatattctccctttattaagtcagtttttggtgttccggtgttttgggcttaaatttttctattttttattggaaaattaatcaaattgtaattaatgcattatattgtaatttaattagtatgttgaagaattatttcacagaaaacttatgttcatttttgtgtgtgcaagatatgaaagtataactagtaacctttatttatttattctaaatatctttgtatccaaaaaaaaaattctaaatatctttcggtgcaggttaattctattggtgcacaagtgttagaattcatagctgattttggaaagcctactgcaccccttcctgcagcaattgttgcttgtgttcccaaaaaggttcatatcgaaggagctggtgaaacagagttcaagatatcatccactgaaattacagatgctatcaaatctggattggatgaacctatagagccggaacctgaggtacctttaacttaaaaccttgttagttgatcctgatttgacattagaaatatcaagttacccaatgactgttgacttgtttattggtactgtgttttgattacatttaaaagttatgttgttttatgagttataaccacaatatgagtggtgaatttattcttcatgtgctatgatgcgtctctgccacactgatcgcacttgtttcattgcacatgaatggtgaaactctatttgtgagagtcaactttgtttatgagttgggtgtatcttgattactgctcagctaattgcttatatgcatatgcagctcgaggttccaaaagaacttgtactatcatcaaatctacaagagttaaaagagcagcgcaaaccagcgtttattccagtaagtcctgaaacaaatgctacaaagcttcatgatgaggaaactggaatcacccgacggcgtcttgcaaatggaattcctgtgaactataaggtttgttgtgtttatattaaggttttcatgattgtagtaccttattttcatttttccttgctctttcattgtactgcattcaatgctccgtggtgtcttttgttctccatctcatgttttagaaatggtgactcagatatctaaaagtgaaacacaaagtggcgtgatgcggctgattgttggtggcggacgagcaactgagagttctgattcaagaggatctgtgattgtgggtgttaggacgcttagtgagggaggtcgtgtcggcaacttctcaagggagcaggtaacttttcttaccaactgatgttccaaatgttaatgtttggattatgtttattttctctcacgacataagttaaattatttgaacatcttgtgaatgtgattgtgtcatc

SEQ ID NO: 1128 - DNA, 661 bp, Xanthium strumarium
gtttggaacgttctacagctcataagcttatgttagccatgctaaaccacgacgaaaggtttgtagagccgtcaccacattcattgcagaagttgagtcttcagtcagttaaagatgctgtgatgaaccagtttgtgggtagcaacatggaggtcagcattgttggtgatttcactgaagaagaagtagaatcttgtgttcttgattatcttgggactgtgagggctgcaagttctccaaacacagaggagcgtattgaaaaaatttccttccgaccattcccatcagatcttcatttccagcaagtatacataaaggacacagatgagagggcctgcgcgtatattgcaggccctgcacctaatcgctggggatttgctactgaaggaaatgacctatttaatgtcattcagagatctggtgctgatgaaatgtcagaacaagtaaacttggatctagcagggaagaaacacattgatgttcgcagccaccctcttttctttggcatcactttgagtcttcttgctgaaattatcaattctaggctatttacaaccgttcgggattccatgggattaacatatgatgtttcttttgaattaaacctttttgacaaattggatcttggttggtacgtgatcgcggtcacttcaactccaag

SEQ ID NO: 1129 - DNA, 1915 bp, Xanthium strumarium
attggataagccagtgattcaaaggccagtgctagatcaatgtacacggttctcttgctttcatcatgggcggagaaaacggtttcctatatgcaaatctatcccaagtatgttatctgacaaatccgtgtttcatctgtcaaagcatggagtagatgatatatttattcgagttccatgtgcagctgtgggtcctgatgagccacatgcagcaagtacagcctggccagagggtgtggagaatggtacttcccagcaaatgcaactttgtatatcgtgggagatatagataatattccatcgattgttcaccacattgaagctgtttttggacagaagcaagttgacaacgaagctcctgtagcacctaaaactagtgcatttggtgcaatggctaattttcttgttcctaagttcacaggagggatatctgctgactcatcacatgacagatcactttcatcgaaccaatcaaagcttcctaaaaaagaaaggcatgcaattcgccctcctgttgagcataattggtcccttccagggacacacggaaatctgaagtctcctcagatatttcagcatgaactgcttcaaaacttttcagtcaacatgttctgtaagattccggtgaacaaggtccaaacatatggtgatttgcgtaatgttctcatgaaaagaatattcctttcggctttgcattttcgcatcaactcaagatataagagttccagccctccatttacatcaattgagttggatcatagtgactcaggaagagagggatgcacagtcactactcttacggtaaccgctgaacctaagagctggcaaagtgcaattaaagtggcaacacaagaggttcgcaggcttaaggaatttggtgttaccaaaggagaattagcacgttatctcgatgcattgttaaaagatagtgaacagttggctgcaatgtgtgataatatatcatcagttgacaatttggattttgttatggagagtgatgcacttggtcatatggttatggatcataaacaaagttatgaaagtttaattagtgttgctgggacaatcactcttgaagaagtgaacttcattggtgcacaagtattggagtacatatcagattttggaaaagagtctgcacctgtacctgcagccgtcgttgcttgtgttccaacaaagtacatgttgatggagtaggtgaagttgatttcaagatatccccaagtgagataactgctgcaattgaagaaggtttgaaggaacccatagagcctgaggctgagtttgaggtaccaaaggacttaataacctcaacagaggtggaagatttgaagttacagcttcaaccatcttttgtacctactggttcatcatattcgaatgctcttagatttcatgacatagaaacaggaatcacccagtgtcgtctctcgaatgggattgccattaactacaagatatccaaaaccgaaaaatgtggtggggtgatgcggcttatagtaggcggtggacgggcggcagaaacaccagaaacaaagggagcagttgttttgggtgttagaactttgagtgaaggggggcgtgttggtaatttcacaagggaacaggtagagctattctgcgtgaatcatctgattaactgttccctagagtcgacagaagaatttctttgtatggaattccgttttactacacgagataatggaatgcgtgctgcttttcagttgcttcatatggttcttgagcatagtgtttggcttgaagatgcatttgatagagcaagacaactatatttatcatattaccgctctattccgaaaagcttggagcgatcaactgctcacaagctcatgacagctatgttggatgaagacgagcggtttgtggagcccacaccacattcattacaaaattt

SEQ ID NO: 1130 - DNA, 1047 bp, Xanthium strumarium
ctagttatgaatctagtttgtcagtgataacatggaggtgagcattggttggggtatttttcagaagaggacatcgagtcttgtgtaatggattacctaggcacagttagaccaaccaaaggtgctgacaaggctttgagttacaatccaatcctctttagaccgtctcctcatgatctgcactttcaacaagtgttcctgaaggacactgatgagagagcatgtgcttacattgcgggccctgcacctaaccgctggggatatacagttgatggaaccgactttcttgtagtccataagaaacatgtcaatcagtagagatggacattcagaaaccgagggacaggttgttaaggcagagaacatcaattttgacctgcaaagaagatctaggaatcacccacttttctttgcaattgcagttgggttattggcggagataattaattcgaggcttttcactgaagtcagagactcacaaggattaacatacgatgtatcttttgagataaacctatttgacagattgaatcttggttggtatgttatctcggtaacatctacaccgggcaaggtacatagggctgttgatgcttgcaagagtgttctaagaggcttgcatagtaaaaagatagccgaacatgaactggaccgggccaaacgaaccctgttaatgaaacatgatgctgaaagcaagtcaaatgcatactggctcgggttgatagcccatttgcaggctgcttctgtccataggaaggatatttcatgcattaacgacatgacaatgttatatggagctgccactattgaggatgtttacctagcatatgaacagttgaaaattgatgagcaatccttgtactgttgcattggcattgccggtgctcaggctggtgatgatgacgtttcaggttctttacaagaggaggaagaatatggaggtcttcctggtgttatgcccgttggtcgagggtcccacactatgactatgccaaccacataatcattcgagatcacaatatttatctagtgcctggatgaagaccg

SEQ ID NO: 1131 - DNA, 2336 bp, Abutilon theophrasti
actacgtttacttcgaggacgaatgggattttccaccagaccgagagaattggcgggaagaggatttgaaggagtattgggtggatgctccgttggagatgaccaaacccggttgggacccggtttgggctgatgaggaagattgggaaattgttagggacgagattaaggagggtcgggacccagggattgccccgttttacgttccttatcggaagccttatccggctctaccggacaatcattatgatatttccaatcccaaagctgttattgaagagttggataggattgaggagttcctcagttgggtcagctacattttccctgatggaagctcgtatgaaggcacggtttgggatgatttggctcatggcaaaggtgtttatgttgccgaacaggggctggtcaggtatgaaggtgaatggctgcaaaacaacatggaaggtcatggggttgttgaagttgatatacctgatattgaacctgtgccaggttccaagcttgaagcaaaaatgcgagctgaagggaaaataataaaaaaagatttcatgactccagaagacaaagaatggttagagatggatgttgaagatagcattcgtctagcggatgggcagtatgaaataccattttatgagagtgatatatgggtcaaacattttgggagaaaaccggagaagggtcgataccgctatgctggccagtggaagcatggtagaatgcatgggtgtggtgtatatgaagtcaatgaacgtaccatttatggtagattctattttggagagctattggatgattcagatggttgtgatgagaacatttccgcgatgcatgctggtatagcagaggttgctgctgctaaggctcggatgtttgtcaataagccagatggaatggttagagaagagaggggtccttatagtgatcctcagcacccctatttctatgaggtggatgatgtgtggatggcgccaggctttatcaaccagttctatgaagttcccgattattggaagaaatatgttcatgaagttgatcaggaaagagaaatgtggttaaactcgttttataaagctccccttcggttacctatgcctgcagagcttgaatattggtggtcgaaagacgacactcccgaattcattcttatcaacaaagaaccggagcctgaccctgaagatccatcaaagctaatatatactgaagacccactcattttgcacaccccaactggacgattgatcaattacattgaggatgaggaaaatggtgtccgattattttggcagccgcctctaaaagatggtgaagatgttgatccaacgaaggctcagttcctaccccttggatttgatgagttctatggacgggaagtgattgtaaaaagggataatatatggaagcgtatagtaacggcaatagaaaatgcgttgaagccaggatttgataatctggaaaaatggactgaagagaagaagaaagctggtaagttgaagatggagcttattgaaaaggaacttgaccttatagaggctgaactgtgtttggaagaggccattgaggacatggatgaagacctaaagaagaaagagaaagaggaggagaagaagatggaaatgggtttgctggaggaggaagaagatactccattggtggctaagcaagaggaaaaagtcattaccaaagatgatgttgacgaagttgttgatgataaggaagatgaagaggaagaggaagaggaagaagaggaggaggatggtgttacaccgtctagttttggatctgttgcttccgatcagaagggaaagaagcccagggactctccattctcttcatcttcattgtcgttcgcttcttgcagccttgtttcagcagttccgtctgcattgcgagaatcagttttatcattgaaacgaggtagattacctccaaaatttcgtcctccctcaattgtggaaagctccaatgacccctcgaaaataatcgattcggtcagtttccgtccagtgcttggctgcagaggaagattgagaacattgaaccaagatcatcagaaatttcaaccgcaaaatcactctagcagaaagaagtctcagttacactccttatgtaagatcttatcatgcccttcgacgactgtgaataccagaagccgtgtaagacctccaggaaagcataaccgttttgagctgcattctgcgccggagaaatattcggacaacattttatctttgcatattccggtttgttattctggattatacacagatactataaggtattgagcatcaccagtggcggagccacatattggattgtgggatcaactgatc

SEQ ID NO: 1132 - DNA, 2093 bp, Abutilon theophrasti
tttttcctatttttataggcttgaagcaaaaatgcgagctgaagggaaaataataaaaaaagatttcatgactccagaagacaaagaatggttagagatggatgttgaagatagcattcgtctagcggatgggcagtatgaaataccattttatgagagtgatatatgggtcaaacattttgggagaaaaccgtatgtttcactatcaagtaatctatttcttgctgtctcatcattgccatcctttcattttccgccactttttcattgtgaccatgcacaagtcgcttttcttaatttaccaaatctgcacatgcacgtattgagcttgtatgttttttctgcaaggcttttgtaccttactttttctctcaaattatggtgtcatgaagacaaatgtttcggtttcagggagaagggtcgataccgctatgctggccagtggaagcatggtagaatgcatgggtgtggtgtatatgaagtcaatgaacgtaccatttatgtatgtgcttgaaatataaacaatcttttttgaggctcaaattcatatattgggatccatctcttccttgaagatgtggatttgtttgtgcataagatttaatacttgctgctgcaccttagtacttggcctctactttataagcccagttctcttttaaatattgctttctagtaacatacaaatttataagtagaaaattcatacaatatttttcaaaagaaatgctaagatatgatggtcatcgatcagtttggtgagtggctgacactatatatattccttattttttactcgcttgttgtatgaaccatttcagccactcgcattctgttttagatgtgcttgactgattttttgtgttccataatttgtatgatgcagggtagattctattttggagagctattggatgattcagatggttgtgatgagaacatttccgcggtaatctcaattatttcatacttaataaatagttcaaaatgaaatagggggaagaaattctatattatggcatttctctgacattgtagtttttcagatgcatgctggtatagcagaggttgctgctgctaaggctcggatgtttgtcaataagccagatggaagtatgtagccttgactcgattaactaattagatttgtatgagcacaaaatctcatttgacacagtaacttgtaggattcaatttatggaaacttgataaatgtctatatcctattcttgccaaagaactctgaatcttagataaatctctgtgcatatttcttttgagaaattcttatcatctacaaaattgacttggatctgttatatctgacatataattttctcttataattgtccctacaagtggttgaaatgattgacatgatgattctgtcctctagtgtaagtcatgtcgaccggtgtttcaagtgtgtgctatactctgtatcttgtgggaacttcattttgacttatgatggtgctgagccctttaaagttgtagaaacttatatttgaagtttgagtgcagcttgctttgttggatttcctccatttggaagttcctacttgaatactcagaaattttatttctttttgctctgctcataaatttattacatgactttctcattcaccaatgagcaagattcagatgattctagagatttaccagtacatgatactttggaagctcgattcctttttacattttatcactggaaatttcaaacattaactgtttatactcatgattcatgaattatctcttggcttgcatgtacagtggttagagaagagaggggtccttatagtgatcctcagcacccctatttctatgaggtggatgatgtgtggatggcgccaggctttatcaaccagttctatgaagtaagtaaaacttttcttttgcatggtggattctttccactttcatgaaaagggagcagtaataagtctgttgttggcaggttcccgattattggaagaaatatgttcatgaagttgatcaggaaagagaaatgtggttaaactcgttttataaagctccccttcggttacctatgcctgcagagcttgaatattggtggtcgaaaggta

SEQ ID NO: 1133 - DNA, 1654 bp, Abutilon theophrasti
actacgtttacttcgaggacgaatgggattttccaccagaccgagagaattggcgggaagaggatttgaaggagtattgggtggatgctccgttggagattaccaaacccggttgggacccggtttgggctgatgaggaagattgggaaattgttagggacgagattaaggagggtcgggacccagggattgccccgttttacgttccttatcggaagccttatccagctataccggacaatcattatgatatttccaatcccaaagctgttattgaagagttggataggattgaggagttcctcagttgggtcagctacattttccctgatggaagctcgtatgtaaacaaactccttttctcatttttagctcattttgtttgtgtttttcttgaatggcggtgcatttactttattggagtatgttaattcagggtgcttgtttaggatttaggagtttgcaattgagtagctaaatgtggattaggatattgaaacagaagtaggatatgtttatgaagagtttaaactttgtgaattgcacattttaatccaacagttaacttttgacttaattgattgctcattattatcattcttcttcttgtttaaggtatgaaggcacggtttgggatgatttggctcatggcaaaggtgtttatgttgctgaacaggggctggtcaggtttgtcaatgtttaactcatcgttcttgattactcgtgtttgtttatctgtgtttctgtatcataatgctggtttctgctttcttcatgcatacattctagtaccatcttgtattgaaggatcgatccttaagcagcagataagactgctgtagttgtaggatttggtgatgtcaagcaccaagatgctagagaacaaaagcaactgtgactctttcaggcgggggacgtttgttctggcacatgcctggtgcaccttggtgtgctgtcttgttagatgttaggcatgaatagaagtttgccaagtgaagttctcttgtatttcttttatttttcggttaaccttacttataatattaaaaagtggacaatatcaaactcattcaacaataaacttgggaccataaggaaaaggttcacattggcaaaagagagaaagaatgtttgttttgtaggataataaatttagtctattctttagattttgttaacagaattatatatcttaggcttgtggtatttatgtacacaaccatatacgtattgcactttagttgccagcacatttttctatcttactccttgggtaatataaaagttttagttccttgagtgtaccttgtgccctcgacaacactagtaggattgaaatggttgtgactgcattggtccaccctgtgactgctgtttgaatatttcattttcatcttttatgggtttatgattttgtttcatatttgtataacgagttgcatcaagtacttctgagctgcttactttttaaaatacaatagaaaatgtgaagagaaaattttacaagatgctttctttgttaggtatgaaggtgaatggctgcaaaacaacatggaaggtcatggggttgttgaagttgatatacctgatattgaacctgtgccaggttccaagtatgtaacaatttgtgaactatttatcatgtgcttatgtt

SEQ ID NO: 1134 - DNA, 380 bp, Abutilon theophrasti
aaggctcagttcctaccccttggatttgatgagttctatggacgggaagtggttgtaaaaagggataatatatggaagcgtatagtaacggcaatagaaaatgcgttgaagccaggatttgataaactagaaaaatggactggagagaagaagaaagctggtaagttgaagatggagcttattgaaaaggaacttgaccttatagaggctgaactgtgtttggaagaggccattgaggacatggatgaagacctaaagaagaaagagaaagaggaggagaagaagatggaaatgggtttgctggaggaggaagaagatactccattggtggctaagcaagaggaaaaagtcattaccaaagatgatgttgacgaagttgt

SEQ ID NO: 1135 - DNA, 336 bp, Abutilon theophrasti
aaggtattcctccttattcccttcagttcttacgtagtctatgaaattgatatcgggaatcctatttatcttttttcttttgctggaatggatgtttacaattcttgaacagacgacactcccgaattcattcttatcaacaaagaaccagagcctgaccctgaagatccatcaaagctaatatatactgaagacccactcattttgcacaccccaactggacgattgatcaattacattgaggatgaggaaaatggtgtccgattattttggcagccgcctctaaaagatggtgaagatgttgatccaacgaaggctcagttcctaccccttgga

SEQ ID NO: 1136 - DNA, 614 bp, Amaranthus chlorostachys
gagtttggaagaagcccttgaggacatggaggaatcattgaaacaacaagaagaggccgcgaataatattgacatggatgttgaggatgaggcggtgtctgtttctccgtcattacctgttgaacaggtggaagaagtatcacccgaggagatcaaagatgagggtagaaaggccgaggagatcaaagatgagggtggaaaggccgaggaagaggatgatgatgacgatgatgatgatgatgatgatttagcttcatcgagtttcgggtctgtttcagattcaaaggacaagaaaaatgaacctgggagatctgcgttttcaacactctcatttgcttcgtctggtttgctttcagcggttccatcaatccttgagaaatctttttcggcttggaagaaggaaagatctccaccgagagttccacatgaatcatgtagccgtaccagaagtaatgcaagatcttcttatatgattacttttcaccagtcattccccgaaaaggcgagcttgagagtgaaagctgagtacgttaagaagattcgagtgaaacaaggtagaaaatcttttgtcgcttcccaaacactcccttctcagttaaaatactctaaaaaca

SEQ ID NO: 1137 - DNA, 1798 bp, Amaranthus graecizans
tgagatacctgatattgaacctgttccgggatccaaacttgaagctcaaatgcgtgctgaagggaaaatttttaggagagatttcatgacctctgaagatagggaatggctggaaatggatattgaagatagtgtgcgtctggcgaatgggaattatgaaatccctttctatgaacaagaggagtggataagacagtatggaaaaaagcctgaaaaaggccggtaccgttatgctggtcagtggaagcatggcagaatgcatggttgtggtgtgtacgaagtgaatgaaaggcctatttttggtcgattctactttggtgagcacgtggaagattctgctggttgcgatgaagaaattgctgcgatgcatgcaggtatagctgaagttgcagcagccaaagctcgaatgtttgtcaataagccagatggaatggttagagaggaaaggggtccatatggtgatcctcagcatccctatttttatgaggcaaatgaagtgtggcaagctccaggtttcattaaccagttttacgaagttcctgaatactggaaaacatatgtggatgaagtggatcaagaaagggaaatgtggttaaattcgttttacaaagctccattaagactcccaatgcccgcagagcttgaatactggtgggaaaaggatgcacctccagaatttattctcctgaacaaggagccagaacctgaccctaatgatcccactaagctcatttataccgaggatcctctcatactgcacactccaagtgggcgaataatcgattatgttgaggatgaagaacatggtgtccgcttgttttggcggtccacgggtgataccgacccgtcaaaggtcgagtttttgccgcttgggtttgacgaattctatggacggaaaaaagcggatgagcagcaagaaggctttttgaagcgtttagtatgttcaatcgagaatttctgtaaaccctggtttgagaaactagaaaagtggactgaagaacagaagacagccagtgatttacgaaagaaactcttagaacaggaacttgaattggtcgaggctgagctgagtttggaagaagcccttgaggacatggaagaatcattgaaacaacaagaagaggccgcgaataatattgacatggatgttgaggatgaggcggtgtctgtttctccgtcattacctgttgaacaggtggaagaaatatcaccggaggggatcaaagatgagggtggaaaggctgaggagatcaaagatgagggtggaaaggccgaggaagaggatgatgatgacgatgatgatgatgatgatgatttagcttcatcgagtttcgggtctgtttcagattcaaaggacaagaaaaatgaacctgggagatctgcgttttcaacactctcatttggttcgtttggtttgctttcagcggttccatcaatcctcgagaaatctttttcggcctggaagaaggaaagatctccaccgagacttccacatgaatcatgtagccgtaccagaagtaatgcaaaatcttatttgatcacttttcaccattcattccccgaaaatgcgagcttgagagtgaaatctgagtgcggtatgaagattcgggtgaaacaaggtagaaaatcttttgtcgcttcccaaacacccctttcccagttaaaatactctaaaaacgatcaccaaggacgaagatcatggattaagtggtcgtgcacaccgccagaaagaatctcagacaagatattatcgttgcacataccactcgaatccttggactcgcgcataagatcgtgc

SEQ ID NO: 1138 - DNA, 653 bp, Amaranthus hybridus
ttgaagatagtgtgcggctggcgaatgggaactatgaaatccctttctatgaacaagaggagtggataagacagtatggaaaaaagcctgaaaaaggccggtaccgttatgctggtcagtggaagcatggcagaatgcatggttgtggtgtgtacgaagtgaatgaaaggcctatttttggtcgattctactttggtgagcacgtggaagattctgctggttgcgaagaagaaattgctgcgatgcatgcaggtatagctgaagttgcagcagcgaaagctcgaatgtttgtcaataagccagatggaatggttagggaggagaggggtccatatggtgatcctcagcatccctatttttatgaggcagatgaagtgtggcaagctccaggtttcattaaccagttttacgatgttcctgaatactggaaaacatatgtggatgaagtggatcaagaaagggaaatgtggttaaattcattttacaaagcaccattaagactcccaatgcccgcagagcttgaatactggtgggaaaaggatgcacctccggaatttgttcttctgaacaaggagccagaacctgaccctaatgatcccactaagctcatttatactgaggatcctctcatactccatactccaagtgggcga

SEQ ID NO: 1139 - DNA, 594 bp, Amaranthus hybridus
ggtagaaaggccgaggagatcaaagatgagggtggaaaggccgaggaagaggatgatgatgacgatgatgatgatgatgatgatttagcttcatcgagtttcgggtctgtttcagattcaaaggacaagaaaaatgaacctgggagatctgcgttttcaacactctcatttgcttcgtctggtttgctttcagcggttccatcaatccttgagaaatctttttcggcttggaagaaggaaagatctccaccgagagttccacatgaatcatgtagccgtaccagaagtaatgcaaaatcttcttatatgattacttttcaccagtcattccccgaaaaggcgagcttgagagtgaaagctgagtacgttaagaagattcgagtgaaacaaggtagaaaatcttttgtcgcttcccaaacactcccttctcagttaaaatactctaaaaacaatcaccaaggacgaagatcatggatcaagtggtcgtgcgcaccgccagaaagaatctcagactcgatattatcgttgcacataccactcgaatccttggactcgcgcataagatcgtgcaacatagatcaaagcatcgccccc

SEQ ID NO: 1140 - DNA, 1298 bp, Amaranthus lividus
tgttcttctgaacaaggagccagaacctgaccctaatgatcccactaagctcatttatactgaggatcctctcatactccatactccaagtgggcgaataatcgattatgttgaggatgaagaacatggtgtccgcttgttttggcggtccaagggtgataccgatccgtcaaaggtcgagtttttgccgcttggttttgacgaattctatggacggaaaaaagcggatgagcagcaagaaggctttttgaagcgtttagtatgttcaatcgagaattcctgtaaaccttggtttgaaaaactagaaaagtggactgaagaacagaagacagccagtgacatacgaaagaagctcttagaacatgaacttgaattggtcgaggctgagctgagtttggaagaagcccttgaggacatggaggaatcattgaaacaacaagaagaggccgcgaataatattgacatggatgttgaggatgaggcggtgtctgtttctccgtcattacctgttgaacaggtggaagaagtatcacccgaggagatcaaagatgagggtagaaaggccgaggagatcaaagatgagggtggaaaggccgaggaagaggatgatgatgacgacgatgacgatgatgatgatgatgatgatttagcttcatcgagtttcgggtctgtttcagattcaaaggacaagaaaaatgaacctgggagatctgcgttttcaacactctcatttgcttcgtctggtttgctttcagcggttccatcaatccttgagaaatctttttcggcttggaagaaggaaagatctccactgagagttccacatgaatcatgtagccgtaccagaagtaatgcaaaatcttcttatatgattacttttcaccagtcattccccgaaaaggtgagcttgagagtgaaagctgagtacgttaagaagattcgagtgaaacaaggtagaaaatcttttgtcgcttcccaaacactcccttctcagttaaaatactctaaaaacaatcaccaaggacgaagatcatggatcaagtggtcctgcgcaccgccagaaagaatctcagactcgatattatcgttgcacataccactcgaatccttggactcgcgcataagatcgtgcaacatagatcaaagcatcgccaccattttgtagtaaatttgacagcaaacttttgtcatctgtaatgagttgaattaccgattatttttggctctggcctcggaaaaatttcagactcgagaatttacgcatatttgtttattgtagcgcatttcgtgtatcaaaa

SEQ ID NO: 1141 - DNA, 1233 bp, Amaranthus lividus
caaaacccgacttggaagaatcacccgaacaaagaaacattcggctatttcaagaagcattgaagtcccgtagatacactcgacttactgaagaagatgagattctggctcggactactgaattggaaagattgtataatttcccgaaagataatgagaattggagggaagaagaccttaaagagttatgggcggatgctccgacccgtatgcttaaacctgggtgggacccagcattggttgatgaagaagattggaagattgttagagatgaagttaaagctggtcgtgaccctccaattgcaccattttatttgccttacaggaaaccttatccggctattcctagtaatcattacgatattagtaatcctcgggatgttattgaggaattggatcgtactgaggagtttttgcaatgggttagctatgttttccctgatggaggctcgtatgaaggcactgtatgggatgacatggctcatggcaaaggtgtttatgttgcgcaacaaggtttagtcaggtatgagggagaatggcttcagaacaatcaggaggggcatggagttgttgaagttgagatacctgatattgaacctgttccgggatccaaacttgaagctcaaatgcgtgctgaagggaaaatttttaggagagatttcatgacccctgaagatagggaatggctggaaatggatattgaagatagtgtgcggctggcgaatgggaactatgaaatccctttctatgaacaagaggagtggataagacagtatggaaaaaagcctgaaaaaggccggtaccgttatgctggtcagtggaagcatggcagaatgcatggttgtggtgtgtacgaagtgaatgaaaggcctatttttggtcgattctactttggtgagcatgtagaagattctgctggttgcgaagaagaaattgctgcgatgcatgcaggtatagctgaagttgcagcagccaaagctcgaatgtttgtcaataagccagatggaatggttagggaggagaggggtccatatggtgatcctcagcatccctatttttatgaagcagatgaagtgtggcaagctccaggtttcattaaccagttttacgatgttcctgaatactggaaaacatatgtggatgaagtggatcaagaaagggaaatgtggttaaattcattttacaaagcaccattaagactcccaatgcccgcagagcttgaatactggtggg

SEQ ID NO: 1142 - DNA, 2875 bp, Amaranthus palmeri
ccatttctcattcttcttcaacaatggcagaccaacaacaagaagaccagccattacccaggaagaagatagcttatctggattccgattccgactccaactcagactcagactcagaatccgaatccgaatccgaatccggaccctccaaacccacaagcaatgaattcaactacaaacgacccagtgactacctcgcctcaaatcccgacttggaagaatcacctgaacaaagaaacattcggctatttcaagaagcattgaagtcccgtagatacactcgacttactgaagaagatgagattctggctcggactactgaactggaaagattgtataatttcccgaaagataatgagaattggagggaagaagaccttaaagagttatgggcggatgctccgacccgtatgcttaaacctgggtgggacccagcattggttgatgaagaagattggaagattgttagagatgaagttaaagctggtcgtgaccctccaattgcaccattttatttgccgtataggaaaccttatccggctattcctagtaatcattacgatattagtaatcctcgggatgttattgaggaattggatcgtactgaggagtttttgcaatgggttagctatgtttttcctgatggcggctcgtatgaaggcactgtatgggatgacatggctcatggaaaaggtgtttatgttgcgcaacaaggtttagtcaggtatgagggagaatggcttcagaacaatcaggaggggcatggagttgttgaagttgagatacctgatattgaacctgttccgggatccaaacttgaagctcaaatgcgtgctgaagggaaaatttttaggagagatttcatgacccctgaagatagggaatggctggaaatggatattgaagatagtgtgcggctggcgaatgggaattatgaaatccctttctatgaacaagaggagtggataagacagtatggaaaaaagcctgaaaaaggccggtaccgttatgctggtcagtggaagcatggcagaatgcatggttgtggtgtgtacgaagtgaatgaaaggcctatttttggtcgattctactttggtgagcacgtggaagattctgctggttgcgatgaagaaattgctgcgatgcatgcaggtatagctgaagttgctgcagccaaagctcgaatgtttgtcaataagcctgatggaatggttagggaggagaggggtccatatggtgatcctcagcatccctatttttatgaggcagatgaagtgtggcaagctccaggtttcatcaaccagttttacgaagttcctgaatactggaaaacatatgtggatgaagtggatcaagaaagggaaatgtggttaaattcattttacaaagcaccattaagactcccaatgcccgcagagcttgaatactggtgggaaaaggatgcacctccggaattcattcttctgaacaaggagcctgaacctgaccctaatgatcccactaagctcatttataccgaggatcctctcatactccatactccaagtgggcgaataatcgattatgttgaggatgaagaacatggtgtccgcttgttttggcggtccaagggtgataccgacccgtcaaaggtcgagtttttgccgcttgggtttgacgaattctatggacggaaaaaagcggatgagcagcaagaaggctttttgaagcgtttagtatgttcaatcgagaattcctgtaaaccctggtttgagaaactagaaaagtggactgaagaacagaagacagccagtgaaatacgaaagaagctcttagaacatgaacttgaattggtcgaggctgagctgagtttggaagaagcccttgaggacatggaagaatcattgaaacaacaagaagaggccgcaaataatattgacatggatgttgaggatgaggcggtgtctgtttctccatcattacctgttgaacaggtggaagaagtatcacccgaggagatcaaagatgagggtggaaaggccgaggagatcaaagatgagggtggaaaggcggaggagatcaaagatgagggtggaaaggttgaggaagaggatgatgatgatgatgacgatgatgatgatgatgatttagcttcatcgagtttcgggtctgtttcagattcaaaggacaagaaaaatgaacctgggagatctgcgttttcgacactctcatttgcttcttctggtttgctttctgcggttccatcaatcctcgagaaatctttttcggcttggaagaaggaaagttctccaccgagagttccacatgaatcatgtagccgtaccagaagtaatgcaaaatcttcctatatgattacttttcaccagtcattccctgaaaaggcgagcttgagagtgaaagctgaatgcgttaagaagattcgagtgaaacaaggtagaaaatcttttgtcgcttcccaaacacccttttcccagttaaaatactctaaaaacaatcaccaagggcgaagatcatggattaagtggtcgtgcgcaccgccagaaagaatctcagactcgatattatcgttgcacataccactcgaatccttggactcacgcataggatcgtgcaacatagatcaaagcattgccaccattttgtagtaaatttgacggcaaacttctgtcatctgtaatgagttgaatcaccgattatttttagctccggcctcgaaaaattgcagactcgagaatttacgcatttttgtttattgtagcgcgtttcgtgtatcaaagataagatgtaagatttgttagttgagtgcaatttaaaagtctttgttttaaaggcatagttttgtaagattgtttatgctgttgtatttgtatatcac

SEQ ID NO: 1143 - DNA, 12165 bp, Amaranthus palmeri
tttcatgatatgtatcatgtcattcccatggtaatgaaagtttgatcataaaaatttgttcacaattttccattaccacgaccattacatttgtcaagatttatctctaccaaaattacgctaactttctattgccattcccaccatttatttagtattgattaccaaacgggctattatgattttgcagcttttcgcttactctattttattgctgctatttaaattactacttgaacagatgcacctccggaatttattcttctgaacaaggagccagaacctgaccctaatgatcccactaagctcatttataccgaggatcctctcatactccatactccaagtgggcgaataatcgattatgttgaggatgaagaacatggtgtccgcttgttttggcggtccaagggtgatgccgacccgtcaaaggtcgagtttttgccgcttgggtttgacgaattctatggacggaaaaaagcggatgagcagcaagaaggatttttgaagcgtttagtatgttcaatcgagaattcctgtaaaccctggtttgagaaactagaaaagtggactgaagaacagaagacagccagtgaaatacgaaagaagctcttagaacatgaacttgaattggtcgaggctgagctgagtttggaagaagcccttgaggacatggaagaatcattgaaacaacaagaagaggccgcgaataatattgacatggatgttgaggatgaggcggtgtctgtttctccgtcattacctgttgaacaggtggaagaagtctcacccgaggagatcaaagatgagggtggaaaggcggaggagatcaaagatgagggtggaaaggcggaggagatcaaagatgagggtggaaaggttgaggaagaggatgatgatgatgatgacgatgatgatgatgatgatttagcttcatcgagtttcgggtctgtttcagattcaaaggacaagaaaaatgaacctgggagatctgcgttttcgacactctcatttgcttcttctggtttgctttcagcggtacgttaatgtttttaattttttaatcttcattgttggagtgttcacggagaggcagtgagcagtaggtttggaatttttttaatgtttccgatccttatctagtccttttattcgtttcattttaattattatagtagagcccattttaggcccggcccttacaaagcccttctaaaaatgggccagataagggctcaaattgggggccgagcccattgaacacccctagtgtcaactagcttagttacttctaatcacatcccaagttcatgaaccaaaaatcaattatcgatgaggaagaatacgggcaacattggaattgatgtattggttcacgtagcggatctctatcgtttgggtttaagacttcggcattgttggaatttatcagtaatgctattccaacacaattaacccttagataggttaatgatggaaagcacaatcggagtgataattgtcatataatttgcatatatcgagtgtattagcgtactaatatgttgttcattgtttatgacttgtttggcagttctttttagtattattctgtaaaaaagatcgatctcgtccataactgtttcccttttatttcgttaagaaatcaatccgcgtagcaatctttttcctttcttttttggggatgtgggcgtcttgccagtcatatgaaccaattatacttcctaaaaatatatgcttaaattttatccttttttacaggttccatcaatcctcgagaaatctttttcggcttggaagaaggaaagttctccaccgagagttccacatgaatcatgtagccgtaccagaagtaatgcaaactcttcctatatgattacttttcaccagtcattccccgaaaaggcgagcttgagagtgaaagctgagtacgttaagaagatccgagtgaaacaaggtagaaaatcttttgtcgcttcccaaacacccccttctcagttaaaatactctaaaaacaatcaccaagggcgaagatcatggattacgtggtcgtgcgcaccgccagaaagaatctcagactcgatattatcgttgcacataccactcgaatccttggactcacgcataggatcgtgcaacatagatcaaagcattgccaccattttgtagtaaatttgacggcaaacttctgtcatctgtaatgagttgaatcaccgattatttttagctccggcctcagaaaaaattgcagactcgagaatttacgcatttttgtttattgtagcgctttttgtgtatcaaagataagatgtaagatttgtcagttgagtgcaatttaaaagtctttgttttaaaggcatagttttgtaagattgtttatgctattgtatttatatcactgatgttgcattcagaatatttgtgctgtatttggttgtttcagtgggagtgactggctatagtcatggagaattttcaacccaaacttccatcttttcccttgccttactcctctgttcgcttgaatttgctacatagcgtgtctgcactttgcacacaaccccaagaaaaaggcagaagtgagtattttagtaagatatgtaggtggggttatgttatttagtgaggatatgaaggtgaggtcatatcttttagcggagtaattatagactttaaattgcagagttcttattacttgggggtttaatttgactgagcgcatttttcttgctctcttcctcaagagagtacgagtatatgtctgtgactcctcccttcggacccttattttgtgtgggacactgccacactgggctgatgaccaaaatcaggtctagacaaataaaataaattagattgtagtgagatattgtgggtggaaaatcatgtacataagaggtaacataacaaattgccaaatcatgtttgacgaagtaaatagtctatgtagcaaaattgagggatagttggagtaactatttttctacataataaacacatattttctttgatataagtataagcagggccggccctaaggatgggtaagaggggtcatcgcccagggccccgatgaccccacatcaaaaaaacaaaattagtgattttagaaggtctatataggttataaattgcaaaggaaaaggaccccaatgtgccattttgcccagggcctcaaaatatctaaggccggcactgagtataagcctttccttttaatttctatatgtgatgtgttatatttttattcacataaataatttatatatctacataaatcattaatattttatcttgtgtattcgctcatcaaagttatgatttgagttgggagaaggatggaaaacgatagaccatatcttaaaaaaggttgcagttgataaaactctaggtttgagagaacctacaaacgcaaacaaatgcccaaaataaaacaagacaaatgtaactattttaataaaaagtgctttcgtaaatacttaatagaggtataatctgtaatacatttacaatagaggacgtcctattttttcgatttagttttttatttatgaagcattccatcaaataatatgcatattcgtttaaccattccaatatcttacatttaaaactctaatatttttaaaataatgattctatataacgtctattaactcaaattaaaaaaaaactacattagcatgaaatcaaataattaattttataataaagcagtgaagtaacaatttcatttattatcgaaatggtaccatcaaatgaatcgctcatagaaatataatttccaattgtagaaaataaaaataatgttttgttacaagaaaaaaaaataatcttaaaaaaaaagatagaaaaaaataaaatcgccgttgccggggatcgaacccgggtcacccgcgtgacaggcgggaatacttaccactatactacaacgacttgttgattataatttggttagccattaatcattacctaattttgcctcacctttgaattacggaagaacaatccatcaaaaacagaatgaaagaaaatcgaaacaaaattagttctgtcaatgtcattgcttaaatccttccactttaatggaaaatgcactctttatactcttcaggtaaaactatttgtcaatacgcaatctaaactttcttaattcaacattttataatgttatttgtttgaatttcagttatttactattctgtattttcgaatgtagaatctaggtgaaaatattgctggaagacacaattttgcaagattaatctgctctgcactcttccattcatttgtcgaacatcgttctgggtttgatcaaaatggaagcacttttcgtagtaatgatcgaacttatttgtggcttttaaagggatggattaattccggttcctggtcattacttgattgcagaaaacttcatgggttgatgtttaaagcaggtattattcaagatattgaattatattatcggctgttcggattttataagttcaatggttgtttctgggatgcccataaactgtttgatgaaatgcttgaaagggatattagtttggtattgcttttgcgtatgttgagtgagaatgtctatcaggatgagtttacttttgcaaatttgtttagggaatctggtggggaaaagagtgatttttggtttactgatcagttacatgctaaggttattgttaatgggtttgatcgtagtcgttttgtttgtaatcctttgatcgatttgtactcgaagagtggaatgagaaaatatgctaaatgtatttttaagaacataggtgagagggataatgtgagttgggttgctatgctttttagattatctcagaatggattccgagaactagctattcgcctattctgtgacgagatccatgctctatctagtgtttcgaattcctacggtaagactgagccatttaagttcggagaggaacttcatggttttctttataagtggggttttgcttttgatgattttgtgtgcaagacgcttgtgaacttttattctcgttggggacagtttatttccgctgtaaaagtttttgagacgatgatgcatagggatgaagttatctataattcgcttattacagggcttgttcagattggccgtagttttaatgccctttgtttgctacagatgatgcagtatgatctgttagaacccaactgcgttacagtggcaagtcttatcagtggatgttctgcgattggagctattgagaagggacatcaacttcacgcacacacactcaaggcgggattcttctctgacatgcttattcaagagtctttgctagacctttatgtcaaacggtctgatctcgaaacttcatacaagtatttccttactacccaaatagagaatttggtcctatggaacgtaatgtttttacgaatgcagatgaagggtttggaacctaatcagtacgcaattccggtcacaagaacttcggaaggagctctaaacttgggaaaacagtttcatacccaagtcattactacaggatttcagttcaatgagtatgttagttgtgttcttatagatatgtatgcgaagcacgggaacctaaatgctgccgaaaagattttcttgggggtcagtgaaaatagcgttgtctatacggctttgataactggatataggcagctcgagatgtatggttatgctttgaagcttttcaaagtgatgttaagccgtggtatacaagctgataatattggattgtcgagtgtaatcagttcgtgtgcaggaattcgagcatattaccaaggtcgacaaattcatgcccaatgctatgttcttggttattgtggtgacgatgctattcagaatgctcttgtaggtctttatgctagatgtggaagaccccaagacgcctatcgtgcatatgatagactcgaggtgaaaaataacaatgcgttgattacgggttttgcaaaggttcgagaggagatgggtccatttggtgatccttgtctatatcaggacgactatctgtgtcaggctcccgcataaatagtggcggcaaacgactatttactacgcaagtatgggtgcacgaaagtgtttgcacccataagcacgtgtatatatggcgtgcaatattcgacaaaagatacacctaattgcgagttgcgagttgcgaccattgtgttaacgactatatacttgggttgctgatgaacattgcccggatttcaatcattagctcaacattttttatacacgtttgcttggtttttgtagttctagattttgtagattgcttattgcattttgtttgaagaacttcatttaaacaagaagcactaataagaatcaatagaattatagaaataaccttttgttggtcctataactaacataggtaagtttaatacataataaaaatgttcttagtacaatcttattattaacaaaaaaatcatttcaacaaacacaatttttttaaaaagttaaaaatccatctggcgactcaagtttttttgcttttccacgtggtaaagaaacattttttcaatttgcgtgatgactctaagtttttaacttttccacttcatagacaaaaaggttaaggtttttgttaaatttacattcttattaaccttcatgaagacttctttagtaaaaatagacatcacgatcaccgttatggacatattttcggaaatttgtttgaaatgagaatttaattaaacaaaaaacttaaattttttctactgaacagaacaattgaaagttctaagtcaccatgtggaattaaaaaaaattgtataccacgtgaataaaaaagaaaaattatatcgccgttgccggggatcgaacccgggtcacccgcgtgacaggcgggaatacttaccactatactacaacgacaatgtgataaaaagtcaatgaattgctattttaatatgtaatggtacgaaacattttagttagtttggagttatagtaattactcactaattaataataacacgccattgaaaggcgaacaaaatcaatggtgtcaatttccttgcttaataattccttccatttccatggaaaatccaccatttatgctctccaggtaaaactttttatgataaagctatttaacttggtattttttaatttttcatttgaatttatatgaacttctgtggtttattcttctgtatttttgaatgtagaatcttcacagaattgtgaataaaagattcaaactagctagtttaagcagctctgctattcgccatgcttttgttgaacatcgctcagaacttaatcaacatgaaaccccttttcgtcccaatcatcaaacttatttgtggcttttagaaggatggataaattcctgttctggatcattacttgattgcagaaagcttcatgggttgattttgaaatcgggttttactcaagatattgaattatgtgaccgtctgttggagttttatatctccaataatcatttctgggatgcacataaactgtttgatgaaatgcttgagagagggataaatgttcatgtttctatatggaataagataatgtacggtcttttggatagaaaattgattagggaattgttgggattgtttttgcggatgttgagtgaaaatgttgatccggatgagtttacatttgcaaatttgttcagggcatgtgatggggaaaaggctgatatttggtttatagaacagttacatgctaaggttattgtgtatgggtttgatcgtagtcgttttgttagtaaccctttgatcaacttgtactcgaagaatggaatgaccaagtatgctaaatgtgtttttgaaaatttaggtgagagggataatgtgacttgggttgctatgatttctgggttatctcaaaatggattagaaaatcaagcgattcgactattctgtgatgaaatgcatgcacatggtatacttcctacgccatatgctttatctagtgttttgagttcctgtagtaagatcgaggcgtttgaggttgggcaggaacttcatggccttatttataagtggggttttgcttctgaaacttttgtgtgcaatgcgcttgtaaccttttattctcgttggggagactttgtttctgctaaaaaggtttttgagaagatgaagtacaaagatgaagtatcgtttaattcgctaatttcagggcttgctcagaagggatttagtgttgacgctctttgtttgctgcagaaaatgcagcatgatttgttaaagcccgactgtgttaccgtggcaagtcttgttagtgcatgtgcttcgcttggcgatcttgagacgggcactcaacttcattcatatgcactcaaggcgggattctgctccgatatgctcattgaagggtctttgctagatctttatgtcaaatgttctgaaattggaactgcacacaagtatttccttactaccaaaagggaaaatgtggttctgtggaacgtaatgcttgtagcttatgggcagattggcgatctaactgaagcgtatcatatgtttttacgaatgcagatgaagggattggaacctaatcagtatacatatccaagcatgattagaacatgtacctatgaaggagctttagatttgggagaacagattcatacccaagtcattaaaacaggatttcagttcaacgagtatgttagcagcgtccttatagatatgtatgctaagcacgggtacctggatgctgctgaaaagattttcacaaggctcaatgaaaacgatgttgttacctggacagctatgatttctgggtataggcagcacgagatgtatggtcgtgctctgaggctctttgaagagatgttacgccgtggtgtccaagcagataatataggattgtccagtgcaatcagtgcatgtgcaggaattcaatcactataccatggtcggcaaattcatgctcaatcgtatgttcttggttactctaatgatctttcgattaataatgcacttgtaagcctttacgctagatgtggaagacttcaagacgcatatcgtgcatttgaaaaaattgatgtgaaagataacacatcatggaatgcactgattacgggttttgcacaaagtgggcattcggaaaatgcattgagagtataccgtttgatgaatgaagctggtatagaagctaatctgatttcctacagttcctcaatcagtgctgctgctaacacggcaaatgtaaaacacgggaagcagatacaagcaaagctatttaaaactggttaccatatggaaaccgaggcctcaaatgccttaatcacactgtatgcaaaatgcgggtgtatcgatgatgctaggagagtgttttcggaaatgaccgaaagaaatgacgttacatggaatgcgatgataacagcttattctcagcatggttgtggggctgaagtcctggagatcttcgatgagatgaaacgggttggtgtggcaccgaatcttgtcacatttttgggagtattatcggcatgtagccatgtggggttagtggaaagggggctaatgtactttgagtccatgagccaagagtatggtttggttcccaaacaagaacattatgtctgtgttgttgatattcttgggcgggcggggcaactcagccgtgctaggaaatttaccgaagatatgcccatcaaaccggatgcaaatatttggagaactcttttgagggcatgtgttgttcacaagaacaaagaaatcggagagtttgctgctcatcatctgttacagttggcacccgaggactcagcaacctacgttctcatgtcaaatatgtatgcagtgactagaaaccgggcccttatggacgaatctagaagaatgatgaaagaaagaggagtaaagaaggagcctggccgtagctggattgaagtaaagaacactattcatgcgttttatgcgggtgataatcttcatcctctgaaagataatatctatggcttcttggaggatctggataagcgtgcatccgaaattggttttgtgcaaaatcaatacagcattccgattgatgcagaaaagaacggaactgtcaatgttcatagtgaaagacttgctattgcttatgggctaatgagcttatcgagttcagttcctcttcatgtaatgaaaaatcttcgtgtatgtactgattgccataactggatcaagtgtgtttctagtatctcaaaccggacaattattgtgagagatgcatatcggtttcatcgttttgagggtggctcgtgctcgtgtaatgactattggtgagtgaattagttggaatatttttggagttgtcgctgtggctggcgccacgtcctagatgggatgatcgtaaagaactctactcaagccctatttgtaacgagggacgaggaagagagtacatagttaagcagtgctacttctcgttcgacatacaaatgagctgatattttccgcgtttcagtttgttcgtttagaaaggtcaatccttaagaacttactataggatttgaggatataggcatgtatgattgaaggtagacatgagaatatggcaagataatgataatggtagattcaggtcatcgggttggtttcgggtcagatctttcaggtcggttaaaaatcggcttctgtgtccatattggtttttacatatttttaattcattttaaagtcgggtcaagtcaggctcatttacaaggtcggataaatatctggtcgttaggtctgttttgaacatctctacttgaatgcatcataattaatgatgcttaattcagctgcatagaggtataaatttgtacatatttggctgtagttttggtagatatatgatgtatatgaaccctcaagatcaatccttattgggttagaattagaaatttgatcaatcctttgttaataatcaatgattatttgtgcattatagtaggttttcaggcctttttattgatgaaatgacctatcaaaaattggatctctcgactctattatcgaatcgaatggattgacacgtagtcttcttattctattacacgtgtttggctaggttcaacatagtctatagaaaagcattttaagtcgttattaaccaatctttttttcttgttacttggagctcttattgttgccctacaaccctaaatcttgagattcaaaaaatacacgtaaaaggctttatgggtcagatttaggtcttaaaagtgtggatctgaacccgaacccataatatagatggatctagaccttaaagtagggttggatcgattctgcacctttaggatccaaaatccatgctcatccctcgttgaaacttgagatgatatcaattcaattaaaataacatggatatttatactcatctcttttattcgtttcaagtctttgtagcatgtatctgaattttattctgtttaacgtatatggtaatgactataatttttgaatttattattcgcttaaaattatccaatatttactaattatggaaatcacaaagttcattgtgtatcaactaagtgcctagtagtacttttaccctcttaaaaagagctataataatcttgtactccatattgaaaaattaagtcaaattgaaacattatataaaagttattattcacatgacataatgatgccacaaaataaaaataccaccattaactttaatatgaataatcaaacttattacatgataatttatattagagaaaaatttaaagaaattgtgctttaaacaaggacccatataatttaataaaaattgtgcaacctcatttttcagtagtcctaatatatttgtcattcggccttggtgtatacttttttcgatataactgtctacttctcaaatactgccatcatttaatattagattaccattgtatttaattaactaatagtataagtaaaatcctaataaaaagtatagtatcctttaaccatcttaattaaaatattcaatacacttaaataatgctcatttaataaataaaattgataagattttataaataattgaaaaaaagaaataaagtttatgattttctaatacattaaatgatgttacctaaaaaatatataattaatcaatattagtcatatttataaagtaagaaaatcaaatatataaatattagtcataataacaatgacgtcatcattgagttttgaagg

SEQ ID NO: 1144 - DNA, 5867 bp, Amaranthus palmeri
ggagcaaccttaggataagtcatctcatgagaagttttcccaaacaagcacgagtgaggtcaaagtgcattgaaaaagcttgtgttggtttgtagggaagtctacagtctccataagtagtcaccagcgatccaatggggttagggtgttacaaaaccctacatggagaagttaacatattcataattcctacttcatataccctgaatcactatctaaggtacttttttttttttgagttaactatctaaggtactttaaatccaaaatagattcctaaacccgtacttgggtttaattaaatcccttcttaatgtcccctaaataccaatttgttatactctaagcccaacttattatggtgtaaaaccctatttgatgtattctaaatgcctactcaaggtatattaaatgtctactcgatatactgttaactcctacttgagttatcctaaatgcatacttgaggtatcctaaaaccctattgaataagggtacagttacacatcacttataaatttgtgaactttaaagggcaacgaagtttaagtttggataaataaatcaagatctatttaggacctgtggccccgactgatccactagttttgggtccaaatccaaaattttcaaccctaaggatatgaatccaagtattagtccattaaaaaataaatctaattgaacatgattcagactcgacctatgagtccatgaccatccctaaccctttttactctttttgccaacttagtaaactgttctaacaaaatccaaaatctagtctagctaattttatggcgaatctaaagttaaatatggataataatcaatcctaaataaacaattacttatgatttaatttttttatgttgagtttataatacaattttttgaaattaaaagaattatagattttaattttgatgaaaaaaaaaaattatacccaaaaatttaaaaaaaccacatctaattatctatcttgttcctactctcacttcttccctcttctttaccttatcactattatccccttctccctttctccctattcactccccatttctccatttctcattcttcttcaacaatggcagaccaacaacaagaagaccagccattacccaggaagaagatagcttatctggattccgattccgactccaactcagactcagactcagaatccgaatccgaatccggaccctccaaacccacaagcaatgaattcaactacaaacgacccagtgactacctcgcctcaaatcccgacttggaagaatcacccgaacaaagaaacattcggctatttcaagaagcattgaagtcccgtagatacactcgacttactgaagaagatgagattctggctcggactactgaactggaaagattgtataatttcccgaaagataatgagaattggagggaagaagaccttaaagagttatgggcggatgctccgacccgtatgcttaaacctgggtgggacccagcattggttgatgaagaagattggaagattgttagagatgaagttaaagctggtcgtgaccctccaattgcaccattttatttgccgtataggaaaccttatccggctattcctagtaatcattacgatattagtaatcctcgggatgttattgaggaattggatcgtactgaggagtttttgcaatgggttagctatgtttttcctgatggcggctcgtaagtttcattgtttatttagctttgttattgattagctgtattttccattgcattatattatgttttcaatgcaatgtattgatttgggttaatcggaaaaaaacctctttaattgtgattgacgagtgtatcccaaaccatgccttagtgtgagccacttacaggaattggggcattgaaaaatgaaatacaaggaattgatttgtatatttcaaattgttagaagtgaattttattatcttcctggattttagttgggttttagtttgtttccttgttgggaacttatatgataattatgacatttttttttattagaataggaatgctggtgtattttagttttgacatgattggttttggttttggttttggttttggtttatgtaaactgtgcataagggtttgtgaagcataaaaaaattagtgtttgcttgtgttttgtgtggttgttgaatagttcatgcaatgcttgatatcatcttgtaggagttctttgtattgtttgattgatttagcatatgaaaggtataagtataacacataaaatcatggagtttagaacttggttaggtttaacatgtataagccgtcccttttgacggggttagcagcacaaattgtttactcgtttggaacgatttagatactgatcatcatattgggttgtctttttctttgctaagcccattgctcaacatcgattgcttcgttgtagtcagagtctggtcttggctattcgactgtaaagaaaatttgttatttgctatttttgtggtggcttagccattaacttcttccgttattgatatccatgataattttaatgcacatgacttcaaggttaaactattttctgtggaagatcccccttttcccagttttgtttcaaattagagcttgtatcgtacttgctactggattcatgtattcttcaatttgtaaaggtatgaaggcactgtatgggatgacatggctcatggaaaaggcgtttatgttgcgcaacaaggtttagtcaggtctgttaatattgctttttttgttttttttggctatcaagggttaatcagaatttggaagcaacccatttgctataaagttaaggttgcgtacatccgatcatccatattccctcccaagtgggagatgcgttatggtattggggaaatggattgttggtgttgtgattttctgaacatttgggtccacattgatgttgattttagctatatttagtaaatactgagttgaaacgaatttcttactgtaggtatgagggagaatggcttcagaacaatcaggaggggcatggagttgttgaagttgagatacctgatattgaacctgttccgggatccaagtatgtctattgacaagaaagtacatttgaatgattagttgtcatggaaacacttttgaatcttccaaactgaattactggatgtttttgtcagactggaagctcaaatgcgtgctgaagggaaaatttttaggagagatttcatgacccctgaagatagggaatggctggaaatggatattgaagatagtgtgcggctggcgaatgggaattatgaaatccctttctatgaacaagaggagtggataagacagtatggaaaaaagccgtaagttattgctgttaactttcaatttgttggttttcaccagttaatttttactttttttgtaaaattattttatgcttttgttcgccatacacaatttgtgtgcagtttgtagcttttttgaacatattatatgagtacgcgataaatgcttgatccccttaccagcaatgagcgtttgcaccaatgaccaatgcatatgtttctatcaacatcatgtgctggagagtggagagtttgtttgaagaaatttaatagattctcatatgttgttgagattgataatagagcttaaggcaagcttgaccgaattaaaatgtagtcttataatcctgttttcgtttaatatatttattcctttaaaagtgatatcttgaatctttctcacttttttgctgatgctatatctcctcaagttcttttctctaatgatagtgccatttttgtcttgtattcattttatgtttactgtacagtgaaaaaggccggtaccgttatgctggtcagtggaagcatggcagaatgcatggttgtggtgtgtacgaagtgaatgaaaggcctatttttgtaagtacttgaaaatactttcacgtctttatttcgtttgtgcatgcttattttcagattttcttgattcatccacggaagtttcttttccaaagcatcccaaaagatggggttggctattgctcgcaatgttttgggcaccttcgtatacgttcacccatttaagactgggaataatgatgattgaaaaaagaacactgaacggctcttttatatacaatttcatgtacgttatgtcattatgattgttatgcaatttgcatgggcagcattggtaacattaataactacacgagagtcgatacgaggaaatattttgctcgagtgatattatagcttgttgcttttttcaattttccggtcaaactgtgcttacagtcatatatacttggtgtttgttatttttgggtttgaagggtcgattctactttggtgagcacgtggaagattctgctggttgcgatgaagaaattgctgcggtatggctcacttttatcaactgttagacgtccggttggaggctctttgataaaaatattgtacatttgtacccttacctgaggactattcagatgcatgcaggtatagctgaagttgcagcagccaaagctcgaatgtttgtcaataagccagatggaagtaagtcctcttttcttttctcagaatactgtaacgctgatgcactcagaggcgaggagtttgttttctgtcaccacaagcatgagaaaaaatagacccgagggggagggggaggagttatgttttctgtcaccacaagcatgagaaaagatagacccgagggggagggggaggagtttgttttctgtcaccactttttatcttaattattgaatgtgttcatgttcgctatagtgctcaaggaatctagtcttggcattgtcacaatttatatatcgggtgcggtaagctcaaaagttttattatgacgtactcatgactcaatgccgtaacgcttatgcattcagaggcggagcaaacattgacaaattctttgaaagtcctgtgaaatttaaaaaattattatatttttctaatagctttgtttcttaaacccttaacatatactatgtaatttaatattgaggctcccaattttttggtcccctatgcggtcgaacatgttgatcatgctcagaacctcctctggatgcactaagcttcagctaataaaaatgacaaattaatggcgaagattgtaaattactcaagctattatttatctaaaacacaaattttttgtgacattgatgatttaagtggtaatggttggtcttggaatttgtctgcagtggttagggaggagaggggtccatatggtgatcctcaacatccctatttttatgaggcagatgaagtgtggcaagctccaggtttcatcaaccagttttacgaagtataagacttaccttttctcgtgcatgaagaatgaattatctcttctctcttctgatataatagagcatgaaaaataatgtatatatgatgcaggttcctgaatactggaaaacatatgtggatgaagtggatcaagaaagggaaatgtggttaaattcattttacaaagcaccattaagactcccaatgcctgcagagcttgaatactggtgggaaaagggtatgtgtttgtcactttgtcctacatattttctatatataatcattgttctcaaggaagttacaattagtattatacacccggggccgggtgcatgtaaaactagagagcttcttgatgtttaaaattggtgccttccctagttcacatttctgtagtgcttctattatttctatgtctggactctggagtaaaggtgttatttttagaggttatatttgttttggagtatttccaagcaatggtggatttaggaaatttgtagggatgggaaaaggggggtcccacggtgtgtggcgtgtgttggggggggggggggg

SEQ ID NO: 1145 - DNA, 1720 bp, Amaranthus rudis
ccatttctcattcttcttcaacaatgtcaaaccaacaacaagaagaccagccattacccagaaagaaaatagcttatctcgattccgaatccgacactgactccgactctgactccgaatccgaatccggaccctccaaatccaccagcaatgaattcagctacaaacgacccagtgactacctcgccccaaaacccgacttggaagaatcacccgaacaaagaaatatccggctatttcaagaagcattgaagtcccgtagatacactcgacttacagaagaagatgagattctggctcggactactgaattggaaagattgtataattttccgaaagataatgagaattggagggaagaagaccttaaagagttatgggcggatgctccgacccgtatgcttaaacctgggtgggacccagcattggttgatgaagaagattggaagattgttagagatgaagttaaagctggtcgtgaccctccaattgcaccattttatttgccttataggaaaccttatccggctattcctagtaatcattacgatattagtaatcctcgggacgttattgaggaattggatcgtactgaggagtttatgcaatgggttagctatgtttttcctgatggcggctcgtatgaaggcactgtatgggatgacatggctcatggaaaaggtgtttatgttgcgcaacaaggtttagtcaggtatgagggagaatggcttcagaacaatcaggaggggcatggagttgttgaagttgaaatacctgatattgaacctgttccgggatccaaacttgaagctcaaatgcgtgctgaagggaaaatttttaggagagatttcatgacccctgaagatagggaatggctggaaatggatattgaagatagtgtgcggctggcgaatgggaattatgaaatccctttctatgaacaagaggagtggataagacagtatggaaagaagcctgaaaaaggccggtaccgttatgctggtcagtggaagcatggcagaatgcatggttgtggtgtgtacgaagtgaatgaaaggcctatttttggtcgattctactttggtgagcacgtggaagattctgcaggttgtgatgaagaaattgctgcgatgcatgcaggtatagctgaagttgcagcagccaaagctcgaatgtttgtcaataagccagatggaatggttagagaggagaggggtccatatggtgatcctcagcatccctatttttatgaggcaaatgaagtgtggcaagctccaggtttcatcaaccagttttacgaagttcctgaatactggaaaacatatgtggatgaagtggatcaagaaagggaaatgtggttaaattcattttacaaagcaccattaagactcccaatgcccgcagagcttgaatactggtgggaaaaggatgcacctccggaatttattcttctgaacaaggagccagaacctgaccctaatgatcccactaagctcatttataccgaggatcctctcatactgcacactccaagtgggcgaataatcgattatgttgaggatgaagaacatggtgtccgcttgttttggcggtccaagggtgataccgacccgtcaaaggtcgagtttttaccgcttgggtttgacgaattctttggacggaaaaaagcagatgagcagcaagaaggcttttgaagcgtttggtatgttcaatagagaat

SEQ ID NO: 1146 - DNA, 455 bp, Amaranthus rudis
atcacccgagcagatcaaagatgagggtggaaaggctgaggagatcaaagatgagggtggaaaggccgaggaagaggatgatgatgacgacgatgatgatgatgatgatttagcttcatcgagtttcgggtctgtttcagattcaaaggacaagaaaaatgaacctgggagatccgcgttttcaacactctcatttgcttctcctggtttgctttcagcggttccatcaatcctcgagaaatctttttcggcctggaagaaggaaagatctccaccgagagttccacatgaatcatgtagccgtaccagaagtaatgcaaaacgtacttatttgattacttttcaccagtcattccccgaaaaggcgagcttaagagtgaaagctgagtgcgatatgaagattcgggtgaaacaagatagaaaatcttttgtcgcttcccaaacactcccttctc

SEQ ID NO: 1147 - DNA, 680 bp, Amaranthus rudis
ttggttttggtttatgtaaactgtgcataagggtttgtgaagcataaaaaattagtgtttgcttgtgtttcgtgtggttgttgaatagtttatgcaatgcttgatatcatcttgtaggagttctttgtattgtttgattgatttagcatatgaaaggtataacacataaaatcatgaagtttagagcttggttaggattaacatgtacaagccgtcccttttgacggggttagcacttagcagcacaaattgtttactcgcttggaacgatttagatattatcttattgggttgtcattttctttgctaagcccattgctcaacatcgatttcttcgttgtagtcagagtgtggtcgtggctattcgactgaaagaaaatctgttatttgctatttttgggtggcttagccattaacttcttctgttcttgatatccatgataattttaatgcacatgacttcaaggttgaactactttctgtggaaggttccctttttttcccagtttgtttcatattagagcttgtttcgtacttgctaatggattcatgtattcttcaatttataaaggtatgaaggcactgtatgggatgacatggctcatggaaaaggtgtttatgttgcgcaacaaggtttagtcaggtctgataatattgctttttttttttttgttatgaag

SEQ ID NO: 1148 - DNA, 677 bp, Amaranthus rudis
attaacttcttctgttcttgatatctatgataattttaatgcacatgacttcaaggttgaactattttctgtggaaggttcccttttacccagttttgtttcaaattagagcttgtatcgtacttgctaatggattcatgtattcttcaatttgtaaaggtatgaaggcactgtatgggatgacatggctcatggaaaaggtgtttatgttgcgcaacaaggtttagtcaggtctgcaatattgcattttttttgctatcatgggtcaatagggtttggaagcaatctatttgctataaagttaaggttgcatagatccgatccttctgattcccatccaagtgggagatgcgttatggtattggggaaatggattgttggttttgtgattttgttaacttttgggtccacattgatgttgattttagctaagtttagtaaatactgagttgaaatgaaattcatactgtaggtatgagggagaatggcttcagaacaatcaggaggggcatggagttgttgaagttgaaatacctgatattgaacctgttccgggatccaagtatgtctattgacaagaaagtacatttgaatgattagttgtcataggaacacttttgaatcttccatactgaattactggatgcttttgtcagacttgaagctcaaatgcgtgc

SEQ ID NO: 1149 - DNA, 673 bp, Amaranthus rudis
  unsure (1)..(673): unsure at all n locations
ggtgtctgtttctccgtcattacctcttgaacaggtggaagaaatatcacccgaggagatcaaagatgagggtgaaaaggccgaggagatcaaagatgagagtggaaaggccgaggaagaggatgatgatgacgatgatgatgatgatgatgatttagcttcatcgagtttcgggtctgtttcagattcaaaggacaagaaaaatgaacctgggagatctgcattttcaacactctcatttgcttcgtctggtttgctttcagcggtgagttaatgtttaaatttttttaatcttcattgttggaattttctcngataaaggttggtgaggcggtgagcagttggtttggaattttttaatgtttccgatccttattgagccttttatagcccgtttcattttaattatagtagaggccgttttaggcccgacccttacaaagcccttttaaagacgggccggataagggcccaaaatgagtgcccggtcattaaatacccctagtgacaactagcttagttaattctaatcacatcccacgataatgaaccaaaaatcaattatcgaaaaggaagaatatggacaacattggaactgatgtattggttcaggtagccgatctctatcgtttgggttactttggcatagttggaaattttcagtaacgctatt

SEQ ID NO: 1150 - DNA, 240 bp, Amaranthus rudis
tgatacgaggaaatatttttcctgaatcctgagtgatatatagcttgttgcttttttttcaattttctggtcaaactgtgcttacagtcatatgtacctggtgtttgttatttttgggttgaagggtcgattctactttggtgagcacgtggaagattctgcaggttgtgatgaagaaattgctgcggtatggctcacttttttcaactgttaggcgtccggttggaagctctttgatag

SEQ ID NO: 1151 - DNA, 770 bp, Amaranthus rudis
cttgaaaatactttcatgtctctttgttttgtttgtacatgtttattttccgatttgcttgattcttccacggaagtttcttctccaaatcatccaaaagatggggttggctattgctcctaatgtttggggcacctttgtatacggtctacctaacacaaccctcatccatctaagactgggaacaatgatgaatgaaaaaagaacactgaacggctcttttatatgtattatcatgtacattatgtcaatgtgcagcattggtaacgttaataattacatgagaattgatacgaggaaatatttttcctgagtgatatatagcttgttgctttttttcaattttctggtcaaactgtgcttacagtcatatgtacctggtgtttgttatttttggattgaagggtcgattctactttggtgagcacgtggaagattctgcaggttgtgatgaagaaatttctgcggtatggctcacttttttcaactgttagacgtccggttggaagctctttgaaagaaaaatattgtacatttgtacccttacctgaggactattcagatgcatgcaggtatagctgaagttgcagcagccaaagctcgaatgtttgtcaataagccagatggaagtacgtcctctttacttttctcaggagacagtactaataaacacaagcatgagaaaaatatagatccgagggggggagggagaggagtttgttttctgtcatcaccttttatgtttattattgaatgtgttcatgttcgct

SEQ ID NO: 1152 - DNA, 1038 bp, Amaranthus rudis
  unsure (1)..(1038): unsure at all n locations
ctacgtaatttaaaattgaggctccaaatcttttggggcccttgcggtcgaacatgttcaacatgcttagaacctcccctggatgcactaagattcagctagtaaagatgagaagttaatggcaaagattgtaaattactcaagctattaattttatctacaatgcaaactttattgtggcattgatgatttaagtggtaatggtcggtcttgaaatttggctgcagtggttagagaggagaggggtccatatggtgatcctcagcatccctatttttatgaggcaaatgaagtgtggcaagctccaggtttcatcaaccagttttacgaagtataagacttacctttgctcgtgcatgaacaatgaattatctcttctcttttctgatataataaagcatgaaaagtaacatatatatgatgcaggttcctgaatactggaaaacatatgtggatgaagtggatcaagaaagggaaatgtggttaaattcgttttacaaagcaccattaagactcccaatgcccgcagagcttgaatactggtgggaaaagggtatgtgtttgtcactttgtcctacgtatttcccatatataatcattgttctcaaggaaattacaattagtactatacacccgggtgcatgtaaaactagagagcttcttgatttgtttgaaattgattgccttccctagttcacttttctgcagtgcttctattatttctatgtctggagtaaaggtgttgttttcagagttaaatttgttttggagtatttccaagcaatggtgggtttaggaaattggtagggatggggaaaggggggtcccacggtgtggggggaggggttgcgggaggtcgtcagtgctaggggaggataagggggtggccagtggtagtggaggtggctgggtggctaggttgaggtgttggtaaagaagggggttgggaaattaggttttccttttttttttttttttnnnnnnnnnnnnnnnnnnncccgttataataggtttatagttaaaagggtatgttgggag

SEQ ID NO: 1153 - DNA, 2372 bp, Amaranthus rudis
  unsure (1)..(2372): unsure at all n locations
gcctggaagaaggaaagttctccactgagagttccacatgaatcatgtagccgtaccagaagtaatgcaaaatcttatttgattacttttcaccattcattccccgaaaatgcgagcttgagagtgaaatctgagtgcggtatgaagattcgggtgaaacaaggtagaaattcttttgtcgcttcccaaacaccctcttctcagttaaaatactctaaaaacgatcaccaaggacgaagatcatggattaagtggtcgtgcacaccgccagaaagaatctcagacaagatattatcgttgcacataccactcgaatccctggattcgtgcataagatcgtgcaacatagatcaaagcattgcaaccattttgtagtaaatttgaaggtaaacgtttgtcatctgtaatgagttgaattaccgaatatttttggctttggcctcggaaaaaattgcagactcgagaatttacgcatttttgtttattgtagcgcatttcgtgtatcaaaaaggaaagatgtaagatttgttagatgagtgcaatttaaagtcttagttttacaggcaaagttttggaacattgtttatgctattgtatctccctgatgtttcattcaaaatgtttgtgctgtttttggttgtttcagtgggagtgtctgcctatagtcgcactgaaatatatatgcacattgttcatggagagttttcaaaccaaacttccataagtttttttttttttttttnnnnnnnnnntttttttttttctttttttgggcaatgccttactccgttgtcttcctgagtttgctacgtagagggtttgcacacaaccccaacgacaacaaagaaagtgagtattatagtaggatgagctcatgttagaatcttgatcccgaaagattgagatcggttaaacagcatcatacccagtgtattccggtcataggatcaactatgatcagggtctgagaagggaaggacggcggcgatttatacccataaagaagagtacgactaatgagttcctcggctcgagaaaagatccatatatgaatccacagaaaaaagaaaaaaaagtctcaacagacaaaaacacccctataaatatacaaaaacatacaaataaattgaaagattggagtcggttacatgaacgatgaaccaaataaattttaatctagataaaagaaataaattgtatgtttttagtgaagcattatagatagggtcatgtataaaaatggtaatatagttaaacaatgcaaaattggggatatataaaatatttatttatctatataattagcacaaatttgtttgacattatatataagcctcctattaatctctacacatgcaatgtgataaatatttatccatataagtaattatttatctacataaatcatcatgacattatcattatattcagtgaattccgctcataaaaattatgatgagggaattttatgattaggatttggggagggataaaaaatggtaagaccatacctcgaaagaaggttgcgggcttacgaccaatgagaactttggctaagtacaatctataattctatttcagtagaacatgttatttttttttttccgggaaaaactgatattaataatccaacctttgatattaataatccaacctttcactccgctatgaataattccatctttgaattattttctaataannnnnnnnnnnnnnnnnnnnnnnnnnnnnnnnnnnntattactaataatagataataataaggtatactactagtaaacaaaaataaaaattgaattattcacaacgaactaaaagcagattctaacaacaatatccattaacatgaaatcaaataatttatttctataaaaagtaatcatgtaacagtttcattattttagaaatggtaccatcaaatgaatcgcttataaaaatataatttccatttgtaaaaaatagatttatcgtttttatacaaaaatttaagttttgtgaaaaaaaaaatatcgccgttgccggggatcgaacccgggtcacccgcgtgacaggcgggaatacttaccactatactacaacgacttattgattaatattttattagctattaatcatttccaaatttcacttacctttgaatgacgaaagaacaatccatcaaaaatagaatgaaagaaaatcgaaacaaaattagttgtgtcaatgtcattgcttaaatccttccattttaatggaaaatctactctttatactctccaggtaaaactatttgtcaatatgcaatctaaactttcttaattcaacatttttctatgttatttgtttgaatttcaggtgtttacaattgtgtatttttgaatgtagaatctagg

SEQ ID NO: 1154 - DNA, 626 bp, Amaranthus rudis
aggagtggataagacagtatggaaagaagccgtaagttattgctgttaactttcactttgttgcttttcaccagttaatatttacttttttctgtaagattattccatgctatagttggccatacactatttgtgtgcattttgtatagcttttttgaacatattatatgagtacgtgataaatgcttgatccccttaccagcaatgagcgtttgcaccaatgcatatgtttctatcaagtatcaacatcatgtgctggagagtttctttgaagaaatttaatagattctcatatgttgttgggattgataatagagcttaaggcaagcttgaccgaattaaaatgtagtcttacatcctgttttcattttatatatttattcctttaaaagtgaaatcttgaatctgtcttacttctttgctgatgctatatctcttcaaagttcttttctctaatgctagtgccatttttgtcttgtattcattttatgtttactgtacagtgaaaaaggccggtaccgttatgctggtcagtggaagcatggcagaatgcatggttgtggtgtgtacgaagtgaatgaaaggcctatttttgtaagtacttgaaaatactttcatgtctcttt

SEQ ID NO: 1155 - DNA, 200 bp, Amaranthus rudis
tttattgctgctatttgaattgctacttgaatagatgcacctccggaatttattcttctgaacaaggagccagaacctgaccctaatgatcccactaagctcatttataacgaggatcctctcatactgcacactccaagtgggcgaataatcgattatgttgaggatgaagaacatggtgtccgcttgttttggcggtc

SEQ ID NO: 1156 - DNA, 1357 bp, Amaranthus rudis
taaatgtctacttgacataatgttaacccttacttgagttatcgcaaatgcatacttgagatatcctaaaaccctatcgaataattgtacagttacacattagttattagtttgtgaactttaaacttgggcaacgaagttaaagtttgaataaataaatcaagatctatttatgacccgtgacccgactaatccaataattttgcgtccaaatccaaaatttcaaccctaaggatatgagtccaagtattagtccactaaaaaaataatgagtctggatctaaatctaattggacatgattcagacccgatctatgagtccataaccatccctaaacctttgaactcttttttacccttaaaactattcataatcgtcttaacaaaatctaaaatttaggtctagctaattttttggtgaatctaagtttaactatggataatcaatcctaaataaacaattacttatgatttaatttttttatattgagtttattataggagtacaattttttgaaatcaaaagaattatagattttaatttcaataaaacaaaattatacacaaatatttaaaaacaccatatctaattattatcttcttcctactatcactttttccctcttctctaccttatcactattatccccttctccctttctctctattcactccccatttctccatttttcattcttcttcaacaatgtcaaaccaacaacaagaagatcagccattacccagaaagaaaatagcttatctggattccgattccgactcggactcagactcagactccgaatacgaatccgaatccggaccctccaaacccacaagcaatgaattcaactacaaacgacccagtgactacctcgccccaaaacccgacttggaagaatcacccgaacaaagaaacattcggctatttcaagaagcattgaagtcccgtagatacactcgacttacagaagaagatgagattctggctcggactactgaactggaaagattgtataattttccgaaagataatgagaattggagggaagaagaccttaaagagttatgggcggatgctccgacccgtatgcttaaacctgggtgggacccagcattggttgatgaagaagattggaagattgttagagatgaagttaaagctggtcgtgaccctccaattgcaccattttatttgccttataggaaaccttatccggctattcctagtaatcattacgatattagtaatcctcgggacgttattgaggaattggatcgtactgaggagtttatgcaatgggttagctatgtttttcctgatggcggctcgtaagtttcattgcttatttggattgtt

SEQ ID NO: 1157 - DNA, 2681 bp, Amaranthus spinosus
caacaatgtcggaccaacaacaagaagaccagccattacccaggaagaagatagcttatctggattctgattccgactcagactcagactcagactcagaatccgaatccgaatccggaccctccaaacccacaagcaatgaattcaactacaaacgacccagtgactacctcgcctcaaatcccgacttggaagaatcacccgaacaaagaaacattcggctatttcaagaagcattgaagtcccgtagatacactcgacttactgaagaagatgagattctggctcggactactgaattggaaagattgtataatttcccgaaagataatgagaattggagggaggaagaccttaaagagttatgggcggatgctccgacccgtatgcttaaacctgggtgggacccagcattggttgatgaagaagattggaagattgttagagatgaagttaaagctggtcgtgaccctccaattgcaccattttatttgccgtataggaaaccttatccggctattcctagtaatcattacgatattagtaatcctcgggatgttattgaggaattggatcgtactgaggagtttttgcaatgggttagctatgttttccctgatggcggctcgtatgaaggcactgtatgggacgacatggctcatggaaaaggtgtttatgttgcgcaacaaggtttagtcaggtatgagggagaatggcttcagaacaatcaggaggggcatggagttgttgaagttgagatacctgatattgaacctgttccgggatccaaacttgaagctcaaatgcgtgctgaagggaaaattttaggagagatttcatgacccctgaagatagggaatggctagaaatggatattgaagatagtgtgcggctggcgaatgggaattatgaaatccctttctatgaacaagaggagtggataagacagtatggaaaaaagcctgaaaaaggccggtaccgttatgctggtcagtggaagcatggcagaatgcatggttgtggtgtgtacgaagtgaatgaaaggcctatttttggtcgattctactttggtgagcacgtggaagattctgctggttgtgatgaagaaattgctgcgatgcatgcaggtatagctgaagttgctgcagccaaagctcgaatgtttgtcaataagccagatggaatggttagggaggagaggggtccatatggtgatcctcagcatccctatttttatgaggcagatgaagtgtggcaagctccaggtttcatcaaccagttttacgaagttcctgaatactggaaaacatatgtggatgaagtggatcaagaaagggaaatgtggttaaattcattttacaaagcaccattaagactcccaatgcctgcagagcttgaatactggtgggaaaggatgcacctccggaatttattcttctgaacaaggagccagaacctgaccctaatgatcccactaagctcatttataccgaggatcctctcatactccatactccaagtgggcgaataatcgattatgttgaggatgaagaacatggtgtccgcttgttttggcggtccaagggtgataccgactcgtcaaaggtcgagtttttgccgcttgggtttgacgaattctatggacggaaaaaaagcggatgagcagcaagaaggctttttgaagcgtttagtatgttcaatcgagaattcctgtaaaccctggtttgagaaactagaaaagtggactgaagaacagaagacagccagtgaaatacgaaagaagctcttagaacatgaacttgaattggtcgaggctgagctgagtttggaagaagcccttgaggacatggaagaatcattgaaacaacaagaagaggccgcgaataatattgacatggatgttgaagatgaggcggtttctgtttctccgtcattacctgttgaacaggtggaagaagtatcactcgaggagatcaaagatgagggtggaaaggtggaggagatcaaagatgagggtggaaaggcggaggagatcaaagatgagggtggaaaggttgaggacgaggatgatgatgacgacgacgatgatgatgatgatgatttagcttcatcgagtttcgggtctgtttcagattcaaaggacaagaaaaatgaacctgggagatctgcgttttcgacactctcatttgcttcttctggtttgctttcagcggttccatcaatcctcgagaaatctttttcggcttggaagaaggaaagatctccaccgagagttccacatgaatcatgtagccgtaccagaagtaatgaaaaatcttcttatttgattacttttcaccagtcattccctgaaaaggcgagcttgagagtgaaagctgagtacgttaagaagattcgagtgaaacaaggtagaaaatcttttattgcttcccaaacacccttttcccagttaaagtactctaaaaacgatcatcaaggacgtagatcatggattaagtggtcgtgcgcaccgccagaaagaatctcagactcgatattatcgttgcaaataccactcgaatccttggaatcgcgcatagatcaaagcattgccaccattttgtagtaaatttgaattgaactttagtcatctgtaatgagttgaatcaccgattatttttagctccggcctcagaaaaaat

SEQ ID NO: 1158 - DNA, 1598 bp, Amaranthus thunbergii
tgctggtcagtggaagcatggcagaatgcatggttgtggtgtgtacgaagtgaatgaaaggcctatttttggtcgattctactttggtgagcacgtggaagattctgctggttgcgaagaagaaattgctgcgatgcatgcaggtatagctgaagttgcagcagccaaagctcgaatgtttgtcaataagccagatggaatggttagggaggagagggggtccatatggtgatcctcagcatccctatttttatgaggcagatgaagtgtggcaagctccaggtttcattaaccagttttacgatgttcctgaatactggaaaacatatgtggatgaagtggatcaagaaagggaaatgtggttaaattcattttacaaagcaccattaagactcccaatgcccgcagagcttgaatactggtgggaaaaggatgcacctccggaatttgttcttctgaacaaggagccagaacctgaccctaatgatcccactaagctcatttatactgaggatcctctcatactccatactccaagtgggcgaataatcgattatgttgaggatgaagaacatggtgtccgcttgttttggcggtccaagggtgataccgatccgtcaaaggtcgagtttttgccgcttgggtttgacgaattctatggacggaaaaaagcggatgagcagcaagaaggctttttgaagcgtttagtatgttcaatcgagaattcctgtaaaccttggtttgaaaaactagaaaagtggactgaagaacagaagacagccagtgacatacgaaagaagctcttagaacatgaacttgaattggtcgaggctgagctgagtttggaagaagcccttgaggacatggaggaatcattgaaacaacaagaagaggccgcgaataatattgacatggatgttgatgatgaggcggtgtctgtttctccgtcattacctgttgaacaggtggaagaagtatcacccgaggagatcaaagatgagggtagaaaggccgaggagatcaaagatgagggtggaaaggccgaggaagaggatgatgatgacgatgatgatgatgatgatgatgatgatttagcttcatcgagtttcgggtctgtttcagatccaaaggacaagaaaaatgaacctgggagatctgcgttttcaacactctcatttgcttcgtctggtttgctttcagcggttccatcaatccttgagaaatctttttcggcttggaagaaggaaagatctccaccgagagttccacatgaatcatgtagccgtaccagaagtaatgcaaaatcttcttatatgattacttttcaccagtcattccccgaaaaggcgagcttgagagtgaaagctgagtacgttaagaagattcgagtgaaacaaggtagaaaatcttttgtcgcttcccaaacactcccttctcagttaaaatactctaaaaacaatcaccaaggacgaagatcatggatcaagtggtcgtgtgcaccgccagaaagaatctcagattcgatattatcgttgcacataccactcgaatccttggactcgcgcataagatcgtgcaacatagatcaaagcatcgcc

SEQ ID NO: 1159 - DNA, 890 bp, Amaranthus thunbergii
atagcttatctggattctgattccgactcggactcagactcggactccgaatccgaatccgaatccggaccctccaaacccacaagtaatgaattcaactacaaacgacccagcgactacctcgccccaaaacccgacttggaagaatcacccgaacaaagaaacattcggctatttcaagaagcattgaagtcccgtagatacactcgacttactgaagaagatgagattctggctcggactactgaattggaaagattgtataatttcccgaaagataatgagaattggagggaagaagaccttaaagagttatgggcggatgctccgacccgtatgcttaaacctgggtgggacccagcattggttgatgaagaagattggaagattgttagagatgaagttaaagctggtcgtgaccctccaattgcaccattttatttgccttacaggaaaccttatccggctattcctagtaatcattacgatattagtaatcctcgggatgttattgaggaattggatcgtactgaggagtttttgcaatgggttagctatgttttccctgatggcggctcgtatgaaggcactgtatgggatgacatggctcatggcaaaggtgtttatgttgcgcaacaaggtttagtcaggtatgagggagaatggcttcagaacaatcaggaggggcatggagttgttgaagttgagatacctgatattgaacctgttccgggatccaaacttgaagctcaaatgcgtgctgaagggaaaatttttaggagagatttcatgacccctgaagatagggaatggctggaaatggatattgaagatagtgtgcggctggcgaatgggaactatgaaatccctttctatgaacaagaggagtg

SEQ ID NO: 1160 - DNA, 1071 bp, Amaranthus viridis
ggtccaagggtgataccgatccgtcaaaggtcgagttttgccgcttgggtttgacgaattctatggacggaaaagcggatgagcagcaagaaggcttttgaagcgtttagtatgttcaatcgagaattcctgtaaaccttggtttgaaaactagaaaagtggactgaagaacagaagacagccagtgacatacgaaagaagctcttagaacatgaacttgaattggtcgaggctgagctgagtttggaagaagcccttgaggacatggaggaatcattgaaacaacaagaagaggccgcgaataatattgacatggatgttgatgatgaggcggtgtctgtttctccgtcattacctgttgaacaggtggaagaagtatcacccgaggagatcaaagatgagggtagaaaggccgaggagatcaaagatgagggtggaaaggccgaggaagaggatgatgatgacgatgatgatgatgatgatgatgatgatttagcttcatcgagtttcgggtctgtttcagatccaaaggacaagaaaaatgaacctgggagatctgcgttttcaacactctcatttgcttcgtctggtttgctttcagcggttccatcaatccttgagaaatctttttcggcttggaagaaggaaagatctccaccgagagttccacatgaatcatgtagccgtaccagaagtaatgcaaaatcttcttatatgattacttttcaccagtcattccccgaaaaggcgagcttgagagtgaaagctgagtacgttaagaagattcgagtgaaacaaggtagaaaatcttttgtcgcttcccaaacactcccttctcagttaaaatactctaaaaacaatcaccaaggacgaagatcatggatcaagtggtcgtgtgcaccgccagaaagaatctcagattcgatattatcgttgcacataccactcgaatccttggactcgcgcataagatcgtgcaacatagatcaaagcatcgccaccattttgtagtaaatttgacggcaaacttttgtcatctgtaatgagttgaattaccgattatttttggct

SEQ ID NO: 1161 - DNA, 1323 bp, Amaranthus viridis
cggactccgaatccgaatccgaatccggaccctccaaacccacaagtaatgaattcaactacaaacgacccagcgactacctcgccccaaaacccgacttggaagaatcacccgaacaaagaaacattcggctatttcaagaagcattgaagtcccgtagatacactcgacttactgaagaagatgagattctggctcggactactgaattggaaagattgtataatttcccgaaagataatgagaattggagggaagaagaccttaaagagttatgggcggatgctccgacccgtatgcttaaacctgggtgggacccagcattggttgatgaagaagattggaagattgttagagatgaagttaaagctggtcgtgaccctccaattgcaccattttatttgccttacaggaaaccttatccggctattcctagtaatcattacgatattagtaatcctcgggatgttattgaggaattggatcgtactgaggagtttttgcaatgggttagctatgttttccctgatggcggctcgtatgaaggcactgtatgggatgacatggctcatggcaaaggtgtttatgttgcgcaacaaggtttagtcaggtatgagggagaatggcttcagaacaatcaggaggggcatggagttgttgaagttgagatacctgatattgaacctgttccgggatccaaacttgaagctcaaatgcgtgctgaagggaaaatttttaggagagatttcatgacccctgaagatagggaatggctggaaatggatattgaagatagtgtgcggctggcgaatgggaactatgaaatccctttctatgaacaagaggagtggataagacagtatggaaaaagcctgaaaaaggccggtaccgttatgctggtcagtggaagcatggcagaatgcatggttgtggtgtgtacgaagtgaatgaaaggcctatttttggtcgattctactttggtgagcacgtggaagattctgctggttgcgaagaagaaattgctgcgatgcatgcaggtatagctgaagttgcagcagccaaagctcgaatgtttgtcaataagccagatggaatggttagggaggagaggggtccatatggtgatcctcagcatccctatttttatgaggcagatgaagtgtggcaagctccaggtttcattaaccagttttacgatgttcctgaatactggaaaacatatgtggatgaagtggatcaagaaagggaaatgtggttaaattcattttacaaagcaccattaagactcccaatgcccgcagagcttgaatactggtgggaaaa

SEQ ID NO: 1162 - DNA, 944 bp, Ambrosia artemisiifolia
tacactccacatcgttagtttttaacaaacgtacgctccacaataggctaaaataacttgttaacattaaaaattaaaaaaaattaataataataaagcttgtaatttcacatatttcagcttcatccaacaaattaaaccttttacacccccctcattttcatcacaattcacaacctagtccttccactttgtaaacttatcactccatctccccctatttaacaaaccaaaatccacactctccttgccgctcctctacagtctacacaccttatctatctcttcatcttcatcttctccaacactaccaacccagctaaccaaaacatgtccgacaacaaacccatttcatccgactcatccgactccgactccgactccgaattcgaagacccaacatccccagacaacaaacccacccaaccccaacccgaacccacacaacccaatcagctcaccaaccaacccaaccaactcaacccaaaccgactcgcaccatttgaccccaacgacgacgacggcacacccgaaggtttctacaacaaagtcactcaaatactagaatcagaacaattcaaaaagctagaagaatcccaggaacttaatgacctggataatatcgctgagctgtatgatttcccacccgacccggaagaatggaaagaggaggatttgaaagagctgtgggcggatggtccgcccttttcattcaaacccgggtgggacccgaattttgttgagaaggatgagcttgatattattaatgaggagattagagaggggagggatccgcctattgccccgttttatgttccgtataggaaatattacccggttattccgcataaccattttgatattcgtaatgctaagtctgttattgaagagcttgatcggattgaagagtttcttacgtggcatagctttgtttttgctgatgg

SEQ ID NO: 1163 - DNA, 2945 bp, Ambrosia artemisiifolia
atctacatcaggtaacgattcttaattatattgcgccgcatctatctctttctcattctcactcaaccctaaacttcaaacctaacatctataatcgacatcggttactttcttctctcttgcgccacatgtatatcaaaaccctaaatccgattttgtttcctgttttgcgatacgtcttcttcatttatttgatgaatataatattccatcattgcatccttcatcttcctttgacatcgcatccgctacgtaatctccgtctaaaaatcgtccgtctttatatccaaaggtataagtttctctcagtttgtgtgtttttgtttcctgtattgcaagtccatgttcttttttatttgaagttcaatacaaatcgtaatttgttttttcatgtatatttgtttatttccatgtaatttgttttctctagggctccaattttatggtatttttggctgtcaaggccaaaatcaagggagaaaaagacatttatgaggaaacatacacatttgaagtcattccatgtcagataggtaagaataaatgaacccaaaagcactttcaacacttgtaaaggttgaatcgtagtataagtaagtgaatatctgatttatgatttgatcttattacatgtaaaagaaggtttagcgtcatcttaaagccataaccagacgcaattcgccaaagcatcattcaccggtaagagaatttaatttgaaggtatcaatgcttatctaaagaaatttttttaataatgttttatagattcaagccaagtttggttgttattgttggttgcatgacaccaatcatgcttggagtatgctttctttgtccttcaatgaattgcataaacagttcattttaatttgcatcttcacaattttcttgatgctacaaaagggatggtttcaatcactttgtttgatggtttctgggtgaagtggaaattctaggtaatattttagatgtaaagatattgatgcttccttgtggacaatttgcagacatagattgtaaagaaaagatctaagaatgtgtgctcaattttgccattagtcgagtcctaaacgacggtttctaagggttcaataggtttgcaattcattcgttagttcataatgtattttcgattttgtgattttgttcattattggctatgtctttgattgcaattgttaacgatttcgctagggtttttgtgattttgatttggatgtgttgtgccatttataaagtctagagaattgttgttgattatagtggttacgtgattaatttatgtggatatcttatgaattgggggtttcaacattatttgatttttggttgttaatgcttggttcttgtgtgctttgtgttttcttttggaacaatcgactaattgcatactgttggagattatgatctcaaataatatagcgcatatggtcaattttaggataagcaagttgattcttatcggtgaatctctatattacaaaaagaccgactgaattattttctaaagatgtagtgattgttttggcaattgagcaattataatgcgaaaccgaagtgcctgcaaataggatacttcaattcgcattcttcttttaacccgtttttacttaaactaaagtaaaattaccctgtcatgtacaattcaagaaatacattcttcaattatatgtccagtagcattagtctctgttgattttgtttgttttatgtctttcacccgagtatgttgtttctttatatgtttttgaatcggaacccttatttttgttttggctgatttgattaacttattttttcattttgcttgctttttggcatttttttgccctaagtctgttttatatgttatagccatggctggaagctgcaaacagttactaaagctgaattggatatgtctattaagttgatcctggctctttacattacatcacccttaattaagtttttatttgtttctttagcttttaacattatggtgaaattaatcgaagtttgatgatttattttgaggaaattttatttttttaatttgttttgccttgactgtagttttggattgtgttatttctgataaacacgatgatttgaggaattttttttacttctctccgtattcatatttattcatgtttttgtttgattaggattttgttatccccattttaatgttgtcgcaaataatatgcatatcaaccctttgatatttgtgtctgggataagaatagttggtttatcattcagatcgtatgatccgtatcaagagtgatttgttttcgattagtgtttatcttatattatgttaaaccatgtgcaatcaatagaggttcctttaggttctattgtgacaaagtctatctagaaaactagagtggtataaactgttcccgacacgaattcaagtatgatgtctaccttattgaatttgattgttcatctaattgttaataatgtttctacatattaaattgatcattatgttcaatattgtttcaggtcgaacatgtaatttatgaagataagatggtggctgcccatttaatgattaactggtatttcagttgcattcaggtatagcagaagtggctgcagcaaaggctcggatgtttgttaacaaacccgatggaagtatgcaatctatctcttattgtttaatgttaattttaactacattatatatgattctatgttgcacatacatcttaataaatgtggtcaaactttgcttttctgatacagtggttcgagaagagcggggtccatatagtgatccccagcatccttatttttatgaagaagaagatgtgtggatggcaccaggattcattaatcagtttttcgaagtaagtaccgcttgcgttgtttggttgttaacttattaatcaaatctgcattaaacttatagctcttgcaaaaagaagactgctttcgaaataagcaat

SEQ ID NO: 1164 - DNA, 1090 bp, Ambrosia artemisiifolia
gggtcaggtcaatctgacccgaattgtattgacccatactacactttaccagttctaactattaccaccgcttgacatgttgccgcctctacctacatccatgataaccgcctgggttcttagtttcttattatatagttaatttaaacagtctagtttaatttaataatggaatttctaaaattttgatttattatattttcatttttaacagagtcgtctcctgagtttattctccttaacaaagagcctgagcccgatcccgaagatccatcaaaactggtgtatactgaagatcccgttatcctacacacaccgacagggcgtataattaattatgtagatgatgaagaacacgggatccgtttgttttggcaaccgactttaaaggacggggaagaatttgacccgagccaggttgagtttttaccacttggagatgaagaactgtttgagcgtgatgaccgtaactttttagagcgtatgctggcatcaacgcaagagaaatgcaaactcatgcttgagaatttggagaaacggattgaagagaagaagaaagagagtgatgcgaagttgaaattaatagaaacagagattgaaatagtggaagctgaatctgaactaaaggaaataattaaagaaatggatgatgagttaaagagattggaaaaagaagaggaaaagaagatggagatggaactggaagctgaagatgcagatgcagatgaggatgaaccagtcgacaaaccagcagaagtttcgcgtgttgaggttaaagttgatgaggttaaagaagatgatgttaatgcagttgatgtaaaagaagatgatgttgacgatgacgatgatggtgaagatgatgatgatgatgatgaagatgcaccacctagttttggatctgctattaaagttcaggatggcaaaaatgatggaagatcttcaccgtttgctgcatcttctatgcagtttggttcgttgggccttgcatctatggttagtttctagcatccatggtattatttaaacggggtggcaaattggcgggtaacgggccaaaagacgtttttagaactgttttacaattaggatc

SEQ ID NO: 1165 - DNA, 1892 bp, Ambrosia artemisiifolia
ggtcagactaaccaaaatttacagattttggccggaatttggctagaatcgctagacagacaccgagtggtgattaatcggtgaacctttggctagctattaatcgaaggctaggcgcgatttttacaaccatcaatttatttatgttaatttttgaaagtaatgaaatttggggaagttaattttgggagttttatttggattgtgtttaggtatgaaggtacagtgtgggatgatttggctcatggaaaaggtgtttatgaagctgagcaagggctggtcaggttcggttcggttatgttgcggatgttattggaagttatgttaatagttaatagaatgtgttttgattgatgtttgaggttaatgtgaatgttatggtatggttgtagatatgaaggtgaatggttgcagaataatccggaggggcatggggtgctcgaagttgatataccgacttatgaacctgttcccggttcaaagtatgtttgtaatccagactgtgttattaattcttatatcaatttggtaatgcaaatgtaagaaatgaatgtgagcggttggttttgttttaaggcttgaagctgaaatgcgggcgcaaggtcatatatttaagagagattttatgtcaccggaagataaagaatggctcgagatggatattgaagattgtgtccatttctctcagggtagacgtgaaattccgttttatgaaaatgaagaatgggtcagacaatttggggagaaaccgtaagttaaaatataagtcatattgtatcaacgacgttttttgtagagttttttaacttagttctaatgttgggttttttgatgatagggagaaaggtcgataccgttatgcgggtcagtggaaacatggcagaatgcatggttgtggtgtttttgaactcaatgaacgtaccacttatgtaagtccaatgggccgtaaatatctgtaatttgaatgaatggtaattttttgctgcttgtcatgcagggacggttttactttggagagtttatgcaggaagatcatggttgtgatgttgatgcttcagcggtagtgttgaaaatctttaatttttaaattggatattaggttaatatattctgacgtccgttatgacaaatttaaatctactgattaaactggtatttcagttgcattcaggtatagcagaagtggctgcagcaaaggctcggatgtttgttaacaaacccgatggaagtatgcaatccatctcttattgtctaagctaattttaactatatatgtattatttgtgaattctatgttgcacatacatgtatacttactttacttttcttttcttttcttttctgttacagtggttcgagaagagcggggtccatatagtgatccccaacatcctatttttatgaagaagaagatacgtggatggcaccaggattcattaatcagtttttgaagtaagttccgcttgcattgtttagttgttaactcattaatcacatctgtaataaacttatagttctttgatagttgccttaatgtaatgcagaagggaaacaaaggaaactaatcttcatgggcctttatctttttatatggggtgagtgcacactattatgttttgagatggctttcaatcattacacatatcttatgtgtttagcatttgctattaagtattaatgaaatcaaaaggcctatagccgtaatgagttgcataaaaacaattttggttcgcctttgtcattcaaaaagtataaaaagtgtaaatttgtttactaacttttagatggacttttatttcactttgttaagattgaaaggacatacttgtcatattgaaaatatcagccaacaatgtatttgacaaggtggcatccaccgatcattattgggg

SEQ ID NO: 1166 - DNA, 292 bp, Ambrosia artemisiifolia
gacgaagaacgacaaatgtggataaactcgttttataaggccccactaaggttacccatgccagctgagctcgagtattggtgggaaaatggtactacatttgaaaattttgtgaatggaaatttttatctgatgctaactttagtctgctgatttaaactatttgtttctttaaaaaatttatgccgtttattacaataatgtgagatcttatatgaaagctgttataagttcagataacggatggataaataattgcaggaaatgagagaaatagggtttatatagttca

SEQ ID NO: 1167 - DNA, 2627 bp, Ambrosia trifida
cttatctatctcttcatcttcatatccatcttctcccacactacccacccagctaaccaaaatatgtccgacaacaaacccatttcatccgactccgactccgactccgaattcgaagaaccaacttacccagataacaacaaacccacccaacccgaacccacccaacccaatcagctcaccaaccaactcaacccgaaccgactcgcacaatttgaccccaacgacgtcgacgacacacccgaaggtttctacaacaaagtcactcaaattctcgaatcagaacaattcaaaaagctagaagaatcccaggaacttaatgacctggataatatcgctgaactgtatgatttcccacccgacccggaagaatggaaagaggaggatttgaaagagctgtgggcggatggtccgccctttttattcaaacccgggtgggacccgaactttgtagagaaggatgaggttgatattattaatgaggagattagggaggggagggatccgcctattgccccgttttatgttccgtataggaaaccttacccggttattccgcataaccattttgatattcgtaatgctaagtctgttattgaagagcttgatcggattgaggagtttcttacgtggcatagctttgtttttgctgatggtagcacgtatgaaggtacagtgtgggatgatttggctcatggaaaaggtgtttatgaagctgagcaagggctggtcagatatgaaggtgaatggttgcagaataatccggaggggcatggggtgctcgaagttgatataccgacttatgaacctgttcccggttcaaagcttgaagctgaaatgcgggctgaaggtcatatatttaagagagattttatgtcaccggaggataaagaatggctcgagatggatattgaagattgtgtccatttctctcagggtagacgtgaaattccgttttatgaaaatgaagaatgggtcagacaatttggggagaaaccggagaaaggtcgataccgttatgcgggtcaatggaaacatggcagaatgcacggttgtggcgtttttgaactcaatgaacgtaccacttatggacggttttactttggagagtttatgcaggaagatcatggctgtgatgttgatgcttcagcgttgcattcaggtatagcagaagtggctgcagcaaaggctcggatgtttgttaacaaacccgatggaatggttcgagaagagcggggtccatatagtgatccccagcatccttatttttatgaagaagaagatatgtggatggcaccaggattcatgaatcagttttttgaagtcccagattattggaaagcttatatagaagacgtggacgaagaacgacaaatgtggataaactcattttataaggccccactaaggttacccatgccagctgagctcgaatattggtgggaaaatgaatcgtctcctgagtttgttctccttaacaaagagcctgagcctgatcccgaagatccatcaaaactggtgtatactgaagatcccattatcctacacacaccaacagggcgtctaattaattatgtagatgatgaagaacacgggatccgtttgtattggcaaccgcctttaaaggaaggggaagaatttgacccgagccaggttgagtttttaccacttggagatgaagaattgtttgaacgtgatgaccgtaacttttttgagcgtatgctgacatcaacccaagagaaatgcaaactcatgcttgagaatttggagaaacggattgaagagaagaagaaagagagtgatgcaaagttgaaattaatagaaacagagatagaaatagtggaagctgaatctgaactaaaggaaataattaaagaaatggatgatgagttaaagagattggaaaaagaagaggaaaagaagatggagatggaatcggaagctgaagatgcagatgcagatgcagatgaagatgaaccagttgaaaaaccagaagaagtttcgcgtgttgaggttaaagttgatgaggttaaagaagatgatgttaatgaagttgatgtaaaagaagatgacgctgatgatgacgatgatgatgatggtgaagatgatgatgaagatgaagatgaagatgaaccacctagttttggatctgctgttaaagatcaggatagcaaaaatggcggaaggtcttcaccgtttgctgcatcttctatgcagtttggttcgttgggccttgcatctatggttccatcacagttacagcggttatttgtggcttggaaggagtcaaaattgcataaaaagacttccctcccttctcgggttaagccaaatcaatgcacccaaaatagttcgatcaaattcgaacgaacttttgaccaaggcttggctttgagagcacatcaccaggtcaacaagtatatcacacggtcaactaccggtacctgttttaagcagaaagcttctgcacatcttcaaagaaacatgagtgagcataaaacacaaagctttacttggccatgcatacatcctagtgaagagttgagtattttatctttgcatattcctatttagattgttattttacaaaattacccctggtgcctgatttgacactggttttttag

SEQ ID NO: 1168 - DNA, 295 bp, Ambrosia trifida
tggctcatggaaaaggtgtttatgaagctgagcaagggctggtcaggttcggttcggttatgttgcggatgttattggaagttatgttaatagttaatacaatgtgttttgattgatgtttgaggttgatgtttatgttatgggatggttgtagatatgaaggtgaatggttgcagaataatccggaggggcatggggtgcttgaagttgatataccgacttatgaacctgttcccggttcaaagtatgtttgtaaaccagactgtgttattaaattcttatatcaatttggtaa

SEQ ID NO: 1169 - DNA, 360 bp, Ambrosia trifida
tagaagttattacaggttttggtcagactgaccgaaatttacatattttggctgcaatcgctagacagctactaactagcgattaatcagtgattactcggttcagaggctagacatgatttttacaaccatgcaatttatgttaatttttgaaagttatgacatttggggaagttaatttcgggagttttatttggattgtgtttaggtatgaaggtacagtgtgggatgatttggctcatggaaaaggtgtttatgaagctgagcaagggctggtcaggttcggttcggttatgttgcagatgttatgttaatagttaatacaatgagttttgattgatgtttgaggttaatgtggat

SEQ ID NO: 1170 - DNA, 314 bp, Ambrosia trifida
ctttttattcaaacccgggtgggacccgaactttgtagagaaggatgaggttgatattattaatgaggagattagggaggggagggatccgcctattgccccgttttatgttccgtataggaaaccttacccggttattccgcataaccattttgatattcgtaatgctaagtctgttattgaagagcttgatcggattgaggagtttcttacgtggcatagctttgtttttgctgatggtagcacgtaagttgcttggtttttattattcattgttgtaggaatcgctaggcgctagctggctggtgaggtac

SEQ ID NO: 1171 - DNA, 291 bp, Ambrosia trifida
gtgttgtactttgacacatctaaaaaaatcattgttattataagtcttgtaacaaataacaaatagttataaagaggtattaagtttttttatttttccatcaggtcccagattattggaaagcttatatagaagacgtggacgaagaacgacaaatgtggataaactcattttataaggccccactaaggttacctatgccagctgagctcgaatattggtgggaaaatggtactacatttgaaaattttgtgaatggaaatttttatctgataccaactttagtctgct

SEQ ID NO: 1172 - DNA, 679 bp, Ambrosia trifida
ttttgttttaaggcttgaagctgaaatgcgggctgaaggtcatatatttaagagagattttatgtcaccggaggataaagaatggctcgagatggatattgaagattgtgtccatttctctcagggtagacgtgaaattccgttttatgaaaatgaagaatgggtcagacaatttggggagaaaccgtaagttaaaatataggtcgtattgtatcaacaacgttttttgtagagtttttgaacttagttctaatgttgggtttttgatgatagggagaaaggtcgataccgttatgcgggtcaatggaaacatggcagaatgcacggttgtggcgtttttgaactcaatgaacgtaccacttatgtaagtccaatgggccgtaaatatctgtaatttgaatgactgataattttttgctgcttgtcatgcagggacggttttactttggagagtttatgcaggaagatcatggttgcgatgttgatgcttcagcggtattgttgaaaatctttaatttttaaatttgatattaggttaatatgttctgacgtcagttatgacaaatttaaacctactgattaaactggtatttcagttgcattcaggtatagcagaagtggctgcagcaaaggctcggatgtttgttaacaaacccgatggaagtatgcaatccatctc

SEQ ID NO: 1173 - DNA, 639 bp, Ambrosia trifida
taagattttgatttattatatttttattcttaacagaatcgtctcctgagtttgttctccttaacaaagagcctgagcctgatcccgaagatccatcaaaactggtgtatactgaagatcccgttatcctacacacaccaacagggcgtctaattaattatgtagatgatgaagaacacgggatccgtttgtattggcaaccgcctttaaaggaaggggaagaatttgacccgagccaggttgagtttttaccacttggagatgaagaattgtttgaacgtgatgaccgtaacttttttgagcgtatgctgacatcaacccaagagaaatgcaaactcatgcttgagaatttggagaaacggattgaagagaagaagaaagagagtgatgcaaagttgaaattaatagaaacagagatagaaatagtggaagccgaatctgaactaaaggaaataattaaagaaatggatgatgagttaaagagattggaaaaagaagaggaaaagaagatggagatggaatcggaagctgaagatgcagatgcagatgaagatgaaccagttgaaaaaccagaagaagtttcgcgtgttgaggttaaagttgatgaggttaaagaagatgatgttaatgaagttgatg

SEQ ID NO: 1174 - DNA, 369 bp, Ambrosia trifida
catgtatacttactttacctttctgttacagtggatcgagaagagcggggtccatatagtgatccccaacatcctatttttatgaagaagaagatatgtggatggcaccaggattcatgaatcagttttttgaagtaagttccgcttgcattgtttagttgttaacttattaatcacatctgcaataaacttatagtttttgcaaaaggaagactgctttcgaaatatgcaattttggtccttcgggcaaattatggaaatgtaattgcaaaagaagagtgttgtactttgacaacatctaaaaaaatcattgttattataagtcttgtaacaaataacaaatagttataaagaggtattaagtttttt

SEQ ID NO: 1175 - DNA, 583 bp, Chenopodium album
atggatgtggtgtgtatgaaatgaatgaacaacccatctatggacggttcactttggtgagaaattggaggatcctgctggttgtactgaagaaatttccacgatgcatgcaggcatagctgaagttgctgcagccaaggctcgaatgttcattaataagcctgatggaatggttagggaagaaaggggtccatatggtgatcctcaacatccctatttttatgaggaagaggatgtgtggcaggctccaggtttcatcaaccagttttacgaagttcctgattactggaaaacttacgtgcaagaagtggatcaagaaagagaaatgtggttaaactctttctataaggcaccattaagactcccaatgcctgcagaactagaatactggtgggaaaatgatcaacctccagaatttgttcttctaaacaaggaacctgagcctgaccctaatgatccatctaagcttgtttatactgaggaccccgtcataatgcacacacctactggacaaataatcaattacgttgaggatgaagaacatggtatccgcttgttttggcaaccacctctaggagagggt

SEQ ID NO: 1176 - DNA, 1115 bp, Chenopodium album
ggaggagaagcggtggaggaaggtgaggttgaagatgaagagaatgtgaaggttgatgttgatgactgagcatcaatggcggcagggaggactgaaagtgaggtgaaaatcaccatgaagatgatggcaaggtgaagcagagacgccattgtcgagagcttgaaaatggaggagagagagtggaagattgaaaaaaatgagcaaaagaaagccagtgaaataagaaagcagctcttagaacaggagcttgaactggtagaggctgaactgaccttggaggaggctcttgaagacatggaagaggcgttgaaacaacaagaaaaggaggcagaggagaaagttgacatggatgttgaggaagaggatgagtcggtttctccttctgttgagcaggaaaaaatttcaccaaagaaggagaccgaagttgaagttgaagatgaagaggaagaggaagaagaagaggatgaagatgatgatttagctccatcaagttttgggtctgtcgcagacccaaaggacaagaaaaatggatctgagaggtctccattctctacactttcgtttgcgtcatctggtctgctttcaacagttccatcaatagttgagaaatcattttcattgtggaagaaggaaagaccttcactgaaaattccacaggcatcatgtagcggtaccattggttgtatggatcattctcctgtagtcacttttcgccaagcattcccagagaatatgaccttgagagcaaaagctcaggctgatcaaacattccgagtgaaacgaggtaaaaaattgtttgctgcatcacggacatcctcttctcagtcaacatgctccaataatcgcctcaaagggtgtagatcttgggagcttcactggttgagtgcatcaccaaagagaaaatcagacgaaatattgtcattacacataccacttcaatgcttggattaatgcattggatattgctcctgctgcattaatgaagtgataccattttgaagtaaaattttttgaaggctgtaatttgttatctgagatgagttgagttctatcatgtatggctcggcctcgggaagtaatagctgtatttaagaatttactcttgtttattgcag

SEQ ID NO: 1177 - DNA, 1070 bp, Chenopodium album
ctttcattatccccacttctcaacaacaatgtcagacaacacccaaacaccctcaattgaccaactccctcaacaacaagatgacaacaacaagaagatgacccagatgattccgctgacgaagacgactcagactcagaagattcagactcagactcagactccgactccgactccgactacgaacccgaagacgcaaccgaaaacgccgacgaacccaccaaaaaacaaaagaagcgacaagcatactaccgccgcgccggtgagttcgacgacatagccgaaggtgactactctgccgaagccaatatcaagcgctttgcccgcgcataccagtcccgtcgatacaaacaagcgctacaaaaggaagaggatgcaattgagtatgaagatgattgttcaattttccaagagatagggagaattggagggaagaagatcttaaagagttgtgggctgatgcacctcttgagatggttaaacctgggtgggacccagcttgggctgatgatgatgattgggaagttgttaagaaggaagttcgagaaggtcgtgaccctccaattgctcccttttatgttccttatagaaagagttatcctgctattcctgataatcatcatgatatttctactcctaagtctgttattgaagaattggatcggattgaggagtttttgagatgggttagctatgtttttcctgatggaagctcgtatgaaggcactgtgtgggatgacttggctcatggaaaaggtgtttatgttgctgagcaaggtctagtcaggtacgagggagaatggcttcaaaaccaggaggagggacatgggggttgttgaagtcgatatacctgatatagaacctatccctggttccaaacttgaagcacaaatgcgagctgaagggaaaatcataaagagagattttatgagcccagaagatagagaatggctggagatggatattgaagacagtgttcgtctcactgatgggaattatgaaatcccattctacgagaatgatgagtggataagacaatatggaaagaagccggaaaaaggtcggtatcg

SEQ ID NO: 1178 - DNA, 2711 bp, Conyza canadensis
ccaacaccacaacaaaaaaaaatgtcatccaaaaaaccagaccaagatgactcttcttctgataccgaagaaccatacccggataccaaaaaacccgaagtcacaacaatccgacccaacaactcaattatcaacaacaaaaacaaaaaaatcgatgctgatgacgacgatactaccccagaaggatatttcaaaaaagtaagtcaaattcttgaatcagaagaattcaagaaacttgaagaatcacaagaagtgaatgacgtggacaatattggtgacctgtatgattttccagaagacccggagaactggaaagaagaagacttgaaagagctgtgggcggatgctccgccttttatgaccaaacccgggtttgacccgagttttgtggataaagatgaacttgatataattaatgaggagattagagaaggaagggatccgccaattgccccgttttatgtaccgtataggaaacattacccggtaataccacataatcattatgatattagaaatgctaaatctgttatcgaagaactcgatcgaattgaagagactttgcaatggcatagctttgtttttgctgatggtagcacgtatgaaggtaccgtgtgggatgatttggctcatgggaaaggtgtttatgaagctgaacaagggcttgtcagatatgaaggtgaatggttacaaaataatcccgagggccatggggttcttgaagttgacatacctacttatgagcccatcccaggttcagagcttgaagctgaaatgcgagctaaaggacatatatttaaaagagattttatgtcgccagaagataaggaatggcttgagaaagatattgaagattgtgtgaaattctcacggggcagatatgaaatcccgttctatgaaaatgaggaatgggtcagacaatttggagagaaaccggagaaaggtcgataccgttatgctggtcaatggaagcatggcagaatgcatggttgtggtgtttttgaactcaatgaacgtaccacttatggaagattttactttggacagtttttggaggaagatcatggttgtgatgttgatacctcagcgttgcattcaggtatagcagatgtggctgcagcaaaggctcgaatgtttgttaacaagcctgatgggatggtccgagaagaacgtggtccatataatgatcctcagcatccctatttatatgaaggagaagatgtgtggatggctccaggcttcattaaccagttttgtgaagtccctgattactggaaagcttatatggaagatgtggatgaagaacgacagatgtggctcaactcgttctataaagccccactaaggctacccatgccagctgagcttgagcattggtgggaaaaagacgagtctcccgagtttattctccttaacaaggagccagagcccgatcctgaagatccatcaaagatggtatacactgaagatcctgttatcttgcacacaccaaccgggcgtataatcaactatgtagatgatgaagaacatgggatccgtttgttctggcaaccacctttgaaggacggggaagatgttgatgcaagcaaggttacctttttaccccttggagatgaagaactatttgaacgcgatgatcgtaatgttttagagcgtacagtgacatcattacaagataaatgcaagctcatgcttgaaaatctggagaaatggagtgaagagaagaagaaagagagtgaagtgaagttgaaattaatagaaacagaaattgaaatagttgaggctgagtctgaattgaaggagattattaaagaaatggatgatgaattgaaaaaattggaaaaagaagaggaaaagaaaatggagatgggtctggaagacgaagatgaagacgagccagttgagaaatctgaggaagtccctcatgttgagattaaagtcgatgaggttaaaaatgatggtgatggtgatgatgctgatgatgaagatgaagacgaagaagaagacgaagaagatgatgatgatgaaaatacaccacctagttttgggtctgttattaaagatcaagactcgacaaaaaatgatcaaaaaggcaaaaatggtggaagatcctcaccgtttgcttcatcttctttgcagttttcttctgtggggctggtttctatggttccatctcagctacagcagttacttggggcatggaaggcgtcaagattacatacaaaaacttctctaccttgttcttctcaggtcatgagagatcaattgacccgaaagtgttcaatcagttttgaacgaacgtttgaccaaggtttgacaatgagggcacatcatcaaaccaacaagctcatcacaaagtcaactcatggtaaccgtcttaagcacaaagcttctgcacatcttcaaagtaacacgggtgaaccaaatagacacagcttgacttggccatgcatacgtcctgatgaagagctaagcattttgtctttacacattcccatttagattgttgtttacagaatcacccccggtgccgtatttgacactggttttcctttttttagtatcttccaattttgtaatttaattaataccttgattgtggcagacatagtcatgacatttttgtctacctaagttgtatcaatctgtttaaaccaccctttggtgaaaactgaaacagaaatgttcacggaagagtattttgagataat

SEQ ID NO: 1179 - DNA, 20456 bp, Conyza canadensis
  unsure (1)..(20456): unsure at all n locations
attaaatatttttacataaagatctaattctattataattattattaattagcagtcaccatgaacttaatgttgtatatagcactttatatgtttttagttagcctggagtttttttctccgaatacttataacggtccaaggtcaacatttcgttgtctagggtacgtgcaagcattacaaataatgttgcatttgttcacacttttagttagcgtgaacaaannnaaaattttgtcacgcttttatatgtgtaaaaatatatagaactaaaagtgtgtagaaatttcttcacactaaaaagtnnnnnnnnntaaaagttcacactttttagtgcggactcttaagtctacacactttttagtgtggagannnttctacacacttttagttctatatatttttgcatacataaaagcgtgacaaattttttaatttgttcacactaactaaaagtgtggacaaatacaatattatttgtagtgaaggctttaccattatacggtccctgatatcgcataccgactgaatgttcggaaaaaaaattatattaagtacgtactcattaagtcaattaagtttcaaataaacaacatctaaaacttgtacacgttaagtctatcatcaatttagttttaatacaaaagctatatatcacctaagtaaagatatgatcatatggttccgacttccgaaggccgactatatatatgatacttatttgtaacgttctcatatatgatcatcaattaaaaaaatgacccttggttctcataactcattattttttttagaaaaatgaagaagcacaaaaattattttctagagaagctatcatgtggggtatcaggtttgaaacgcaatggggaaataataaaaataagaggaccgaagatgtcagccagggtgtacaaacgaaagctattgtatggcaaaaggttacatgtggacaacaaatttcagaatagggaaaatgaagatctgtttagcaccaatttcgattcctcatgtaagtatttccatcccttctctaagaccattttaaaacgtaactgaaagaggtagatgaaagctaaaggtgaaaagggtgaagatgtaggtgatgagcgaaggtgaagggaggaaagtgattatgatcacctatctaaaaagacaaaatgtgtggtccatttttacatattgattaaatgtattgtgcttttaattaaataaaagtggggaccaaatgataggtgaatgattaagggaaaaagtagaagtgaaagaaatgagaaggtgatgctgatttgacagaaaaaaatgtagatgaaatggtgaacggttacgaatggtctaataaatatacactccgcggtacaagattttacatatatgcaacaatttattgtcttatgttggcctatggggtttagtgtatgtgtgagcgtacgtatttaactctaaaggtttttaatgtgtgtattgaagtctaaattttttcatgattgatatatccaacctagctaataaaacaggtaaacctttgatgatatataaccggtaacttaattagtgtatgtttggtaaggggcttttactaaaaatgagaacttaatgaagcccaaaccccttattcctcttcagatttactaacgacagcatatgaaagcattgagcaagcaccatctattggatgtatggttggtaatagaggtaattctgaaattggtagtgtcgattttagttatgatgcaccaccatcatacaatgacgtagctcctcgagatagatctcaaacatatgagtatcccaggcacagtggtgttcagaatcatttgagagatcttacgaacacaagcgacgccaatcaaaggaaaaagaagaaaatcacgacaatgatggacaacaacattcgggtgtaaaacccctccttttcagaaaatgtatttttatacttattatgagctattttatttatttttttatgaagtgaatatgtggaaaattcatataaggatgtaatattgttacttaaaaaacgactttggtatggattggaataaaactataaaagtgtcaattagccaagttgaaggtggactctttcccttatgttttattggttaagattcttgatggctttttgaattttgaggatttaagacgtcatttgattgaaaagtttatgaaccctagttattttgattattttgtatgttgaattttgaggaattttgacgtcatttgatagagtcatagaggtcaactactactcaactatggcaatggtgattaatggttttgaatttttgatcaacttatttgggctcacgttcggtgttggtgggttctagctttcccctttccctatttagtgaaatgggcctctaacatgtccaacttacagcttaccaaggccttattaaggtatccgcttaatctactttggaagtttggatgatttggagttggaggattaattcatgcctcaaataatgaaatctcatattatgattagaggcgaatcggtgatcataatacatcgagggatctaacaggatttctaatgctaaaaatatttattagtatcatcaaggttatataatcaccggctagttcacctgaatttctagacttttttctatcgtcaactcgactttgacctactatattcaacagagttttatttaaattcataaggtttattttatagattcagtgatttacaacatctaattattcaattccattgacaacgcaaaccattgaggtaattttatttataaaacatgtatcttttaatagattttcatacttttattaatgtatgcaacaaatattatatatacaaaaaaattaactcaaattatatatcatgcatgtagcatgttatacaacaaattaattataaggagtgacatagattatgttgaattttatataacatagtaatcaacaaatattatatagggtatattatgtcaaattgtgcatcacgcattgacatcaagaccagaggcggtaccagaaaaaaatttcgaaggggcaaacttagaaaacttatgaaaaataaatctaaaagggagcaaaatgtcaaaaacctatataaatttttttaaaatctatgaaaaatttaaaaatacangacaaaatttaaatttggagggagcattggacctccttgtcccctttagtgccgcccctgatcaagaccggtctatactacaaacatatgacgatacctagataacacagtggatcgcatcataaacattccaagaatagcatacaacgacgttaaaatttgtggaaagtagatagaatatctgttggcatattctaagaataaaaactagagagaataattttgggctattatgattaattcggtctatggaatttatctaacatagagaaagttcatattttagggagttacaaaccagaataatataatactatgaaattagtacaaaactattttgtcatcaatgcatatgcaaactagagatgccataacatacaaacggatcataaaacaatatcaacctcatcgcaagtgtcaagtaaaatcatatattgggacaagaaaaaaaaaatactatcttcgaaatcttacatttccaaagatgcagtaaataagatgtggtaaaaaataattatcacactattcatgtttgcttaagcattcaatgcattttcatcactttttttttatgtagtagtatcttatatttatttattttttttattttttaaacaacgagttagtaattagtagttattagttagcatttgagacaacacagtgacagttatcgtctctttgactagtttatttatattactttttattatcaaataataagatagaataatttaacaaacacatacatgttcattgattgtaaaaaaattggcaaatgaacaaaaacaggatataaattcaatctctgagagcgttgaacatttttagatggaatcaatttggtggttcaccctaaaatatttaatcggatacaataaaagattaaataattttatgtatgtttgtgtttaagatagagaacctgagagaataagggaaatgaccaaatgataatatgtaaaagaataaatacgatcaaggcccattaactgctttttatgctgcaaatttactagtagcgtcgtaatctctaaaggcgttgaacacgtttagattgaatcaattcggcggttcacccaaactattcaatcggatacaatcagagattaaacacatatttattaagtaaaaacattgttggggatatatagaaaaatgaacaaaagcaggatataaatttaatctttgaaggcgtgaaatactttcagattacatcaattcgctagttcaccccaaaatatttaatcagatacaatccatcaaagattaaataattttcgggatgtttgtgtttgagatagagaaccagagagaaaaagatcatcgactagaggataatacgcgttctgtcgtaacctttttgggcgtgctacatgaggctaacgcgtcactccccttgccctaagtatctgtagaacaaaaatgaaagcgattagcaagagaatacatagttcgcgtcattaaaatccacgaaatatccattcaaacaacaatttgactttcgaagtttcatgttcttaggaatcaccaaacatgcattacatgtatatatagataccaatactcgtctcttttcactcctatttctcattgtcaaattggatacacaaaacattagttgtaccttattttcagtacttgtcatccacctatatattattctgtattatatagtggtgcattgggtacaagttgagacataacttaatattggtgctagtttatgttcaaaattaaatggaaggtgaaactatgaaaaatgacaatcaaagggtggtgttagttcatgatgcctctggaggggtgaaaaccaatgctgtgagatggattttggagggattcaagttgaaggctggggatatttttacctttctttcggttcttcatcaagttcatcatccaagtaataattctattgaaatgtctacttttactgtatatattctgagcaactgtaaaattcttaatatcttggactaaaattttcgtacatttaacaatgtggactcatttataacgaaacgggtcagctcagcatattttatcctgaatatgtaatggactatacgaatcttgttatatatatttgtgattgtagtgggaatcaagataagagtggataattccatgttcgggggaacaaaccaaaagattattgatgacgaaattgcttggaagaagaaagagtacgatgataatcttgaacttgtccaaatatcaaaactatatgaaatgcaagaggtatgtaatcaagacaattctacttttctttaactacaaaatgaccaaaatctatctatctatatatatatatatatattctgaatgactaaaaaaactagttacaaggaccatatgtattatttattttgctgtaaagtcttttgaaaaatgtattttgctgtaaaaatatgtggtgttattgtattgtacgtgaagtgtatagtaggatccttttgctacatacggagtatatgatgtctctatgtaatatgtaatctcagaagctacatatatattgacatgaacgtacacacttcaaataatttaagttatgcaacatttttcttttacaaaacagatagaattcaagattgagttggtcgttggacctatacctaaggttgcagccgttgaagcatctaagaaatgcaatccgacatgggtgattcttgataggtagatcaaccaatgatggtttttaattagtcaaattctatcaactacagtattatttgtttatacaatgaatatttgttttggttttcattacttgcgacatttattgatcctttaggagaatgaagagagaaagaaagtatttcctagagaagctttcttgtgggatatcaagaatgaaaagaaatgacgaaataattaagataagaggaccaaggatatcgactgtatcccatacaaagatatcatatgacgaaatgttaccagttgaccacgaatttcacactagggacaatcaaaatgaccaagatctgtttagcatcgaactgtcctcgtgtaagtatggtatttccaatacacacaaataatttcctacaatcctagctacaatgttgaatatagatacaatatgtacagtacacaacttaaacttatttttttttttttatatatatcaccataatatacatttcagtttaaactattttataagtttagtatttcttataggatttaaggtagaagtataagccaacgtagtttttccttatacatagatgtatgcctgtatcgtaaacttaattttttattgatctgtaattttttatcgatctgtttgcccgactaacttttaaaatttatacatcgtacttttatgacttatgataggtcataagtgtacgaacaatgtactaaatttaaaagttagctgatcaaacatatataaaaaagaaatttagccttaaaccttctcttttaacctaagtacattctttactagctagtgataataggaatagatgatagcttttacttaaacaatgaaataacaggtacaagttctacgagtacaagaaatagcgttagcgatggcatattaacactaggtaatagtcaagatgacaagataaaacagttgtcgacgctcttagaaacaattgagaaagaacacgagagtccttctacagaaactagtcgtgaaagtactcaaacaccacggatgtcaatagagaaaatacaatttgatcagaagaaatgcacaacttgtaatatcacaagaccgacgaaagtgtggcaaagtagaaacttttcttattcagagattgttgaagccactaatcggttttcatctgagaatctgatctatcgaggagaatacgaagctgttttttcagggaaacttaaaaggagtaagttaaatgttatcgttaagcaacaaaaagatataaagaagtacagttcagagatgcaagcacttgaaaaaacacgacacgagaatgtgatcatgttgttaggaatatgtgttgaaaaaatcccagtattgatggtttatgagtacgcttgcaatggctcactcgatcaacatttgtcatgtaagtaagatctttattaggtatatataaaagttttacgtacctttacattcttatcgagttcttgatgcatttaaatgataaacagatcaaaacattagacctttaagatgggcacaaaggatggcaattgcaattggtgtatctaaggggttacaacatttgcatactcaccacataatccatggagatatacgtccgaagaacattttattgacacatgattttgaaccacttgtaagccatcaaactcgtcatccatgatgcgtacattttatgaatgcatacgatacacacttgatgttgttattttcttcacctaattagattgcagggtttgggctagcaaagatgataaacgagaaacaaaactcctcggaccactatataataggtacatttggatatatggcaccagagtatacacaaagggggaaagcaactacgaaaacagatgtttatgcttttggagtggttatattggagattatatccggtcgaagtccaacagatacacggctaaaaggacaaagtttattacaatgggtaaagcttatttcatgcctcaaatgacaagaagtcacataactttttccatgtacaaattttatcattaatttgcaggctattccactcataaaagagaagaggtattctgagttgattgatcccggaattacatacgacaacgagcagctggtgagcattgtacaaatggcattagaatgtctatgcaaagattcaaatttaagattatccatggacaaggtaaaaatgtaaaaatgatatgatgtaccattgactatttgacttgcatttgataattgtaatctgataaacttgttgatggtctattttaggtagtgcaaacattggaacacatcaatgatgagaaaactagccatgaagcccactcagtagatgaaattgaggaggtcaacgaaaatgcaaaaagtaaccatcaaagtcaacgtgtttttgatgaggaagtcaactttagctttggaggaatgacccctctgcccaaagaagccaaacatttttaccaagtagaacaaatataactctttttagttttaacgttttatcaacaacaataataaaaacaataatgcttcggagtatatgaaagcaaattaagtgtgcaagtatattattaggcaaaatagacaaaactattcactcaatgtattctcttttatatactagtacttttgcgggtatttacatggtgtaacaaatgtatatattttgaaactttagacttcgagtctactaactcatgaaaatttcattaatgtaaaattattaggataaatcaatttaaaatacagtcctaattcaaatcttaggatatagaacttcgttcttaatttggtttgtcgtaactcgtaagcttttaagttagtatctaatgataagtgaataaattacatgaagttggtcccaaaaaatgtttgatgttccaaaaaaacatacaaagttaatgattactttaattcttaagcaatcatctttcaaccacgcatcactttgtaaggccaaccattcatttcactcggctatgagtgtgtgtggtttgtaagaatgggatgaaggtatgagttcctcttccattgaaggtgtttggtttatgatttcaaagtggatatcaaaccctagaaaatacccatgcatcatgtttacaatgtgattctcatcaatgttcaatattagtaataaacttaggggttaactagtatgcttctagtagcatgcttccaccataatttttagggggggagagattttatattcaaacatgtgatatggggtgagtttgtgagtgaaaaacatgtttctttcattcttctagcagcatattggtttttcccataaacttatatctaaaataactacagagtattatcgatcacttagtaacatcttcatttttataaattaattcatataataatcattaattatactgagcctttaaataaaacagattacaaatgtaaacgagtcaaaatcaacacaaaagatattattcctcttctcttcatcaagattagaggactttttttttccgttgctagtctttcaaccaagtatttatgcattttaagtgaacgagctatgatcttgtaaaatacttaggtcgcatttggtttacagaatttgataaaaattgatgaaattggaattgaatttcattccttggtgcgtttggttgttcaaagaagggtgaatctcattccgtaggaatgtaaacatcctatcatttgatggaatgtcaggaatttcattccttccatcacttgaattttcaaaaaatcaaaaatattccgtatcaaatttcatttctttgaattccaatttctttgaaagattcaattgattctaaaaatattctgtgaaccaaacgcacttttttttttttttttccggaaatttgtagggtatatatgtacttttagaagttttctttctttacttttactcttttagtagtctcatcttttaacaacatttcaagattggtccttccactttgtagatatcccaatatatatctaaccagcatttcccaccctcctcttgcactctcacaccttatctttctccttcttccccccaacaacaccaacactcacacacaaaaaaaaaatgtcatccaaaaaaccagaccaagatgactcttcttctgataccgaagaaccatacccggataccaaaaaacccgaagtcacaacaatccgacccaacaactcaattatcaacaacaaaaacaaaaaaatcgatgctgatgacgacgatactaccccagaaggatatttcaaaaaagtaagtcaaattcttgaatcagaagaattcaagaaacttgaagaatcacaagaagtgaatgacgtggacaatattggtgacctgtatgattttccagaagacccggagaactggaaagaagaagacttgaaagagctgtgggcggatgctccgccttttatgaccaaacccgggtttgacccgagttttgtggataaagatgaacttgatataattaatgaggagattagagaaggaagggatccgccaattgccccgttttatgtaccgtataggaaacattacccggtaataccacataatcattatgatattagaaatgctaaatctgttatcgaagaactcgatcgaattgaagagactttgcaatggcatagctttgtttttgctgatggtagcacgtgagtttttactcctttttttttacatttttttttatcgattttatagatacattgttgttgttgtttgtatgtttagtgtgtagtagtatggataaccgacccattattagtaccggtcaacacgaatgaggtaaattgtgaacactatggtctatggttaaagtaaacatgtaacattgtaacgggttttcccttgacattgcaagtcctccgcaactaggctactactactattatgaggacaatatagtgtatgattagtttcttgttttaccggcttttgatagagaatttgtggggaaaaaacatactctgattacttttggttagctagaaaaagtaggcgatattatgaggggatttaggaatgcgtatatcttaggagtgtttggctatcaggtggtttgtagtgaaaaaacactcaatttattgtgaatgcaacttgtcaagtcataggcacttataatatgcacgcttctaaagaacctaaaaaatcaaccttgacaatgtgggtcatgtaaagttttatagtttcgtaaaaagataatgtaaatcaattctcccaaacttggtagaacatagagttggaacaaacatgattcgtattgtaaatacaatgaaaacatgataataataaaacctgacaaacctgtggaacctgttagatgattaagcatacttgccagttatgtcgggttcccaaaacgagatgattgtttgatgatgggattgagaatttgggagatacacacacaaagagggtggaagattagggttagaaatgttgtacatggctctctatttatagagagagcatttacagcttcagcccctggtgtttagtatgcgcaatataagtccctgtagttccaatcatctaataggaaaccctataatttgtctttaagagtgaatacgctcatcgtatatttactagacatagggatnnnnnttatcgtcaattatcatatcacaaatgataaacgaccagtgacggtcacatttaacgtggttccaacacatagactaaagtagttgagagaaatttatgatagcattttgggagcaagataatttttgcattgtcaaagttattattatgtcacctttttttggggcaccaattacaaataaatcagttaattggaacccccaatttatctaggcaagtacaagtcctagacaagatctttgggccaatgtgcttcagttttgatagccgtttgaattatgatacacaccagccagggaaagttctgcatctgtacatgtttagttttctattttgtgtctattcttttttacaataagtctttttttacattatgaaacggtaatttgcttgaaagtatatatttgcggctcattttgatgttgaatgcatattattcagttcttaaagttaactttcagcattctactatttagtagtttcttgtaatatttcaaggtatgaaggtaccgtgtgggatgatttggctcatgggaaaggtgtttatgaagctgaacaagggcttgtcaggttcggttatattgtatatgtttgtcttgttagtttgttatttgaatatgttttgattgactcttgaggctaacaatgagaacatctatgctgatggatgattgcagatatgaaggtgaatggttacaaaataatcccgagggccatggggttcttgaagttgacatacctacttatgagcccatcccaggttcagagtatgtatatgatccgaactatgtttcttatatgtattgcatagtatgaaaataaaatgaatgcgggacgtttatgtttttgtttgttctttattttacaggcttgaagctgaaatgcgagctaaaggacatatatttaaaagagattttatgtcgccagaagataaggaatggcttgagaaagatattgaagattgtgtgaaattctcacggggcagatatgaaatcccgttctatgaaaatgaggaatgggtcagacaatttggagagaaaccgtgagttcactagaattgttgtgtcccctttagacttaagtttgatacaaaccatattcgttcttgtctgtatctagtggttattacttactttatcacttgggtttttgatggtagggagaaaggtcgataccgttatgctggtcaatggaagcatggcagaatgcatggttgtggtgtttttgaactcaatgaacgtaccacttatgtaagtccgaagtaaagcatggtagtttatatttgtgctttaaagaagcataacatttgatgttctttgttcagggaagattttactttggacagtttttggaggaagatcatggttgtgatgttgatacctcagcggtaacgtaacatcttactgtttattggattctgttgaatctttgcttattaaatttgattattatagttaagtttaatgcaaatcatactctgataaatctactaattacatatgtaattcagttgcattcaggtatagcagatgtggctgcagcaaaggctcgaatgtttgttaacaagcctgatgggagtatgtcatctctcttatcctttcagttgaaattatatacatgttcataaacagtcgaaacatacgagtccctagaacatttcagcttaagaaagttttttacttcccaaaacctataccaagttgtagctattagttctaccagccacaagatttctatgcatattttttccgtatgtatatattctctctttagtcactcgtgagcatctgttacagtggtccgagaagaacgtggtccatataatgatcctcagcatccctatttatatgaaggagaagatgtgtggatggctccaggcttcattaaccagttttgtgaagtaacttcttcttccattttttattgagttaaacttcttaacgtttttgcaatataaccatcgttcttgcaaaagaaacactactatgtaagcatgacaaattttcaacaatatgggggatcaggggatgtactggccaaaagcgctttgtacttttactattttgaaaggttaatcatctttttcacttgctttatgtcaggtccctgattactggaaagcttatatggaagatgtggatgaagaacgacagatgtggctcaactcgttctataaagccccactaaggctacccatgccagctgagcttgagcattggtgggaaaaaggtaatatcctctttgaaagactgtatatgtattttaagttgaatttttacattaatacgctagtttaaactactaggttatttagaaagataaaatcatttgtccttttatcgaacatactataacatcattggtgaaaactcttaggattacaaatcaaatgcatgcagaaaaacataatccaaataagggaaaattccataaaaaggtaatccttttaccaaaaatttctactaaagggaacctattcacatttagtcttttcaaaggattttattatcaaatatcaataaaaaagggaatatcgtaaattttttggattggtccttcgttaaatgccaggcttgccacgtcataaataccaaagcgcttcctgttctgaccaattatccaacctgctcaacccaccattttgctttttcttcctaaatatatgcttattgcttgggttcttattgttttattcatgtagaacagtttggtgtagttaaagaaaattggataaagttacaagacagataacaactgtcttctcattttattttcattttgagcagacgagtctcccgagtttattctccttaacaaggagccagagcccgatcctgaagatccatcaaagatggtatacactgaagatcctgttatcttgcacacaccaaccgggcgtataatcaactatgtagatgatgaagaacatgggatccgtttgttctggcaaccacctttgaaggacggggaagatgttgatgcaagcaaggttacctttttaccccttggagatgaagaactatttgaacgcgatgatcgtaatgttttagagcgtacagtgacatcattacaagataaatgcaagctcatgcttgaaaatctggagaaatggagtgaagagaagaagaaagagagtgaagtgaagttgaaattaatagaaacagaaattgaaatagttgaggctgagtctgaattgaaggagattattaaagaaatggatgatgaattgaaaaaattggaaaaagaagaggaaaagaaaatggagatgggtctggaagacgaagatgaagacgagccagttgagaaatctgaggaagtccctcatgttgagattaaagtcgatgaggttaaaaatgatggtgatggtgatgatgctgatgatgaagatgaagacgaagaagaagacgaagaagatgatgatgatgaaaatacaccacctagttttgggtctgttattaaagatcaagactcgacaaaaaatgatcaaaaaggcaaaaatggtggaagatcctcaccgtttgcttcatcttctttgcagttttcttctgtggggctggtttctatggtgagtttatgccttctaatgtccatggttttcgagttcaatcctttgactattaggactaataatcatacctatagatgcaaaagataaaataaaaaatcaaacatactttttatgttagagacggcagtttttactatttataatggaaaagggccattttatgttttatttcattgataagaggcccagcgattggaatgtagaaaattagcttaaatgaaatgggtcaaacttttaaattggtcgaaggtatgcttaagatgtcttgaattgatttttacatcaataatctacaaaacacaaaaatgggccaccagtaacatggtttgccagtttgcggtgtaaacacgtgtaaaaaaggacccttttcctctaaataagtttctgtcatactaattgtctaactaatcctggttacttgaatttaacatccataatgttatgggtgttgatataatatcaaagtttccctagaactatatcataatttgcttgatgaagctagaatagattaatctagggtagaaccatacattttcttaattctgcatgaccatagagtctctatccttcaaatattgtacttcataatcacctttctgtgtttaaattgtaggttccatctcagctacagcagttacttggggcatggaaggcgtcaagattacatacaaaaacttctctaccttgttcttctcaggtcatgagagatcaattgacccgaaagtgttcaatcagttttgaacgaacgtttgaccaaggtttgacaatgagggcacatcatcaaaccaacaagctcatcacaaagtcaactcatggtaaccgtcttaagcacaaagcttctgcacatcttcaaagtaacacgggtgaaccaaatagacacagcttgacttggccatgcatacgtcctgatgaagagctaagcattttgtctttacacattcccatttagattgttgtttacagaatcacccccggtgccgtatttgacactggttttcctttttttagtatcttccaattttgtaatttaattaataccttgattgtggcagacatagtcatgacatttttgtctacctaagttgtatcaatctgtttaaaccaccctttggtgaaaactgaaacagaaatgttcacggaagagtattttgagataatgcaatggccaatggagaattggagatgggttatggaagaaccgcttctaatgtcatgttatgattgtgttataatgatggaatatccaaaagctcagataatttaattgttgctttacaaaaactcttatcaaattggtgcaaattggtgagattttggtctttgctacatgttgctgaataattcactgaacacatgaattaaaatcacattattaatacattatattaaaaaaaaaaaaacatttctatccatcaccgagatgcccataacccccaccccacttcctctctggtcaccgaccccgtcactggcatggtccgaatggttatatagcaaacggattattcgaaatagataatgaaacatgaaacctagtaaaaccccttttatctatattattattattattatnnnnnnnnnnnnnnnnnnnnnnnnnnnnnnnnttattattattttattatatatactatattataaagtaaaaaaaatttaaatttaacttaaattttaaatattgattttaagtacttttccaaaatgtctctccaatctattctatatttacctaaaataactataataccctttatcttttctcaaatctcaaccaatcatttttttcccctctcctgcataaatcattttatttctctaactctttcaaaatcttttatctcaaaaattgtacattgataaattataaaaattatatgggtgttcttcaaatttcatgctttttcattagagnngtcattcgatatactttcgataaaattttaaatccgagggtggagcctgtacggctaagacatttgnnnnnnnnnnnnnatgacatatcacctcctataacctattatactttatggtctatcaccttaccatttcaccactgtaatgcgcgagtacttactcgttttgtataatagctataacaaaatgacaacacaagtggcggtagggtggcctatcaattattgtgtaaaaaaaatagacgacattagtgagtccaaaaaaagtcataaagtgcaccacatgtcatgttattcgaagctcatcatcctactatcttcaacaaatttacatcccattatcccaaccttgtgtatagttttagtaaaaaaaatatatgaatagttaacttgttgattatatatgtgtgaaacatctgtaatacggataaaattgagaaaccatatatatgagcaaaaaccaaagttgcatcatgtatgtatttgtattcgattatcacatgttctaagctagaattataactgtgttatctttgagatatgtcgctttaccagataacatgggacatatatgcctagtggcttagtggtgcatgaatataggcgacaattgattaacatgagaaaaggtaaatcaagcaatacttggctaaataaatatattcttatttgcaacatatatttgcaacatatatgtgtgatatgatgtatttgctacttaataaacaaattgtttttctacatttcatggaaatcgtaatgttggaaattgaaagcaacctttctacatcgtcgttttaaacgtaagactgtctacatctcaaccttccccatacaccgtcgacatactgagatcgtgaaatacgacattgggcttcatggaaactataaggccggagatttatttttcttatcatttagatataacctgaaaacaacctctctacatcttcattgtaggcgtaagactgtccacatttcaactttccccatgtaccgtcgacgtattgtgatccaaaacccgtaagatatggcattgggtgtttacttttactctatatgtagctgatggtaaatactatgagaacataactatatattacgtatcaaacacaaccaattctgattaattcatgctccattcatttacgtatcaatcataagatcaagtatagaaaaccttgtatcgagttggtatcaaatacgtcaaaatatatatggtcaacacttgtacatacccggctttggatttattagcctttctagtttctaatcacacgctagtcaattcaaatatttcaaaatcagaagagaaaaaaagatgactcatgatttaagctacaattaactttatgtttgagtttgaaatatcgggagatcatattcaattacgttatattagtgtattgacaataattcatcgaacactcatcattcgtaacaatatatagaaccttttttttttaacagcaacagtatatagaacctgaatccataatctctagtaaagtaaaaagatgataatttttttactagaatccaaaatctccggccactatctatttgtagggttttgttgtagaagaagtaaatgatactacgatagtaaagtaatcggcacatttggtttgtaaattgatgggtttgttaatgaatattgtaatgggtataagtttgaaggatagaggattaaaatcaaacgtgaatcaaatttaaccggaaggagaacaataattcgaaaataagaatatttaatttgattaagacaaaaatgaaaaggtaaagaagaatgggggaagacattggaggggggccgccaatgaagcccacaaacgcaattttcatgcaccactaattaaacgctattccacttaatttccggcgtctactccccaatcaggggcaaggatgtagtcgactatttatattggcaaaaagaatcggttctttggcaaccctatagcacatgcattggttagttttggcaagtttaatcggctagttttggctatatatattggcatcttttggccgatccttgtgaatgttgggagtgtgtctttgtgaccctttttatttcttgtgtcaaatctcatcttcacctgaaacctaatcggaaaatttggaggttttcgattttgaggctagatttatgtttttcttggcttttattaccggaatacatgccgataaaacttgtcgatgttccttaacgttatattgtaccctttccggcaagaaacgttcacttttttaacagccaaaattttgtttggcttgtccaagggtgcggttggctatttgactacttgttgcttcggttttctagtgaccccttttttggggtttccagtttaatcgatagggtttcctgttgctttgttggttcggtttcccggcgagccctttcttgggtttccggtgaactgttgctgcatgttgcatcggttttccgacaaaccctttctttggtttatggttaactgctgctgttgttgctgtttacggcggctagttttttggcgagccttttcttgggttttacggtgaactgttagcctgctgctgcttacatgtgtgtgtgtgtatatatatatatgcatatttatctttttacattgccgttagttgtaggtttgtgattagcttggtagtgttaacttagcggtagtattgtcggatttttccttggtagcgttgccggattttgttccattaaagcaataggtagccgtaaaaagtagttttagccgatgattatatcgttgactagttaggttgccagtgttacgttaaatgggcgatgatgatacaaatgttcgtaaaaatgagactcagatgatccaaggcgtatcttggcggggtaaaccttcgggttatcagccatggcgtctctgaattccaaaattcccgagccctaaattctaagtccaagtttttattttatacaaaaaacagtcactttttatggtttccggcaactttgattattttccagttaccttttatatgtttttccgacattagtaatttgccaagttttggctagttttttggcaacgacacgttcggcttgtcattggctgaaaacttgtcaaacttgccaatttaccaaagttttgacactacacccttgcccctaatgaccacacacatgtcgcttgttacgatagtaagcaaatcgatcagcttctcacacctcgacataaacgttatatgaaaataatatatgtaactattattagcatttttttctcaaaaatttggtaaacaatatagggtgtatgaatgtcacatcccgctaaaacggaatacatgagatgtgcaacataatatagtacatgttcgacagtcaaaatcataacacaccatagtatttgataaggctattatgattacattgtctaggtacaaaagtgagaccacacgaggtcaatctagttacatagatgtacaatgtacttcctagttagctcaagtggttgagcacctgccttacaagcaagaggtctttggttcaagacttgggaagtacatatgaagtctttctatgaaggtttggcttgggtatacccaggttcaagtctgaggagacagggtttacccctatt

SEQ ID NO: 1180 - DNA, 480 bp, Digitaria sanguinalis
aagaatggctcgagaaggatattgaagattgtgttcgtttctctcggggcagacgggaaattccattttatgaaaatgaagaatgggtcagacaatttggggagaaaccggagaaaggtcgatatcgttatgcaggtcagtggaaacatggcaggatgcatggttgtggtgtttttgaactcaatgaacgtaccacttatggacgattttactttggagagtttatggaggaagatcatggttgtgatgttgatgcttcagcgttgcattcaggtatagcagaagtggctgcagcaaaggctcggatgtttgtaaacaaacccgatggaatggttcgagaagagcggggtccatatagtgatcctcagcatccttatttttatgaagaagaagatatgtggatggcaccaggattcattaaccagttttttgaagtcccagattactggaaagcttatatggaagatgtggatgaagaac

SEQ ID NO: 1181 - DNA, 497 bp, Digitaria sanguinalis
tatgcgggtgctgcagtagtgaatcaaactgcccaccccattaaaagtgaccatataaaagtcagatatagatatgctgatggaacataatgcctttttgttgttcgttgtgcaaagtttttaatcatgcattaaagatggtgatgtgtttgataaaaatgtgacggagaatcccttgcgttttaagctcaatgagatcatcaatgcttaatttgtgtttgaagctttaatctactggagcatggtagtgctatgcatattagcctattaaattgatatcattgttttattttattctgcctgtcatagtggtccttttttcccccaagattcgtaatgtgtttctattaccaataaattgtgtattcattattatgtggttgacaactaatgttcatctcctttgctgttgtaattactgcttcaacagatgccccacctgaatttattcttctaaacaaggaaccagagcctgatcctaatgatccctctaagct

SEQ ID NO: 1182 - DNA, 201 bp, Digitaria sanguinalis
tgtctaccatgaagacttgtttgattttccaaaggataaggagaattggagggaggaggatttgaaggagttgtgggctgacgctccattggcaatgactaagcctggctgggaccctgcttgggccgatgatgatgactgggagattgttgctgatgaacttaaggctggtagagacccacctattgctcctttttattt

SEQ ID NO: 1183 - DNA, 235 bp, Digitaria sanguinalis
ctattagacttgaagcacagatgcgtgctgaagggaagatcattaaaagagatttcatgagccctgaggacaaggaatggatggagatggatatagaagacactgttcagcttgttgatgggagatatgaaactccgtggtatgagaatgacgaatggatcagacaatatggaaaaaaaccgtaagtgtttaagttaaagctggcacttgcgcattagtttcttttgttctttac

SEQ ID NO: 1184 - DNA, 240 bp, Digitaria sanguinalis
agaaagggaaatgtggttgaactccttctataaagcaccattaagattgccaatgcccgcagagcttgaatactggtgggagaaaggtctgattttccactaatttcagccacacagctcattatctgccgtggaagcagagtgtttttttttccttttttgttaggaggaagcagagtgtttcatcattgtatgtgacatgaacatggaaaatgaaccatgcaaaagtcagaaatagat

SEQ ID NO: 1185 - DNA, 375 bp, Digitaria sanguinalis
tgagtgatgaaccagatgcatcatacatggagtaagattcccttgctatcaggcttcaatgcatttactgttgtgttttatttatttattgactgtagtggtgagggaagaaaggggcccatatggtgatcctcaacatccctatttttacgaggaagaagatgtttggcaggctccaggtttcatcaatcagttttatgaagtaagacacatttattcttttgcagtatatcatgattctggctttgattgtgaaaaaaagactggaaagaagtgatcaatgctgttgtcctgggcctcctggcaacattgatgattataatattttcatgattccaggttcctgattattggaaaacatatgtgcatgaagtt

SEQ ID NO: 1186 - DNA, 2748 bp, Euphorbia heterophylla
cgaagacgtgtggacccctatcttatctcttcatccatggctaaccaagatgcctccatttcaaacgacgaccaacaacccgagccggaaccaaacccagacgaagccaaccgcgattccaatgcctccgattccgactccgactccgattccgattccgattccgactacgactacgactacgaagagttcgccggccagcaaggcggagctgtggggtcctccctcaccagggccggagaattgccgctggagtccaacacgccggaaaccaacatcgctcttttcacccaggcgctcgacatcgccaaggagctggaagataaggaccccaagaggaaaaagacgcgcacccccgaggagctttacaattttcctgaggataaggagaattggaaagaggaagatctgaaagagctgtgggccgatgctccattgctgatgaggaagcctggatgggatcctgtgtgggcggacgaggaggattggagggttgtgaagaaggaacagaaggaagggagagatcctgtgattgcgcccttctatgtgccctacaggcctccgtatcctgtgattcctgataatcatgttgatattaacactcctgcggctgttattgaggagctcgataggattgaggaatttcttacttggcatagcttcatttttgaagatgggagctcgtatgaaggcactgtttgggatgacttggctcatggaaagggtgtttatgttgctgaacagggactagtcaggtatgagggtgaatggtttcgaaataacatggagggatatggggttgctgaagttgatatacctgatgtacaacctgtgccaggttctaagcttgaagcacagatgcgggctgatggtgaaattataacacgggattttatgtctcctgaagacagagagtggttggagaaggatgttgaagataccatgcgtctgattgacgggaactatgaaatacctttttatgagaaaaaggagtggatcaaacattttgggagaaaaccggaagtaggtcgttatcgatatgctggcgagtggaagcatggcaggatgcatggatgtggtgtctatgaaatcaacgagcgagtcctatatggaaggttctactttggggagtatgttgatgaggctactgattgcgatgaggatatatcagcgttgcatgcaggactagcagaagtagctgctgctaaggctcggatgtttgtgaacaaaccagatggaatggtgagagaagataggggtccatacagtgatcctcaacatcactatttctatgaggacgaagacgtgtggatggctccaggcttcatcaaccagttctatgaagtccctgactattggaaaagatatgtagaagaggttgataaggaaagagaaatgtggctcaattccttctataaagcacccctcagactaccaatgccttccgagctccagtactggtgggaaaatgaagaggaacccgaatttgttgttcttaacagggaacctgaacctgacccagaagatccatcaaagctcgtatataccgaggatcctgtaattctacatacaaaaacgggaagaataattaatttcatcgaggatgaagagcatgggattcgcttattttggcagccgattttaaaagacggggaagaatttgatccagcaaaggtggaattcctgcccctaggttttgacgagttttacggatatgagacagtggtgaagaaaccgactttctgggaacaccttttaaaagcagtggataatacactaaaaccaatgctcgagaacttagagaaatggaccgaagagaagaagaaaatcagcgagatgaaaaaaaagctactcgaagcagaactcgaacttgccgaggcggaatcggccctcgaagaggccatcgatgacatggaagaggagatattgatggaagaggaagaagataacaaacgaaaggctacacgagagggtaagggcgtttcggtcgaccaaaagcctgtagctgaagagggagaagaggtcgaggaagaggatgatgatgatgatgatgatgtcacgccgtcaagttttggatctgtagctcaaaatgaagacacgaaaaagaaaggaaatggacctggagaatcacggttttcgtcgtgttcaatggctttggcttcttgtagcctcctttcggttataccggcgaggttacaacttccattttcgggttggaagacaaaatttccgaaaaagccgactcctacggaattcccagaatgcaagtctggaaagttttgtacagtcagcttcccggcaaaaaccgggcaaaggggaaacttgatggctaaaactcgtacaaatcctaagtttcggtcggttggaaaggtaactcatttacattcattatctcaaattctatcaagtccaaagcccatgaatcagaaaaacagagagaagatgccgagaaagaagagtaatggctcttggcttcatgatgcgcctgaaagaaattcagacaacatattgtcgttgcataccgattttaattttcgggaattgcatatcgaaaaaggtgagtttgggtttgggcctcttatgctatgagagtagagggacttgattcttattaagaaggtgggcaattttgcagagaccataaggctgattttcttgtgtaatttttatgttgtactgtgtagctgtaatctcagcttaaggtgttgtacacaatctgagcattataaacttgctttcattcaaaat

SEQ ID NO: 1187 - DNA, 5719 bp, Euphorbia heterophylla
tccgattccgattccgattccgactacgactacgactacgaagagttcgccggccagcaaggcggagctgtggggtcctccctcaccagggccggagaattgccgctggagtccaacacgccggaaaccaacatcgctcttttcacccaggcgctcgacatcgccaaggagctggaagataaggaccccaagaggaaaaagtcgcgcacccccgaggagctttacaattttcctgaggataaggagaattggaaagaggaagatctgaaagagctgtgggccgatgctccattgctgatgaggaagcctggatgggatcctgtgtgggcggacgaggaggattggagggttgtgaagaaggaacagaaggaagggagagatcctgtgattgcgcccttctatgtgccctacaggcctccgtatcctgtgattcctgataatcatgttgatattaacactcctgcggctgttattgaggagctcgataggattgaggaatttcttacttggcatagcttcatttttgaagatgggagctcgtatgtttctttctttctcttctggttttgccttcttctgattttgctgtgttgcttcaattttgattgtttttggatttaaattgcctcttgttgattgtttttgggtgatgcttgagtagttcttttcaatttagcttctgggggattgacctgaatgttcagttgagttgaattgatatgatgacaaaaagttgaataatgctcttttactgttctattgttgtgtgattgttcaaactttgattgacatctgatagagaaataggattaatttgcttagtttcatccactgaattgctaaggtgtaaatcttaatgttagtcttattaattagcaatatatgttccgtaagtttgtgtggcgatataccgaggccttgctcatgggtaggaattggtttctttgctcattaccttatatttttcggttttgtgtaggtatgaaggcactgtttgggatgacttggctcatggaaagggtgtttatgttgctgaacagggactagtcaggtttatctctctctctctctctgaacttgctcttttacatccatttgcattatacaaatccattgtgattaaattattagctcgcaatttgttttactacttaatgcaggtatgagggtgaatggtttcgaaataacatggagggatatggggttgctgaagttgatatacctgatgtacaacctgtgccaggttctaagtatgttcattaaacctgtctctttatcaatagttgaacattgatgtgttaggagttagttctagagctagaagtcccttttgcatgtaagagaatgagttaactgcttgttatccatgcattttgaaggcttgaagcacagatgcgggctgatggtgaaattataacacgggattttatgtctcctgaagacagagagtggttggagaaggatgttgaagataccatgcgtctgattgacgggaactatgaaatacctttttatgagaaaaaggagtggatcaaacattttgggagaaaaccgtaagtttcatttcatattgatataatatttgttccattaattccccttcgatgcaattttgtttcttgtctacatctttttccattgtcagcagccattgagttatttcctttagcctgaactgtttcctagagaataacagcttttttttatttcttctgctcttttttccaaaaaaaatatacttgatagccgatgtatcttaataaaaatgagaaatttggcatgtgtatgtttatatgtcaacatgttgctttcaataaatctagattgttcctctgtcattgacaagggaaatggatgggtcggttttctcatgcttgaacttgaatgtaactagatacaaagtgttcaacaattaatgcaagtcaagctcttgtgcaaaagatattccggttgtaatttcctaggttttgtttttacccttttctttttaatttcttctttccaacaaaatagagatttgttgaagacattgcttttggtttgtcaaacttcccttgttttcattcataagatgtaaaactttagcatttaattaagctgttcctgaattttcttttatattttgaaaaagcgctactgcatgaagaaattgtgtgtgtggaatgtggatcagtaagtaagaaatcacccaattgattttgctaagactaaaaagagagaatttgttattttgggctttcagatcagtaatgtgaagatctcgtgtaaaaaatgttaggaagttgaaattatagaaaataaaatatttttaggtaattccttaaacgcatataggtacttggatgagtgcataatccaaaattctacccaatcaacttacatgtcaatattagtatgcagaattctaatattttgggttttcagattagtaatgtgaagatctcatgtaaaatatgttagaaagttgatattatagaaaataaaacattttttaggttattccttaaacatttttaggtatttggatgagtgcataacccaaacttctacccgatcaacttacatgtcaaaattagtatgcagaattctgggttgggaacatgtggtttgaatccatcaataattcatggattagcaaaacaataagcagaagcccacatatccatatgcaccttcaagttgtattgtaaactagtagttgaaacttctgctgaagggatttgaatggttgaaattgaaattctaaattttttcttaatctatgactataagaagttttttaaagttttctgctaggaaagttttgacaagtaaacttcaaatctcaaatctcatttttcgttggatagttttctgcaagggctttttcaacaaaatcattttttggctttgaattgccagtaatcttggagtgtactgaatttttacaacttacgagtctcagagagacagaagcaagtaactattaatagtggctgctgccaagttgaatggaattgaacaatacaacttcaaatttcaaacttactcttaatgatggcatttgtttttattgcataaaacacgaagatttattcaagatgaaggtttgttcttttgggattactgatgaatggtgatggtatatgccagggaagtaggtcgttatcgatatgctggcgagtggaagcatggcaggatgcatggatgtggtgtctatgaaatcaacgagcgagtcctatatgtaggtccctaaatatggagacattttatttcaactttaatgcatggtcttatggactctttgtggggctttatataaacacatcaattacaggcaatttttgttatggctaagcttctaatcttgttctttagcaaaatctcttcaaattaccatgccctaatttgaaatgaaagatcaatacaccatatattggatttgacataaatttgaaacccagaatgaatttcagctactgatttgatcataaattgcgagaaattgtagtcgttcaaggtgattgagtataattgataattcctatgtgtgtacagggaaggttctactttggggagtatgttgatgaggctactgattgcgatgaggatatatcagcggtacccatgattttttttattttttatgtttaaaagttaaaaaacctttgagtagaaataatatctgacatatgttctttcagttgcatgcaggactagcagaagtagctgctgctaaggctcggatgtttgtgaacaaaccagatggaagtacgtctttcaatgccattagattatagccatttaaaggaaatctaaccacaaattatttgatttcacaaactgaaaggcaaaaagaacttttttggtccctgtgctataaacgtttcttatttggtctatgtggtatacgcgttgcctatttggcccgtatactatgcaataattacctttttggtccctgtgctatttaatcattacccatttggtctgtgctatattcaatcattacccatttgatctgtgctattcaatcattacccatttggtccttgcgctatgctatttgttatctttctggacccttttacggttggtacttttattagtgatatttcacatgattcgtactaaagggacaaaaaaggtaacatgtatagcacaaggaccgaagggaccgacaaactgatgatgccatggggcctataaaggtctttttgccaaaactaaaacatatgaagtccaatttgaaaaggcatgtaacacggttactatctagtagtgatgactatcgctaacatataagagttaaaattctcttcctctactttagcacggatctcgtaatattttgcctcatttactttatacatgagcttcaaatataatccttttttttcttttttacgttttattacagtggtgagagaagataggggtccatacagtgatcctcaacatcactatttctatgaggacgaagacgtgtggatggctccaggcttcatcaaccagttctatgaagtaaacatttcttcttctatctcattgtgtttcgatcattcacagtattagagcaactatatgtattcgcaggtccctgactattggaaaagatatgtagaagaggttgataaggaaagagaaatgtggctcaattccttctataaagcacccctcagactaccaatgccttccgagctccagtactggtgggaaaatggttaaaacctctctctctctctcgctctctatacatggtccaatcttgttacttaaagccgaaaccagaattttggggttttctgattggttataacctagaattttaatataatgttattgatatttgttctcctgtatttccagaagaggaacccgaatttgttgttcttaacagggaacctgaacctgacccagaagatccatcaaagctcgtatataccgaggatcctgtaattctacatacaaaaacgggaagaataattaatttcatcgaggatgaagagcatgggattcgcttattttggcagccgattttaaaagacggggaagaatttgatccagcaaaggtggaattcctgcccctaggttttgacgagttttacggatatgagacagtggtgaagaaaccgactttctgggaacaccttttaaaagcagtggataatacactaaaaccaatgctcgacaacttagagaaatggaccgaagagaagaagaaaatcagcgagaagaaaaaaaagctactcgaagcagaactcgaacttgccgaggcggaatcggccctcgaagaggccatcgatgacatggaagaggagatattgatggaagaggaagaagataacaaacgaaaggctacacgagagggtaagggcgtttcggtcgaccaaaagcctgtagctgaagagggagaagaggtcgaggaagaggatgatgatgatgatgatgatgtcacgccgtcgagttttggatctgtagctcaaaatgaagacacgaaaaagaaaggaaatggacctggagaatcacggttttcgtcgtgttcaatggctttggcttcttgtagcctcctttcggttgtaagttctttatcagtttcgcctctttatagctaatatggttgagtttcgcctctttatagctaatatggttgattatagtatggttgtgaaatatcgaagggttaacttcaaaaacataccatgtgatttcattcatttccaaaatggtgcttttgaaa

SEQ ID NO: 1188 - DNA, 2325 bp, Ipomoea hederacea
ctcattctgcaagctgcaatggccgacgacgagaaaatggaggaccagaatgcgcccaataattactccacagattcagattccgaggaagaggaagaggagatatatgaacatccttcaaccacccgggcggaaactgtcaggaggttcgtgcgtgtgctcaagaagaagaagctaaggagagagttggatgaggaggaaaacgaaggccctactattgaggaagagtacgatttcccagtggacccggagaaatggactgaggaggatgtgaaggagttatgggcggaccctccaattgggtcgggcaaaaccgggtgggacccgagctgggtcgacgccgaggatgaagagatgattaggggggagttgagggagggtcgagacccttactttggcccgttctacgtgccgtaccggaagccgtaccccgtggtacctgataaccaccacgagattgcgaccccaaaggctgtgatagaagagctcgataaaatcgaggagttcatgagatgggtcagctacattttcgaagatggtagctcgtatgaaggtactgtttgggatgacaaggctcatggaaaaggtgtttttgttggtgagaaaggactggtcaggtatgaaggtgaatggcttcataacgaaatggaaggacatggagttgttgaagtagaaattcctcatatgcaacccgttcctggatccaagcttgaaaagaagatgcgagctaaagggaaaataataactagagattccatggatccagaagacagagaatggctggaaatggatattgcggatagtgttagatttgctgcaggaaaacgtgaaatccctttttatgacaaaaagatctggataaagcattttggagagaaaccagagaagggccgttatcgttattctggtcagtggaagcatgggagaatgcatggctgtggtgtatatgaggtcaatgaacgaacaatatatggccgattctacttcggagaatttcttgacctggatacttatggatgtgatcttgaaatttgcgcgacgcatgccggtatagcagaagttgcagcagctaaggcccgtatgttcactaataaacctgatggaatggtaagagaagataggggaccttacagcgatcctcagcacccatatttttatgaagaagatgatgtgtggatggcaccgggcttcatcaaccaattttatgaagttcctgattattggaaaatgtatgtgcacgaggtggatgaagaaagggaaatgtggctgaattctttttataaagctcctttgagattacctatgcctgcagagcttgaatattggtgggccaacgatgaagaaccggaatttattctgatcaacagggaaccagagcctgatcctgaagatccatcaaaactcatatatactgaagatcccctcatcatgcacacgccaactggaaagattattgactatgtggatgatgaggaacacgggattcgattattttgggcacctgatgttaaagatggagaagatgatgagaacatagatgatgtcgagtttcttcctctgggactcgatgagttctatggacgagaaacatatgtcgaggaggaacaagaacactttttgaagcgttttattgtgtctgtagaaaatgcttgcaaaccgatattcaccaaactggagaaatgggtggaggagcagaagaaagctagtgagatgaagatggcattgctaaagaaggagcttgaattagcggaagctgaatttgctcttaatgaagcaattgaagacttggacgaggcattaaagctggtgcagcaagaggaggagaggaaggcggagatgggtatccaggaggaagaagaagatacctcgccctccaaaccaactgaccaatccgagaaaactacaaccgaaagggaggaggaagaggaagaggaagaagaggacgagggggatgatgatgccgcttcttttagttttgggtcggttgaaaatcaagacaaggccaaaaccgaccagaatgggaacaaacccaggaagtcgtctccatttggagcatcttctttgccatttgccacatgttccctcgtttcccaagttcctcccaagctactacattcatttatgacatggaaggaggggaaaacaaggcagcagccatcttcagctaccactgcccgcttccatgttttgcctcacgagcaacacgccccaacctcaatcaccttccccaacaccgttgctaaaaactgcagattaagagcaacccggcacttgcaataccacgaaaagcgtgcatgcaggttgcccatgatagttcaatctaag

SEQ ID NO: 1189 - DNA, 901 bp, Kochia scoparia
tttgttgtctcaagttcactcctaattacttcaaatttctttcgcaggttccatcagtgattgagaattcttttgcgttgtggaagaaggaaaagtctccactgaaggttccacaagcatcatgtagtaccaggagttgtattgagtatactcaaccggtcagtttttaccaaccatttccagaaaatttgagtttgagagctaaaattcgtcagactgatcagaagatccaggtgaagcgaggtagaaaattgtttactgcatctcagaaatctggttgtcagtcaacctattccaaaaatctgtttaaagggcataggtattgggactttgattggttgcacgctctacctgataaaaactcagattggatattgtccttgcacataccaattgaatgtttggattcctacatgaaataatgttaagttgtgtaccctttttgtagtctgttttgaaggcgtgattagttatccgagatgagttgactttgagttcctgattcatttgtggctggagatgtaatagcagaaaaattcatatgaattgctctttgtttattgcagcagtgtgtatcgaatgcaatgaaacaatgcaatttatagagatcgattttatttgttgtctatcgctgtatttgcatataagctgcaatttaatctttgctttgtttagacacaattgcatctgatcaatattgtcgttgatgatcaaatcacttttcctgtcgacatttctgcatatggaagtatggaacaatatgaatatgctgcctcaaattccttcaacttagaataagctatcaacttacttggatacttgatggttgactggttgtatatacaggtttgtgcttgtaactccaagcttgtttgattatgccctgtgaggttgtgacctt

SEQ ID NO: 1190 - DNA, 2701 bp, Kochia scoparia
tggtaaatgaattgcttgttatacgatcatcaaattgattctgtagcttcttggacccaccatttcttggaaagactgtaaatatctctacttaagctcaggcatcaaggagctacatagtgggttagctatgttgacgaaattttgtaagaattgtgcttttgttgtcatgttggttaattttgtggtctggaatataatggggaaaaatgaggtttcttttcatgtttctttatgtttttctgaagtttagaggtcctatctcttttcctaattgtttttgtttatttgttcaattataaggtatgaaggtactgtatgggacgatttggcccatggaaaaggtgtttttgttggtgggagaggtctcaccaggtatgcctattatgcatttttcttgaattcatatacatggcttactatggaaacatcaatgaacttggactttggtttacattaatcttgaatgcttgtatttttatgaattcattgcagatatgaaggagaatggcttctgaataacatggaggggcatggggttgttgaagttgacatacctgatatagaacctattcccggttccaagtatgtaaagcacttttgcattattgcaggttgggatttagtttcttcaaaaagctaactcatcagatgctcttttcagacttgaatcagaaatgcgtgctgaaggaaaaatcataaagagggattacatgagcccagaggacaggaaatggctggagatggatattgaagacagtttaaagtttggaagatttcaaatccctttctatgagaaagatatctggattaaacaatacggaaaaaagccgtaagttgtttgctgtgaacttttactttgttttccttcttctgcaatcaatattagttctttgtattatcttttgccatgctgttgatgtcttcgtgtctatgaacaatgtgtttttttagtgtttatcagtactaactgtctaactcttaattcttgatttatgggtgctttgttctttggcatcatcattatttttttaccattcatttgtagtcattactatgtatatcacacactgattaagtgattagtcaagtgaacgatggacatgccatagtataatcagactcattaactgtgatcgtgttcatcctttaaaaaacttttttttggtggtgctgtttcttctttgtagttataagcaggtttatgtggcagacttcttttgctggtgtcgtttcttctcaaaagtttatataaaggcatcagcatcgtttctttctcttttaaatcattgtagggaaaaaggccgctatcgctacgctggtcagtggaagcatggcagaatgcatggctgtggggtgtatgaagtgaatgagcgtcccatctttgtaggtgcagaaatatacttagcgatttatagtctaatttactttgggttttcttccataatttttggttatggagtataagttccccttttgttatttattctcttctcgaccggttttagaaattagcttctttaagaaatttctttttgcaacgtcaaaaaaagagaaaataaatgctttttgtactgtcaatttacatgggttgcagttgctctgttgttaacatttataataatttaattacttgagatgaggcaattattgcttttgctttcctgctagctgctgggcctgctgcttagcttagctactcgcttttgatttaaatcatcaactagtgctggtattttgtgtatactcagtctttattgttttgtggttttgaagggacggttctactttggggagctgatgaaagagtctgctggttgtacacctgaaatttgcacggtatgattattgtactcctgttcttcttttctctgtcaaggtaggaggttttcttctttatcttcctcattttcttcctttttctttttggtctgtgtgtagaggcctagagggtgggggatctatcgaagggatgtaacttaaactttctcttacacaatgactatacagatgcatgcaggtattgctgaagtagctgcgggcaaggctcgaatgtttattaacaagcctgatggaagtaagtcttcttacaaactgagcaaatcatttctatagggatattatagaaaatgacaggaaaatcgggagtggcttctttcaggtttatcatctccagctagctgaaaatgagatgttcaacaattagttgtaattattgactaatattgtaaaattactcaagtatatatttttcttctaatctatcattcaaatcccaaggagacattaatcaaatcgttatagcttgtaatgatgtgttttgtgttttggtcttttggatgcagtggttagagaagagaggggtccgtatagtgatcctcaacatccttatttttatgaggaagaggacatgtggcaggcccctggcttcattaatcaattccatgaagtatgatggctacctttatttttatttttattttctatgtatgagcagagttcacctattttgcacattactcaacatgaaaaccaatgtttctacgattcaggttcctgattactggaaaacttatgtgcaagaagtggatcaagaaagggaaatgtggctgaactccttctataaagcaccgctaagactgccaatgcctgcagagctcgaacattggtgggacaatggtgtgcatctctcccatgaaaa

SEQ ID NO: 1191 - DNA, 866 bp, Kochia scoparia
attaatgcttgattttatcaaagattgtcatttttagcttcttattcatagcccttagggctatgtttatcattttccattttttttttatccaattgagctaatttgttgcttccatctgaattctttcttaaatagaacgtcctccggaatttgttattcttaacaaagagccagaacctgaccccaaggatccttctaagctaatttatactgaggaccctctcatacttcacacaccaactggacgtatcatcaattacattgaggatgaggaacatggtgtccgcttgttttggcaaccaccaacaagtgaaaatggaaatgttgacccaacgaaggtcgagttcttgcctctggggtttgatgaattctatggtcggggaacagtggagaagaaacagggtttttggatgcgttttgtgtgttcattggataatgctcttaaaccatggcttgagaaactagaaaaatggactgaagagcaaaagaaagaggctgaacttagaaggcaactcttacaacaggagcttgaatttgcagaagctgaattaagcttggaagaggcccttgaagacgttgaagaggcattgaaacaacaagagaaggaggcagagaagaaaatagacatggaggtcgaggaagaggatctatcagctcctctagctgctgaacaggaagagaaagcttcttttaagaaggatgtcaatgatgaagaagaagaggaagaagaagatgatgatgatggtggtggtttggctccatcaagttttgggaccgttgccgatccaaaggaaaagaaaaatggacctgggaggtctcctttctccacactttcattcgcttcatctggtttgcttgcaacg

SEQ ID NO: 1192 - DNA, 2864 bp, Kochia scoparia
  unsure (1)..(2864): unsure at all n locations
tcccaatgtagtaagagtagacaatttaaataaaatatttttatcgttttatttcatttttttaacacataattaagttactaattaaattaatatcgtaaagtgttgatttttacttaaacttaattatctaagtatacgtaattacataaaattgattcattaaatatattaagataattatacgttaatcatatttaataattttaataataataagttattagtttatttaaaattataattacaaaaactataaatataaaaagtagtgttgggaaaaaataaaaaaaggtgtttgtattatggtggggtagagggaatagtaggagagagattggtgaggaggtgtttttttaccattggtgtggaaggaaagttgtatatgaaaaaaaattgggtgggaagagaganaaagtaggagagagagtggtgaggaaggtgttttttgcccactagtgctagtggtttaagagacgagaagccccaaactggaaattttgtgagacagggaaagtaatttatttgtagaaaaataaactcccttgtctttttttatttgctacatttgttttttcacagttttcgagactcaacttcaaatcaaaatatcttgaattatgattataaaaaaattataaaaattatatatttgaaaagtagacatcgtaatgaatcaaagtagatcactcattactatattttttcttgagtatatgaaattaaatgaagttaaagtatacatgtgaatagtaataaaagtcaatatgtagcaaataatttaggacggagggagtatgaaataatttgagacgggtcaggtaaagtgcaaaggggaagagtgagtgtgtgggcttattacaaggcccaaaaatcaaaggcacaattccacgcaacaaactacgaagccacttccctcctcgagtcctcaatcctcatccatcacttcaccctccaccttatcaacaacactcgctcgctcactctcatttgagtttcattccactctcaacaatgtcagatcaaccagaagaagaagaacaacaacaaacccaggaagactcgcaacaaccagaagaatccccaaacgatgactcctcatccgaccactcctaccattccgacaactccgactcagactccgactccgactccgactcagaagaagaagaggacggagaccccaagaaacccaaggaagccccttcatacgaggagctctactaccggcgcgccggcgagttctccgacctcccaaaagacgacaactccgaagcagccaacatcgagcgcttcaaccgcgtcttccagtcgcgccgatacaagcaacagctcgagcgagaggaggagagaatccagtacattgaggacaagtacgacttcccctacgactgggagaaatggcgcgaagaggacttgaaggagctctgggctgatgctccctttgagatgtccaagcctgggtgggacccagcctgggttgacaagaatgattgggaggtcatgttagacgagctcagggaaggccgtgatcctcccattgcgcccttttatttgccgtacaggaagtgttaccctgctattcccgataatcatcatgatatttcgaatcccaagtctgttattgaggaattggatcggattgaggagtttttgaaatgggttagcttcgtttttcaagacggaagttcgtaagtttcgctttttctttgttctaatgatggttttaggggtgaaattctgggattttgggtgtttttgtgctggggtttagtggggatttatggcaatttctcactggggttgaattagattatgttgtttaaattttatgtttggaaagaagaatttgtgggaattcggggtgttcatttgggttttcggcgaatttcaagaatggtttgtaggcggtgttgaatgaacttagagtaggatttgttagtgttatgcaaaatttgaagatttaatgcttggtataaaggactgaactgaatgtcttattaaactttgatttaatctcttgttggtgttttcatggtgttctactgggattaatcttctagtttgaattgtgctctttaagattgtaaatattgcattgaagtatgggtttggaagtatcttcctctttttagtgattgcttttggttttgttgagttgtgaattatgatatataatgcatattggatttgtatcagactaatttttagcatgcaatagattaatgaacttttgtattccctctgttacgtattagttgaaacatgaaacaattgaactagggaggatttccaagtgaaatttattaattgtacaatagataagagtgtaagattaggaaaaagtaagagagagaaattgagtgaaatatgaataaagtaatgagtgggtgtgaagtcaggaaaaagtaggagagagaatgaataaagtaatgactgggtgtaagattaggaaaaagtaagagaaaaaagagtagtaggaaagtgaataaagtaggaaattttttactaaaattggaaaaaaggagaattgtttcaaggattatgtaacatccttttatgtttcaagtaaaacgtaacggagggagtatcatgaatcatgtatagtgtcctttggttattagcctaatggtatctgttttctgagtttaacaaaaccagtattgatttgggaagcatagtacttgaatcacaaatagggtgtacaagaggcaccctgcagcaaatatctaaaatctaaattgcttgttttgttgtacataaaggctttttgaagcgatttcattacagaattattgtgctcttggttactcttaattttgaggtggcttagatgtggtgcttttgttactctatatatatat

SEQ ID NO: 1193 - DNA, 2631 bp, Portulaca oleracea
acatttattcttttgcagtatatcatgattctggctttgattgtgaaaaaaagactggaaagaagtgatcaatggtgttgtcctggcaacattgatgattaaaatattttcatgattccaggttcctgattattggaaaacgtatgtgcatgaagttgatcaagaaagggaaatgtggttgaactccttctataaagcaccattaagattgccaatgcccgcagagcttgaatactggtgggagaaaggtctgattttccactaatttcagccacacagctcattatctgccgtggaagcagagtgtttttttttccttttttgttaggaggaagcagagtgtttcatcattgtatgtgacatgaacatggaaaatgaaccatgcaaaagtcagaaatagatatgcgggtgctgcagtagtgaatcaaactgcccacccctttaaaagtgaccgtataaaagtcagatatagatatgctggtggaacataatgcctttttgtagttcgttatgctaagtttttaatcatgcattaaaaatggtgatgtgtttgataaaaatgtgatggagaattccttgtgttttaagctcaatgagatcatcaatgcttaatttgtgtttgaagctttcatcaactggagcatggtagtgctatgcatattagcctattaaattgatatcattgttttattttattctgcctgtcatagtggtccttttttcccccaagattcgtaatgtgtttctattaccaataaattgtgttttcattattatgtggttgacaactaatgttcatctcctttgctgttgtaattactgcttcaacagatgccccacctgaatttattcttctaaacaaggaaccagagcctgatcctaatgatccctctaagcttgtgtattctgaagaccctgttatcctacatacaccaacgggtcgagtaataaattacattgaggatgaagaacatggagtgcgcatgttctggcaaccacctcttaaggagggagaagatgttgatccagaaaaggttgaattcctgccacttgggtttgatgaattctatggacgagaacctgtggtcaagaaggagaccttttttagccgtcttatgtcctcagtggaaaatgccttcaagccgtggcttgacaaattagaaaagtgggttgaagagcaacagaaagctagtgaaatgagaaagcagttgattcaacaggaaatggaactagtagatgctgagctggatttggaggaagccattgaagacatggaacaggagttaaaacagcaagagaaggaggctgagatgagcgttgaggtgggttcagaggaagaggatatctcaacttctcctttacctgataagaaagaggaggtggtttctccctcactagaagaaaatgtagaagaggacgaggaagaagaagaagaagaggatgattcagctccatcgagttttgggtctgttgcggatcaggcttcaatgaagaataacggaaatgggtctgggaggtctcctttctctacactttcatttgcttcatctggttttctgtcaatggtaggttctcattccctgaattctccttttgttctgatttgcttgatggaaagcaatagtaatggaacttgaacaaaaatgccaactttatgtatatcaaattaacagatgtatctgtatttgaccaaatcctgagtcttatgaattatgttacaaatcataagcagggtaattgttggagcatacaaaacaatagaatattacagatctatgggtcttatgtcgtcttagttagcaggtttagagtgatcagtgagttttctgaaggcagccaacttctggaaaagtttcgcatatgaattcaggttgactggaaattttgacatcacaagaatcagtttactgtcttgacatgagaagtgtgaatgtatgacccgtagtctcatagttatggctgtgtagtgtagtcggacatgcttcagaaaattggatgtttgtagtgtaaattgaaatgggaggtatgaggtaaataaagttaacacatggtatgatatgagggaaatggtgtttttgagatgaagtagcaatcaaagcaatggagatgcaaatagcaatacaatgcattatcaggttgagaagagagaagtgattgcaaattgtacgggtgatcatatagtaacagaatgtaagtttgggatcttaatcgcaatgtgttttggtttgcatggaatcaatgataaatgtaatctgtttcgcaatgtgtagtttgcatggaatcaatgataaatgtaacagacttcatttcttcctgcaggttccatcaatggttgaaggatcctttttgtcatggaggattggaaaatctccactcaaccccaagcttcattttccatctacaaaagcaactgattgtgctgaatgctctgattctgttgcttttcccagagcatatccagaagaaaggagcatgaaagtgaaattccatgcagataggaaatttctggtaaaacatcgaccaaagaaatttggcaattcatcccaattttcatcaccctcttcccagtctgtaaacccatctaatcaccagaaagttgttagaaaccagagggttaaatggcttcgtgca

SEQ ID NO: 1194 - DNA, 6281 bp, Portulaca oleracea
ctagatattatgctacttagaaaatctagataagtatctagatttttctcttaataatatatatttatctttctctagatttttcctaaatatttatcttataaagtgggtgatgatattttacatctaacatgctcatgatttttgactgaattttaagaatgcaatttgtagctctaataccactgttgggttttgggttatctatttcctaaacaaatatgattaacagacggaataattcataactactatgaatacaattaaacaatccaagaaacacaattgtagagactatagattaatacttgatgcgatttcggctgatgaagaggttgacatttgatatttcaaggtagaaatcctctactgtaggtccacgcaacactcagggaactcaattgctagattgttgtaattgatactaatctcaacaactatgtgtgtatgtgtttaggttaatttgatatgcttgttagacaagctaatgatgatagagtagtggaggagaattcaagaattcttaattctctcactgaaatttgcaaaagttctctctcaatgaagaggtcctagggtaccttttatgatccctttgaactgtttagcgagaaaaactatcgatgtgggacaacctcattaatcagcgtaaccgcatgggtcacaaactcacgggtgggacctctaaggtcatggtcatgacccttcattgttttgccaacttaaggcaggcgttggtcacggtcgtgatccctagggtcttggacgtgacctctaaggccacaagcgtgacccccatgatcactcacttcaaatctgattcctatgataatactatattatcgatccgggccatctcatatttttccaaggtactgacttatttgacctagtagggcgaaataatacagtctataattaaacacatttaatcactaattatagaggtctctagcaaaatatacgatcacgaaattactttagttaaaatttcaagcaattggaacattatcgtgacattcccaacagtctcggtgcctttctcttatcagtcgtcctttagtttgtaattgttatccaatttggttccatttcacaatttacaactgaccataaatcgaactaaatcgataaaatttattttcatttgtagattttacaaagtagactcattgtgtactcatgtaatacacaaactagtgttgaatatctgtgacgccctcaaaattataaatgtagataaccatacaagttcaatttaattaagtaatgaatgatctaaactaggcgttactattgtacctctaaaaagatacaagacaaatttacatataataagttcaatgaaaataaagaaaacacaagacatctcaaaactcaaaataaagtttaatcctcatgcaactatgcatttactcttgtcctaaactcaacttgaacattatgacggcctcaccacttgaacctcagtccgttcaatatcaataatacctaaaaataagacatttaagaaaggcatgatggatgtcaataatgtctgtgtcctatatcacttccttttgatgcctctgagaatgtaccaagtttaaagatggatatttttgtgacatcttcatggaataattttttcttagtatattttcaaatatttaaacgaaatgtaggcagataatattgggttagaaacaaagttgccgtccgtattcagcaggcctttattcattgggctggtctttccgattccataaagaacgtaaggaagtggcagaaacgggcaggcccacaattgaaaacttgaatccttgtactctctttcacactccactccagtctccagtgcatcatcttatcggctcattttactttcacaggtctatcttgaaaagaacccctccgttttccccctcaccaagttccacaatggcgtccgaggagcaggacaaccaacaatccccaaccgccgaagaagagctcgaaaatgaacagaaaaacccagatgaagaaacctccccctcctccgactccgactctgagtctgagtctgactcggactacgactctgacgagtcttccgagtccgaatcagaagagcccaaggagaagaagaaagtggacaagtactacactcgacctggtgaattcgaagacatcccagaggacgacaactcccctgaagcaaatgtcaaacgtttcgccagagtcctacagtctcgcaggctccgccgagctcaggaggttgaggacagggagtatgtctaccatgaagacttgtttgattttcccaaggataaggagaattggagggaggaggatttgaaggagttgtgggctgacgctccattggccatgactaagcctggctgggaccctgcttgggctgatgatgatgactgggaaattgttgctgatgaagttaaggctggaagagacccacctattgctcctttttatttgccttataggaagtattaccctgctattcccgacaatcattacgatatttccaaccctaaagccgttattgaggagttggatagaattgaggagtttctcagatgggttagctatgttttccctgatggcagttcgtaagtacttcacttgtttacttcttttcccctttctttttgctctattatctggccccgcttctgctcttcatgcttgtttcaaggctgtgatggtggaggggcttgttatgcaacttggccattttttctgtctgtttcaaaatgtgtgtatggattttatgtgatttttagttccattggtttgaatgtggtgttgatccttgattcctgttggcagatgtgaataatcccaccttggaggctttttttgttgtctatttttaaatgtggactgtttgtgctatgcatggttccttcttttagataatgtatggtttgtggtttgtgaagcttagtggccatagtgattgtgactgaggtatataatgagagttgcggggtctattagacgtgtgagctatgacattccctgcgggtgctcaatttggtggtttctgtggtctgacatagaatttttgctccttcatttgttttgtgggtttgatcatctgtctctttggtttcaggttagacagttgtttatagcggtgtgtgtgatacttcttttctcttggtttctgtgttggaaatgctagccaaatcaatgttaactactgtatgttactatgttctggtatgaacaaggagatttgaggagagggaaatagagctgacatacaaggggaaggggattgtttttccttggtttggatgtcctagtagaagggatcgggagtgttatgagatgagtgattagatttttctgaaattgatactgaatagggagactcagacaaggggaagaaaaggtgacggagtgaaggataaggatttgcattgaaggtcctaagtttactttcgcttgcactcccttgaggcaaagcacattttggtaatttgaacaatcagaggtggaagttttccttttctcctgttgtcgtttcaatagacatggctaaaaggggttcaaacccttttccctcctgtatacttaccctggattcgtaatacaaaagttttgcatgtttgccatgtgaatgagtttctaagagtgttcaacattttagttccttaaggatgtggattttccgcaacaaagcgattaatttcacaattttagtgaattcagcgattgtgcattctgactttgctctgatgatgctaagctaaagtaagggcctaatcttgggcgtatacctttgctttagcacttacatgcaactcgagtgagtctagcaacagttgaatgtgccctatcccaaggctcctagccctctgttttgtacttcagaatattggtcttggtcctatatcctatccttggataagttggcaacatgctagaatgctgcttccctgtcttggcggctttatgtttctaatgatgcttcgcaaatgctcctttcttttgtgcactttgtgtatgacaactgtgtgtctttaccaatagaataattaaatgtgcaacctactctcttacatagtataacttggctttgggtttgtcttttgctgagaatttggttgcctaaatttgtgattgttctaggaagttgtttcccatgcatattagcaagcatgtatattaccaagcgatgttttttcagatcaaggtagtggtatcaatgacattgatctgcattacttctggtaatgttcaagggccaagtgtaattttactatcacgcgtaggaatcaagtggcaactagatgtgaaaatccgacttgatgcatcttatattttacgaatgctatgctaggcaatggtgttctaatttaccgatctaattaggtatgaaggtactgtttgggatgacttagctcatggtaaaggagtttatgttgccgaacaaggtctactcaggtcagtacattgcaagtttccttttctgtatgacactgtgtagtcagggaaggcgtttccgttaattagggactttcttttagtataattttgatctgcctgttgtaggtatgagggagaatggcttcagaacaacatggagggtcatggagttgttgaagttgagatacctgatattgaacctatcccaggttccaagtatgtctaaacttcttaagaagcctaaatgatgtaatttatacagtagatcttttgggtctcgaacccccatcctgatccattgaggtgtctattagacttgaagcacagatgcgtgctgaagggaagatcattaaaagagatttcatgagccctgaggacaaggaatggatggagatggatatagaagacactgttcagcttgttgatgggagatatgaaactccgtggtatgagaacgacgaatggatcagacaatatggaaaaaaaccgtaagtgtttaagttaaagctggcacttgcgcattagtttcttttgttctttactctaattgcttccatttccatgcaatgatttgtagagcgtaatgggtgctccttgaaaattcccccaatcgcatgttaagttactttggactctttcttttcacctttggtacccatatcggttagttttccttctagattgggatccttgatctataatctcatctcatttaagatggagacacctgacatgtttgtcatagagggatacatgtttggctatttgttgattcatgactaaggagcacttgcaattagttaccgcttactagttagccctcagttgcaacgtgtaaaattttggagaagttgggtaatgtgtaacatgagcatttgttacgtagtaaaaatttcaaattttgcatgtttcccaatattttgctaaccaatatttactctatctctcaaaagaacacaagtttaaatccacaatacggtgaaaaggatatgacagatagccgccctctttaatttctgctcttacattcttagctacatttctagtctttagtattagtacgctttgattattcttttttactttactcagtatatgctgtcttcctcagggaagtagggcggtaccgttatgctggtcagtggaagcatagcagaatgcatggttgtggtgtgtatgaagtgaacgagaggcccatctatgtatgtacatcaaaagattctagcattctactgcctgctgaattattttaaagcaattgttggacgcgttgaactatttatcataacttcataagtcttttatgcacactatcttaaggagccgttatgctcaaacctaagcttctattttcatgctcaagcttcagtctgatatttacttagcattcctagttcttgtggttgtgaagggccgcttctactttggtgagcttgtggaggatcctgatgggtgtgatgaagatgcttgtgcggtacttccattttaataacatcatcatttgtctttggagcaattttggaggctttaatagggatattacacttacataatgatttatgtagttgcatgcaggtatagctgaagttgctgctgccaaggctcgaatgttcattaacaagcctgatggaagtgagtcctttcttcttatgccaaataaaaaactagactggaaaattaagatagcatgtttctgtttttcatgccattttgggaatcaattaccacttgcaatgaaaagtgaaaatcctaaaagtgagtgatgaaccagatacatggagtaagattcccttgctatcaggctttaatgcatttactgttgtgttttatttatttattgactgtagtggtgagggaagaaaggg

SEQ ID NO: 1195 - DNA, 425 bp, Portulaca oleracea
ctgtagtggtgagggaagaaaggggcccatatggtgatcctcaacatccctatttttacgaggaagaggatgtttggcaggctccaggtttcatcaaccagttttatgaagtaagacacatttattcttttgcagtatatcttgattctggctttgattgagaaaaaaagactggaaagaagtgatcaatgctgttgtcctgggcctcctggcaacattgatgattataatattttcatgattccaggttcctgattattggaaaacatatgtgcatgaagttgatcaagaaagggaaatgtggttgaactccttctataaagcaccattaagattgccaatgcctgcagagcttgaatactggtgggagaaaggtctgatttcccactaatttcagccacagttcattatctgcttcacatgga

SEQ ID NO: 1196 - DNA, 2704 bp, Senna obtusifolia
ggaagtgtcgctgactctacttgcttgcactctcacaccttatcttcttcatcctcacttcagctgccactgccatcccccccggaaaatggcaaacggagattccgccaataatggcactgattcacagcaagaacaagtcaagagaaatgaccagcaacaagaccctaatgcctcttctgaagattccgactccgactccgagtcggaatcatcgtatgaatcttcctacgacggagagtatgaaggaggagatgaagttcgcgacggtctggcttaccggcggaccccagaggaactggcccaattgcagaacactcctgaggcgaacttcgagctgttctccgaagtcctcgatagcaaacgcttaaagaggatacaggaagaacgggaccaagagattttggaagaggatgaccctttcgattttcccaaagacccggagaattggagggaacaagatttgggggagttctgggcggatggtcctttggaaattgagggtactggttgggacccggtttgggccgatgaggatgaatgggagtacgtgcaggatgagattgctgctggaagaaaaccacccattgcgccattttatgtgccctttcggaagtataatccctcaatacccgataaccattttgaccttcgaaagcccaaggcggtaattgaagaattggacaggattgaggaattcctccgatgggtcagctacattttccctgatggcagctcgtatgagggcactgtttgggatgacaatgcccatggaaaaggtgtttatgtttctccacaggaactggtcaggtatgaaggtgaatggcttcaaaacgacatggagggtcatggtgtagttgaagttgatatacctgatatagaacctgtacctggttccaagcttgaagcaaagatgcgtgctgaagggaagataatatcaagggattttatgtcccctgaagacagagaatggcttgagatggatattgaagatagttataatcttgctgatgggacctacgaaattcctttctatgagaatgatgagtgggttaaacaatttggaagaaaaccggagaaaggtcgatatcgttatgctggtcagtggaagcatgggagaatgcatggatgtggtgtatatgaagttaatgagcgtaccatatatggtagattctactttggagaattgctggatgacaccgatggctgcgatgatgaaacttcagcgctgcacgctggtatagcagaagttgctgctgcaaaggctcgcatgtttgttaacaagcctgatggaatggttagagaagagagaggtccatatagtgatcctcagcatccctacttttatgaagaagaggatgtgtggatggcaccgggcttcatcaaccaattctatgaagtccctgattactggaagacatatgtgcatgaagtagatcaggaaagggaaatgtggttgaactctttctataaggctccacttaggatacccatgcctgctgaacttgagtactggtggtcaaaatatgagactcctgaatttgtcctcgttaacaaggaaccagagcctgatcctgaagatccatcgaagcttatatatactgaggatcccctcatcctccacacgccaactggacatctaatcaattatgttgaggatgaggaaaatgggatacgtttattttggcaaccacctttaaaaaaggatgaggatgtggacccagagaaggctcacttcctaccccttggtttagatgagttttttggaagagaaaaacagggcgaaaatgatggaatgttgatgcgtcttgtactttctgtggaaaatgcattcaagccactatttaataaactagagaaatggactgaagagcagaagacaaatagtgaaatgaaaaagaaaggattggagaaagaacttgaactggttgaagctgagttgcgtctagaagaggcagttgcagatttagatgagttgttgaggagaagagagaaagaagaggaagaaaaggtagagatgggtttgccagaagaagatacggcttctgtaaccaataaagatgaagaagctcctttagcagaggaggaagtggaagtggaagaaggagaggaagaggaagaggatgaagaagatgaggatgacaatgcacaatcaagtttcgggtccattgagcaggaacaaacaacagatcggccaaaggataacaaacctgggaaatcaccattttctacatcttcgctttcttttgcatccagtagccttgtttctggggttccattcaagttacaaaatcccttttccttgttgaagaaggataaatcaaaatcagagttggttgctcccttgcgcattgacagcttcagtgatctaaaaacagttcattttcgtcaagtgattggccagaagggcagcctgaaggccgttggtcaaatacaagggagagtcaaggcaagaagccattcaaatggtaaatcttttcaggtttgttctttgtctagggctcaatgccgttcactgggatccacaaattccaaaagcatcttaaaagaggcaagaacgaaaggagacatatggttgcatgcagcaccagacagggatttagacagcatattgtctttgcatacaccattgtataatttgaagcatatagagacaccgtgtgttgatcctgcccctttggatctaaatatccatggacaggtt

SEQ ID NO: 1197 - DNA, 15242 bp, Spirodela polyrrhiza
  unsure (1)..(15242): unsure at all n locations
ggacgggtatatgtagagagcaggagacggacgtacagggaagggggtgcactggttcgagaccggcgagtatgggttccgagaggggtagccaatgccaatgccaatgccaatgccaatgccaatgagggatggatagaagatggaggggactggcggcgaggggggaggagcggcggagacgccggaggaagaaagtggcaggatagcgccgacactggcacatgtgggcgcggagaagcacatgcacatgtacatggaccggtgaaacaagagggaagaggaggggagacggcgtcaagaaagggtggggccgacagctgcagacgacattgattccgaaagttgcaaccccccccctcccgaagctactgtttgttcgggcttccgcgtcttttaccacggcggcacgagaacgggtggggtagtgaacggaggagaggactcggcggtgtcggcggaggggagggtgaatcggggaggaaggatgggctgtggttccgtgtgtcggcaaacagaggaggcgcggtgacagctagtaagctgtagagggctcataatgcgccgtctcctactgctgggtgaatcgaccaacgacggaagacggcagggcagcggggagggccagcggcacaggcgtgagaggaggcccctcgccgcgtgtccccgatcggaccgcattgaatagacaggagagagagaggagaggggggttgcggaggcggtgactgaccatacttccaccgggcctggacgagagccacgtcggggttgagcgcgaggaaggggatggtgcgccagaggaagtcgggctccggccggaagtcggcgtcaaagatggccacatagtcgcagcccttggcgtagtcctgctccatcccatccttgagcgcccccgccttgtacccgttgcggttgtcccgattctcgtacctgatgtttatccccttgctcgcccacctctggcactccacctccactaagctctgcagcgccaccacggttcttcgaggtcagctctccctacggccccccactggcggcgccgccgggggcctgatgggttgttgttgggagagggtgcttacctggatgacggggtcggtggagtcgtcgaggacctggatgacgatgcgatctgacggccaggacagcccgcacgcggccccaatggagaacttgtacacttccctctcgttgtacataggaatctggacgaggaccatggggtaggccgcattgcccagctccacgtcgtcccggatgggctcccatctgtattgcctctctgggcgccggcggaggagcttgattaccagcagggcgacgcccatgtagaccctctccacgaacaacatcagcgccatggccaggcacaccaccactgccaccttaagcaggggcacgatcaccggcgtgcgcaccagctcccacacgagcccaatctgcccggccacgtcgtcgcgcgccgcccagtcctccggcagcaggctcgtcgacgagacgctctccattctgaacgcaacccttcacgcccacagccgcacgcttaccggatgggacgcaggcagcaagacggagaccctacgcgctcatcttgcaactgggggcagagggcagcggttggagacggccgggcattggagcgtgctagatctgcgataaaagcggagctctgctctcctttacttcttggattctctccccccctctctctcctctcgctgtgtggaaccgtaccagcgccagtggaatccctggaagatcgaacttcaagctatctacatgcaaggaaaaagcatcaagacccgtgaaactgaagcatcgagtggcgagggattgacgaccggaggctcccctggaggagtcatcgtgctaactcacctttgctttgctgaacggcgaagccagcggaggacaggaacaaaggcaatggcagcaggccggaggccgggagaaaaggaaatggaggcagaggagaaagaggtggccgtcaaatgataagcggtacccctttgccgatgaagcggatcgtcggaaggcccctcggcggagggatggggaaggtaggaagaagtcctgataggctctctccttccctgtgtctctcccgccaccccccacgctctctcacacccaccctgccgccgctcagccgcttaagtagtgggagcaggagtggttaagcaaacactgagaaggaagggagagggaaggtgagaagggggaggccaagcgcgcggggcccaagctgagagaagagcattaaaaaccgggggatcggactgcaggaggaaatcaaccaaagaaagctgaccgagaaaacaacattattggtacggggaaggaggaggacgagcgacaagcgaaggggagaaaatggtggtaatagagcccgccggctacttgcccgagcggaataagtgcggcgactgatgccggcgacgaccgccgtctggatctaagtccatgcccgattatttattccccccttccctcccccgcccggtctgaccggcgcttgtttggacgacgtcgagcccatgagggcggggctagagagagagagagagagagagatgccaacgtggaagcctgggagggtctgcccccgcagctctttggggtaaacaaacacagaagcttgacggcggaatctcaccatgggttgacaaactgctgtcggtgccgtcggtcgcctctctcgagaccacacgatcgtccgatcaaatcgaacccgcatcacgtggcctccgaatcgatacgaaacacagctcgtggatgaatcggccgccggcgccaactggccgacgttatttcccatgtgtctgtgttgtcgtgtgcactcctctccctccacctgctcccctctttctctctcttcttcttcttcttcttcttcttcttcttcctgaaggaagcagcgtcggcgggctgtcgacaagtagctgttgagaggaggggccacagcgggcagctgagttccgaaagcacggtagtgatttcagccattagcgctccccccctggcatcgcagtcggtgcaggccctgggggttcgacgggtctgaaccccaccaccccctaccccctcttctttcgacgatcaatcagtgcgatatgtgagactcgggccgttcccggttggttggcctctgatagcacacctgtcacaacgtaggcggcggcgggggatcaccgacgcaactcgcatctgcagcgagaacggagctcctgtcccggcaatcccagggtcgccgccctagaggcgtagcgggcgctcgctcggagacttgccaagagctcgcccccttggccgggggtggccgacgtcgagggagacgaactcaacccctcctccctgggcccctcgcccgaaggggtcgccctcattcccccgcgctcgcaccacgcgctcggtctccccctagcgatacaagccgtccatttctaggcgagggtgtttgactttttcacgttgaatattttcacgtcgtttccaacatcagtacatctgtacgaaaaactgcaagggcggcgacacagagagagagagagagagagagaggagagataacccatggcacttttatcggctggcctccatcaacagcaatctttaagtacgaaaatatcgaccctcacctgctgcaggggctagagtcaacgtgggctcgctcaactctgacgcttgctatctgcctatacaatgccgaggtccaacgaccgtcggaacggagcacgtggaggctcagccggcgtgccatccatcgaatgcgagatgcgagagcgggcggactccccgggcggcggaggagacggtcgcgtgcgcggccacgtgcagtatgccgctcatgaccgggtatgtaggtctccgagccagtagggcgcgggcaccaaccaatcgggcctggaaataattcgcacaggagacggcgtggcagctccgccggcgtacgccgccctcgcggacacgcgtcggaggtggctcgcagcaggctctctcgaacgacggaacgacaccttgtaagacccgttgaaaattcaactatgagagacaaaattgcccggagatgacccaccaaaatagaaagcagactctttcttcgtcttctacgaccccgactcgatttgacagtcgacgactgcccactacgacgaacttgacttgcccacctctccgccaattccgcgcggcgtcacccgagccgcagctctccaaaatgcacgggccattgcgcagctcttctcactggggtgggtgtttggcgagggtgtgggatcttagtgcattctcatctttgaatgtcctgcacgcgccaggggaaaagatttcgtcagatacaaaagaagaaataaatgggcactgcatatccagcacagccgtagggagagttacttagggcatgaccggcaggccactgagccacctgattttggcgtctgttgcttggatttgtcgctggttgcaggagtcttcccggcctgttttgtggggtacggggtagcggtatggccaccctttttcccgtcggggccgccacctagggggcattaacaaatgtttggacatcacgcacaggaaaaagtccttcacactaacccgctatgtcctatgtaaataaataaataaataaaacatcttccagaacacgtatatctgagcaagtaagcatacagaaaagcgaatgtgagttgactggtacgaatcatgcaccgttgcaacataaaggatcgactatttcatgatccagtgatgatcacctgtcttctgactactattcggagcaaccagttttgctttcttgtcgtggataggtgtctttgaagcagattcagcaggtcgttttttgttgtccgcctaaaaaacaaggcattaaattcaatattttttggaaagaatagcactgtcccacttttcattctcaagatgtgagattcactttctccgacgaaacattaggagcgcagctctgccacacaaacatcagaagcggcaatgtgttaccttctttggtgtagcttcttcctcttcctcagagctgtcatcttcatcttcgtcgtcactatcgctctcaccatcaagcatgtcctgcatagaaaggatgaaatgattaaagaaatacgttatcatacgcacagcaaaacaacatgaagcccaacttttagtgtaccgacgcacctatgaaacaattgagatcttctaactaccaccaaaaaactgaatgcatttgtcgccgcaagtgacatacctcatcatcggattcatcttccgaatcatcatcatcgtcctcatcgtcatcagaatcatcttcttcaactgctttcttcagctccgaagctttggcatctgctttagatggcaaggactcgttcttcgtaacatttgcttttggctttgctggttcatccttggagtctgtgtcaacaaatagatcctccaattctgaatgttaaaatgcactaggtgggactaataattgaatataagatcacatatcaggatttaatatccaaaataaagaaagagatcgatcgtctcaaaccaacaccaaaaaccaagcgtcatcaaaagtacgacatacaggaacctagggcaatacaagaagtacaccgtaaaaaataacgttcaatgcagcacaactagtttatgaatatagcaatccaagccaattacatgggtgcagtttcataagaatgctaacctttggattccttcttaactggagaatcttcatattcgaattcagaatcagtgccatctgtagttatccatgaaggcagatccgttaaactgaaggcaacgtgtgtcattagaatgtagatgactagatagcacatggaagctcacctgagaaatcgtcagacgtgaattacaggaaaaacaggcaggatatatgtcaaggaagcaacttaaggccgataaacttaataatcgcagtaaaacattataaattgatgatatagaggatatccttcagatgctactttgtagccaacaaaaaagacactcccattcttccagctgtgggacagctcaaatcctttttcgaagacgaggtcataagatatttggggacacttgtcagcagataacgtcccaattacaagctttttgtcatcaaatttaacatagattgttgcactttcatttgctttgttatccttcttcccttccccaagggttgcctgcgtcaacaacatcaaggttagatatcacgaaaacggaggctaacaaatgagtaccaactaaatcaagaaccagtatagtaacctgtgagagatgcaagtacttattatcaccagcctcgtatctgacagtctctccaggtttgacttcagtacctgaacatcagaaaatagaaagtaaattctacgtacttcaatactagaacaaatttacacaaaaaaaagacaattatacggcgacaaatgcaaggaaataaaaaattagtgttcttgttagacgtcaaaggaagatattttttgtcaatttatttaagaagcaaaaagtgactttatatccgccatttgtttacctttggaagcttatgttgaaaaaaatctagacagataatccaatgcagaagatgaatatttgttgcagaaaaagatcaacataaaacaaggagcagaaaaaaatttgggtactcacgttttagtgccaattaagtgaacgagggaaagagtaccttgcgccaatacggggtccaatggagtttaaatattatggtaatgcaccgtggaatacttccgtggatgcaattcttatatgattataggacagcaaataaaccatatgctcgtagtggcgaccagggtcatacgacaacatttgcgcataaaataaaagaatgtttggtttaagacgatagccaacgattagatacacatagatagatagatctttactgatgccaaacgagaacatttaagcaggtgtggttacatatagggttcgacataacgacatagaaaatgataggttttgagcgtcctgtacaaaagtaataaagaatgtacaaaggctaaggccacaacattttgggattatccttttagacggaaagaatgcactaggaaaaaacgaggaaatatgattaagacagccataaacacttgccagtaagaagacgaaatcggagatacaagcaaagaaaggacatctaaagtcaggagggaacaagactgatcgaaaatctccaaatcttatccactgacaataaactaggagtttccacggtatggaggaagaaaattttcacgaggctacagacacgcacataaatcattgaaaaataagtacggagtgatactgaacatcaaatgatgaacaaaggcgtcgtcacattgcgcgaatattcactggcgtgataagactgacagccgggagtacaaaaccctaagacagaaaaagagacgatccacaaatagcaccacacggggaaaggaagaagagggagtacgctcaccccagaactccatttgcagacgcgatcgacgaccacgagatcgatgggaggtgaatgaaggaggcggatgctccgggaggtatggaacgaagacgaatgcaaaagggcgggattagggttttgggaagtcggtcctcggttttttaagtaggtcacggaagaggcggcttgggtgcgtctcgcgtggcgtggaccccacgacagtcggctgcagcggagtagccgacgcatggccagcgtgggtgtcaactcggacgagagatctctttaacgggccacctattagttggcccattaagatgatgcgggccccaacgccgcatcactccctccctgcccccgccccagccctccctctctctctctctctctctctacacccttttctgttctgttctgttctttccattcctctcgcttctcccccggccatcttatccgcagtctcgctccccgctgctcgcctctccgtcggccccgaaatggcggcagaagccgactcgaaagggaacgccgagcccgaggagatggcagcccccaagccgacctctgccgactccgactcggaggaggaaggcctggagcgaaagggcgatggggaggaagaagaggaggaggacgaggacgacgagtccgactcggactacgactcggactactcggatggagccttcggcggcggtcccgagggtgaaggtggcgagaagaagggcgaggactcgcgcgaggcgaccgtccgccagttcgccgaagtcctggagagcaagtccgtgcagaagcgcttcgaggaggaggagaaggagtacgtctaccacgaggacgtcttcgacttcccccgcgacccggagcgctggcgcgaggaggacctcctagagctttgggccgacgcccccgtggacatgaccaagcccggttgggaccccatatgggctgacgacgaggactgggaagtagtgcaggaggagagaaaggccggaagggatccccccatcgccccattctacgtaccataccgcaaacactttccggccatccccgacaatcaccacgacatctcaaatcccaagtctgtcatcgaagagcttgaccggatcgaggagttccttaagtgggtcagctatatattccccgatggcagctcgtgagtgttctcctctcttcctcatgcttcttcgtgttcttcagtttcatagcattgtcgtcttaattaataggagagacattccgcttccttattatcccccatcatggtcacggctgtaattatgcgtgcattgccttgccggaattcagttcattggatactagcggcatttttcgccgtcgtcttgtttaatttgctatggttttccttctttcgttggttaccggttgtgccagcttggatgactgaggctggcaggtcatttgaatgaatgctctgacatgggaaacccgaatgttcaatagcattcccatttaatgttgactccaaatttgtggactgaatctttctgcttttgtgttctctattagactgatttcacgctcattcttgtagtgtttagatgcctgcattttgaataaacattgtttgtatactcccacgattttggttgtattttaccgtatcagatatcattttaagtattgcgaacatgaaaacaagtctatgctatttaaaaagaatgctcagaccctgcttgctccatcattaaaaattttttttatgaatttcccatttgaaatcgatgcatttataggtgctcggattttttttacataaattgagttgaggttcactaacggatcttgctgcttcttttctgaagatacgaaggtacagtttgggatgacttggcccatggaaaaggtgtttacgtggctgcacagggtcttgtcaggtcagtaccttttgtgaacaaattatctgactgttttactgtcctttttcaataaactttcttgactcgtttaaattttctggtttagttctttgcttttcgaaatgtagagtaaaaatctaaatattcatcaaccacgaaaatatggcatacacctacgtttataccttcaaactcattgatattaacaggcgcggttatgtgcttatcacctttatcagccatatattcctttcactttatgcaattccttggctccatctccatgacttgatgctcgatgctccggtatcctgtaccctcccggcataccaaatattcctctagtgctacgggtgctgcaaatctattcattcagatcgattttctgatgtcaaaactagcaactcatatatttgatggtttgcccaggatcttgctttcatgacactcatataatctggggattccattttctctgttggacctttgatatcgaatttcgtgacaatttggattaaagatctaatctggcacataacatgagcctttttctgttctcttaatattttggtttttgtctcaagtagtctcaacatctattacttcagattcaattttcttactgtttatgaaaacagtatccacacttcatggcaggcgtccaatcggttttttttgtgtaaacgatagggacaattggtaatgaaaaatgaaaaattaggaaatctaaatgaattctatctttttacagtgtatgaacgtctctttgaagtgcaatgctgaactcatggatacaatcatttttcttatttgatttttgttgtccgatgactgtgttcacattagtaccagtgtcttagtaattgatgtaaacttgtaatttcacgaaaagttacaattaccgttgttttcctttttgtcaataattgattatatttcctggttataggtatgaaggggaatggcttcagaatgcaatggaaggtcatggtgttgtcgaagttgagattccttctgtagaacctgtacctggttccaggtgtgtagcaaaccggcaaaacttgtaaaatgaatcctcggatatctcattgttccctttcctattttctcaacaacttgcaatttgattgccatcgttttgtaggcttgaagctaaaatgcgggctgaagggaaaatcattgctagagactttatgtctccagaggacaaaaaatggatggaaatggacattgaagacagtgttgccttggccggtaaccgtgttgaggttccattttacgaaaaggatgaatgggttaagctatttgggagtaaaccgtatgtttttacattcgtcaatgatcttcatgcacaatttttgtgtgtacctgcatactagtaataccattctcgtgtcaaaaaaaaaagcgcactgcctttttaattgttcatatgatatatttcttaaacaatttcaactttcatgagtcgtggattgaactttagggcatatgttctctctatgaataatttaactgtggtctatctgtaatatctaaaaaccgaagtgaaacacaggactatccagctcaagtttggatacatgtttgacctgttttttcaatgaacgcatgtttgttttgcatcacagaatcgttagattggttattttgcatggaacatactaagacaatgatactccatgcccaagcagtcgtgctatggaaacttaaccttctttttcatcaaataagcttcagtcgccattcataatcaatggctgttatccttgaaatctttagaaaattctgggtcttctttgctaacaatgaactgtattaatttttctttctgagtgaaattaactctaccctctcttagcttgttctgttttttgtgattgtcttctactcatccacaagtaatctattttccaaacagggagaaaggtcggtacaaatatgctgggcaatggaagcatggaaggatgcatggatgcggtgtatatgaagtgaacgagcaaatcatttatgtaattatcgatttgttctctccttcatttacattcccttttatttgtgtcctatttgctcttctcagaactattgttgttggtctggttgccaagggttttctgcaatggtgaagtagccttggaggtccctcatagcatagagtttattcccttcagtgatctgaccagcatgtcaaaaagttctggtctaagattggcaatgccacgtataatgcagggaagattttactttggggactacttagatgattcgactggttgtgatgcagacatctcagcggtatatgacttccacttctgtcacttttttgtcatttgatgaaaatttatgaacagatgtgttatttcagcttcatgcaggcattgcggaggtagctgctgcaaaggcaaggatgtttgtaaacaaacctgatggcagtatgccctcttgctttgcctattttattttggaaaattgtgaaccatgcaatcgctgaactggcttccttaagatgacgaaattgtatgatatattttttgcgcactgaaatccgttagatcagttcttttcagctgggcaagacctgacatcaagacatctatacagggaatattataatgacacagactgtacattggtttcaaagaagtcagaaatcaatctggatccggctttggatcagccagactaatcttcccctttgatgaatgacatcttggtcactagatctcggagagctattttttgttagatcacgactagaaaagtggagcgacgttgtcaatgaaacattagaatcggagcgtgccagtccattgtgtatcatttcctgttttggttatccaagatttcacttttttgcagttattcgttcctttggtgttggcaaggagcaaattatatcatgtgacaagatttctttccgtacctagtgatgctttcgatcttgagatctgtttgcttttttttttcttcatttttttaaaacaggtatcaaacgttatatttgatggttggattgtcttccgtctacttgtgacaaggttattttcgcgtctaggtatttgtgcctattctaaatgaaatattaagattctggatgggttggtgaaggtcatgtaggattcttaacgaggaaccgcaatcttattttaaccattcaagacgagaatttgttggcagcctggtcaaaacatggtgttacagatagttagttaaaatgaaatattagtttgcgcccctacagagacttggcacgtcagtttccatcaattgtgagagtcgttatgtgacttttcatttactatatttccttgtctatttttgcgtactggcaactgaaatacttgtgctcagtcttgatttataatttcagctacaatcatccacatgattgccatatgaagcgtatgtatgtttttatgctggtagtgatcccatatctatactgcatatgtctaaattttcttctttcgtatgtcttaatcaagagtatagcttaactttgtaatttttgtatggtcataacctttctccaagctcctcattgtccgttatttctaacttgcagtggtaagggaagacagaggtccatatggtgaccctcagcatccatacttttatgagcaagatgatgtgtggatggctcccggattcattaatcaattttatgaagtaaggtttcttctgtggctttcatgagtaggaaaaatattacgttcttgaggaaaccatgataactgtttcctctcaggttcctgattactggaaaacatatgttcaagaggttgatacagagagggaaatgtggttaaattcattctacaagtcaccactgagaatccctatgcctgcagagcttgaatattggtggtcaaaaggtatgccttttatctatgacccagttttttttgctcatatccttcctgtcatggatctcattagcaatttaattttaattttcgatcgagctctgcgggttgtgtgcatgaaagttctaaacatattagatagttttcctcttaggttcaaacatcttccggaaaagttgttcatctgtgcatagcgtgggataggtggttgtcatctttgttgcaatacagattaacgcatgcagacgtcaccattacttcttagatgtgttaatagatctgtggtatgactaagtcaaggaaaatttttaaataggatgcttgggattattctcattggtccatctttgcggtctgctcccctgccattcctgagcagctgagacctcatgaaagctattatctgctaaagatttatatcgagaacaaggaatcaaccacaaatgggtgtatttgcgaagtgaatccatagaagaagcttggcagacatttgtagtccaactgaattctttgcatttataggatacttgtattgcttctcagatgtgttaataggtacatggtatgatactgttcgtcatacaacggaatagtggttaaaatccattcgaacaatctctcggtaggagagaaaaaaacttcaaacataggtcgttccaacaacctctctctctctctctnnctctctctctctgtctctgtgtagcgcattttacacaccttcccatgttttctcattacaccattgttcacgttctatccccttgcaaaagttatgcgcctcagatttgcatctctgcttattctgcagaagaaagcccggagtttgttctcattaacaaggaacctgagcctgacccagaagatccgtccaagctcatatatacggaggaccccttgattcttcacacccgaagtggaagactgatcaactatattgaagacgaggaccacggtgttcgacttttctggcagccaccattgaaggacggggaggaggtggacccagaaaaggtggagtttttaccgcttggtcttgaagagttctatgggcgagccgtgccacgcccaaagaggcagagcgggttgatgcgcttcgtgggtgctctagaaaatggattcaagccactatccgacagactggagaagtgggctgaggagaggaggaagaaaactgaattggatctcaagctgatagaccaagagctcgagtttattgaggctgagatctgtcttgaagaggccatcgaggatatggaactggaattgaagatgaagcaggaagaggaggagaagagagaagatgacagttcatccacttcggctgctgggagtgcggctgaattagacgagggagaagaagaggaagaggaggaggaggacaatgcaccatctagctttggcacggtttctggagaaacggcggacagcaagccaaggaagaacggtttttcttctctctccttgtccctcccctcggtgtcagtggtgagttctttgcgttcccttcgccctttccgacatcgcctgccgtgtccagcatctattaccaggcatccttgaaaccctgatttacattttgtaggtcccgccgaagcttctgcagtcattctccttgtggaagaagaatgtccgaccaccgccggcggcgaccgaggttcactccggccacgttttcgtggccgcgtctgtttccgcctcaccagtgtcggtcagatttcctccccaaccccggccctcgagcctgagggcggcggcggcggggggcctcaggtggcagggtcgctgccagcgccgccggaaggatgataagaggcactggcagctgaatgcgttggccaggatgctatcggggtccgcagaggcggctccccgctgcagaatggaggggacccagcgttgccgaggacagcaggagcaccagttcagcgtgctgtctatgcacgtccccctctcgtcttacacgcccggcggcggcgggggcggcagcggcggcggcggcggcggtggcgcttctggtggctggattctctggtgagc

SEQ ID NO: 1198 - DNA, 200 bp, Taraxacum officinale
gatattaggtcaggtaaggatccgacaattgcccccttttatgtgtatcgaaagtgttacccggctatacccgacaatcattatgataaacacacgagaaaagaccagcagaaaacaaatttcagttagccagggaaacttaatggagaagatatggttactttctatttgaggtttattttccagtatttaagataaaa

SEQ ID NO: 1199 - DNA, 787 bp, Taraxacum officinale
aaaatcaggtcccggattactggaaaatttacatggaagacgtggatgaagaacgacaaatgtggctaaactcgttctacaaagccccattaaggctaccaatgcccgctgagctggaatattggtgggaaaaaggtaataacaataacaataataataataattaatataattacacgcgtaaatttattattattataattacagacgagtctccggagtttattctccttaacaaggacccacaacccgaccctgaagatccatcaaagatgatatacaaagaagatccggttatattacatacgccaacagggcgtataataaactatgtggatgatgaagaacatgggataagattatactgggagccagaaggggaagaggaagataaggttgactttttaccacttggagatgaagaggtgtttgaaccccgcgatgaaaggagctttctacaacgtgtgctgacatcagcgcaggataagtgcaaaatgatgttggaaaacgtggagaaatggagcgaggaaaagaagaaagcgagtgagatgaagttgaagatgattgaaacggatattgagatagcggaagcggaatcggaattgaaggagattcttaaagaaatggatgatgaattgaagagattggagaaagaagaggagaagaaaatggaaatggaaatggaggtggaaaatgaagatcaagatgaagatcaagatcaaggtgataagattgagaaagttgaagaagttgaaaaggtttcgagagttgaggtgaaaaatgatga

SEQ ID NO: 1200 - DNA, 857 bp, Taraxacum officinale
caggcttgaagctaaaatgcgtgcagagggacgtatatttaaaagagacttcatgtccccagaagataaagaatggctggaaaaagacattgaagactgtgttaagttctctgaaggccaatacgagatccccttttatgaaaatgaagaatgggtcagacaatttggacagaaaccgtaagtcatgtcttatcgcttacaatatcgtatatctatatatggttataagttacaacttaagttttttaattgtagggaaaagggtcgataccgttatgctggtcaatggaaacatggaagaatgcatgggtgtggtgtttttgaacttaatgaacgcaccacttatgtaagtgaatttgaaatagtaaaatatttgaagaaattgtaactttttactgtgttttattcagggacggttttactttggagagtttttggaggaaaatcatggttgtgattctgatgtttcagcggtaacttattaatttaatttaaattttatattttcctatattcacacaccaaatattacaaataaactaatacaaaattatttcagttgcattcaggtatagcagaagtggctgcagcaaaggctcgaatgtttgttaacaaacctgatggaagtacgccatctatttcctttcatttttcaattcttttatatatatgttttttttcattcactttttttataaaattttgttattatttattacagtggtgagagaagagcggggtccatacagcgaccctcagcatccctatctttatgaaggagacgacatgtggatggcaccaggcttcattaaccagtttcatgaagtaaattgactaataaattccacttcttacat

SEQ ID NO: 1201 - DNA, 613 bp, Taraxacum officinale
tacccggctatacccgacaatcatgatgatatacacaatgcgaaaacggttatcgaagaacttgataggattgaggagtttttagaatggcatagcttcgtttttgctgatggaagcacgtaagttgcttcattaatcttgatacattacctccatttttctatcatcttcttaaacccccagtttctaggttttcgaatgttaattagaaactacaacaaattaattggaaccctaagttaccattaatgacctaggtacgaaggcactgtgtgggatgatttagcccatggcaaaggtgtttatgaagctgaacaaggactagtcaggttcgtttatgctacacatgtttaaagtttcttaacacaattcctttaaacaactcttgaactcaatcttacaaatcgctgaatcatcacagatacgaaggtgaatggctgcaaaacaatccagaaggccatggtgttcttgaagtcgacatacctacttacgaacccatcccaggttcagagtatgttcataaccccatctatcttcttacaccatacaagctcataaagctcttgaaccgactcggtgtttctatttacaggcttgaagctaaaatgcgtgc

SEQ ID NO: 1202 - DNA, 516 bp, Trifolium repens
ttgttatttttcatttatcattagacattttgtctgtgcagtggttagagaaaagagaggtccttacaatgatccacaacatgcttacttgtacgaaggagaggatgcgtggatggcgcctggcttcattaaccaattttatgaagtaaggctcaccggaaaacctttaccttaatacatagcttatttttcattttatgcaaaggaaaggaaacatgaatatgattctgttacattacaggtccctgatatctggaaaacatatgcacatgaagtagatcaagaaagagaaatgtggttgaactctttctatagatctcctcttaggatacctatgccagctgagctggaatattggtggaacaaaggtatttagagcgcgtttgttgatgttttcctttgtgtgaaagaatcacttttaaatgttttgatccagattttcaaaaaaattataatctcaaaaaaagaaaaaaaatatttaactgcttcaagaaactgttttgaggagcttctctt

SEQ ID NO: 1203 - DNA, 316 bp, Trifolium repens
gaaacttcagcggtattaaatactcttcacctttgaaaataacaacaacgatattctaagaggtgtggaaatatctcattcactgactgtcttaaattctgtcaatttcagctgcatgctggtatagctgaagttgctgctgcaaaggctcgcatgtttgtgaacaagccagatggaagtatgatgttttttcaagatgaaactttatattgaaaacctcatattcatggtttttgattttggtcattgactttcctttgtctgtttgatagatctattcattagcacatatgtactatgaattaaggagaaataa

SEQ ID NO: 1204 - DNA, 250 bp, Trifolium repens
atacattgttactggtctgaaaaaagtttatattttcacgctcagggagaaaggtcgctatcgttatgctggtcagtggaagcatgggctgatgcatggatgtggtgtatatgaagttaatgagcgtatcatatatgtaggtccatggatcagataaagtttacgtgtcaactgttaactccaaatctccaatcaacaacttccttattgcacaaaatagcatgatttgctttaactttctggaaagagt

SEQ ID NO: 1205 - DNA, 584 bp, Trifolium repens
aaactgttttgaggagcttctcttaaaatttattttttatgattgatttttttttcttaaaaagtagttttcattatggtaaacaaacataaaatagcttacgtttttcttttaaaatctctaaaaactattctccaaattattgaatttcaaaatcattttattattatctgtaacaaacaggctttaggcattagtacataaattttgtccaaaaaaaaagtacataaatggaaatgaagagtttatttttaaaaaattaatcaattcttcctccaaatccttgaccagatgagaatcacgagcgtcctgaatttgtcctcattaacgaggaagccaagcctgatcctgaagacccatcaaacctaatatattctgaggatcctctcatccttcacactccaactggaaatattatcaattatgtcgaggatgagaaacatggaatacgtatgttctggcaaccacaacctttggaaaatgacgagagcggagaaccggaaaaggtagacccagacccaaaagaggcaaagttcttaccccttggttttgatgaatattttgggatagataaaggaaaagag

SEQ ID NO: 1206 - DNA, 1643 bp, Trifolium repens
tataagtgtgaagaagtggaaaatccgagattcaaatcttgacatctccaataatattctctcatccttattttttttttctcaaaccagagaaggaaatcaatgtatcaatttctaagcaaaacttgaggcttcatctgatgttgatcttccttacttttgttttaatgaagcctcataacacatctttaccgttcgatcaaggttaaattgctcatattttaaagtcgaattatgatctaacggttcacatatattcaactataatgcattcagtcgatatcttatctttcgactaaattagactcgagagattagtctcctccacatctacacacaaaaaacactctcactactaatagcttactacaagtgtttgtatcttcatttcccgcacacaacaaacaaaccttatcttcttcttcataatcacttatcatcaacaatgtccttctttcgccgtttccaaaaacctccacaaccaccaacctccgaccaaccacctacctccgacccaaaaaatccctccgattccgactccgaatcagaagcatcatcagactcagaaccatacgatgaagccgaaatcgaagcatatctcgctgcattccgtgccgaatacaacaatgacccatacgatgactccgaattggatccagaaacaaacttcaaagacgttatggaagcatttcaatccgaaaaacctcgaaaaaggctcgaaagaaatgcacgtaaaggtgttgaacaatttaatccatttgattttcctcctgataaagagaattgggcagaagaagatttgagagagctttgggatgatgggaataattcaattactggtgctggttgggaccctgatgctgttgatgaagatgaatgggattatgtgttggatatggttgatagtggaaaagatgttcccattgctcctttttatcttccttataggaaacctatacctcctattcctgataatcattctgctattaaaagtcctatggatcttattgaagaattggataggattgaagagtttctcaaatgggttagctatatgtttgaagatggtagctcgtatgtgaaaaatattcctcttttcattttttagtaatttttggtattttttagtatatagttctttcaagcacgtatactcttcagattaggtgtgtcctggtgccgtgtcctggtgtcgggcacgatacttatgattacattgaattatgacattttctcaaattgttatcgctgtggacgtgttagtatatctgtgtcgtgtccgttatctgtgttagtgtttgtgcttcatagatatagtttatcttggttttgtttgtttggtgttgttcagtagcagctatagtgcagtggagtttaaacagattgctaggccaagtttatggtgcacaagtgtgacaagtttttcacgatgtgcaaacttgttttcaccgttggatcaataaatctcacaattgcatcaaatgacatgtgatgtgacattttgattcgatggcgagacttatgttgattaaatggtgaaaacaagtttgtgaatggtgaaagacttgtctcacttgtgcatgttagacaaaacccaaattgctattgttctgtaatatgttgtttagtatagaatgttgtca

SEQ ID NO: 1207 - DNA, 815 bp, Xanthium strumarium
cactatttaacaaaccaaaatccacactcctcttgccgctcctctacaggctacagtctacacaccttatctatcttcatcttctcctacactaccaacccagctaaccaaaaatgtcagacaacaatcccactgactccgactcatcatccgactccgaattagaaccaacatacccagaaaaacccatccaacccgaacccgaaacccccacccagtccaacaaacccaaacccaaacccaaccgactcgcccaatttgaccccaacgacctcgacgacacccccgaacgcatactacaacaaagtctgtgaaattctagaatcagaagaattcaaaaaactagaagaatcccaggaacttaatgaccttgataatatcgaagacctttacaatttcccacccgacccggaggaatggaaagaggaggatttgaaagagctgtgggcggatggtcctccgtttttaatgaaacctgggtgggaccccaactgggttgacaaggatgaggttgagattattaatgaggagattagagagggtagagatccacctattgccccgttttatgttccgtataggaaaccttacccggttattccacataatcattttgatattcgtaatgctaagtctgttattgaagagcttgataggattgaggagtttcttacgtggcatagctttgtttttgttgatggcagcacgtatgaaggtacagtgtgggatgatttggctcatgggaaaggtgtttatgaagctgagcaagggctggtcagatatgaaggtgaatggttgcagaataatccggaggg

SEQ ID NO: 1208 - DNA, 1804 bp, Abutilon theophrasti
aatcaaatatccccaaaatgacttcaatcaatttcaatcctttcgaaagctggttcaagaaacctcaaacccaatccaactcatcaactttcactcactcgccgaatcattcatccccaaatcatcctcagcctcgccaaatttcgcttccattaaatcctccaacctctttaagcaaaagcccaagaaacccgacccggattccgacaagcccgggccttacaagcagatggtggaccagttcttttgggaatgcgagaacctccccgattacaggcacacccctgaagtggataaaattttgaacgaagaaccaatttttggaaacaaggagaatccaactgaggaggagattaaagagaatgagaaatggtggaatgatttcagggcaagtccagttgttcagtttttggctagagctgaggaaattgccgatgaggtcaataaattggagcttaaagaaaatgaagagccgtttaggaaggaagataagaagctttggcaggcgattccacatgtaattgggttggatggtaggcctatgcctcgaaaagctatcaaaaccagggaagagagtgatgataagttttgggatttcactaaacagttcttctttggtctctggggattccgccaaaggccttatccaccgggtcgacccattgatgttgctcaagctatcgggtataagcggctcgagaagcgttactatgactttatcatgaggagtggaggatggtactataaagatcgcctcggccgtactcgaggtccctgtgagttaataaccctgaaaacagcttggggtggtgggattattgataagcatacctttatttggggagaggacatggatgaatgggcaccaattcatatggtttatggcttggaacctgcaatagccacttgggaagttaggctcggtgcagcagcgacggctttccttcacaaacttcagaaaggtatacctccttgggttccccttaaaggacacgaggataaaacttataagcaacttcaagaagaagctatagagagcaaaagacgtgatttggccgtcctaaaagctaatgacggcatatggccaggagttaaaattcctagccatgccctatttctttgggctagtggcgcggaaatgacatctcttttggaatctgatcatatgccgaacaaatacatttcgaaagatcttcggcgaaaattggccaaagctatccctgggttaaggccgtgggaagttttaagtgttgagcaagcaatggatgatattacgtacggtggagagtggtatcgtgaacctcttggttcctacacaaccggtcctccatacattaggaattggaatatggatgtcaagagtatcttccgaatcttttacaaccttagctcccaagtctataacaaactggaaaggacagttcctggtttcaatacaataatggagaaagtacaggttgatgctgctgcaagggaggttaaacggaaggcggaaagggaagcggaaaagaaagcctgaggctgaagccatatatggtcgaagagagaaatgatccataccataactaccacataaagaagttaaactctgattggtaaggactgatttggcttcgtgtatgttctatgtgggtaaccaaccaagtaccaacccagtcgaatttgatcatttaatcttcgaaaagagatggtttctgattcttgtgagatcgtaggcagagttttttttatgttttaaatgataaatactttccttttgtcaatgtattgatacaaatgctgattaatgaagatcttgttttag

SEQ ID NO: 1209 - DNA, 393 bp, Abutilon theophrasti
ccgggtcgacccattgatgttgctcaagctatcgggtataagcggctcgagaagcgttactatgactgtaagttcatgtattagttccgagtttaatttctatgtacattgttgttttgcctggatttgatgcaaaattgttttagaactattttgatttgtttgtcgattgtacagttatcatgaggagtggaggatggtactataaagatcgcctcggccgtactcgaggtccctgtgagttaataaccctgaaaacagcttggggtggtgggattattgataagcatacctttatttggggagaggacatggatgaatgggcaccaattcatatggtttatggcttggaacctgcaatagccacttgggaaggtttgtttattttccctt

SEQ ID NO: 1210 - DNA, 1076 bp, Abutilon theophrasti
tccatttcttagtgtagcaagattctgaattgaatcgattggcaaaattccatttcttagtgtagcaagattctgaattgatcaattggcaaaattccatttcttaggtgcaaatcgacgtaatcaacaccttcaaattctgtcagttaaatcgtttcgttttttttttctttcgattttccaaaccgagattgtgaatttttctatttacgaaatataaccaaatgatggactaaaattaacttagaattgaatcgaaccgaataccattaaatagtatctgaaccgaaattaagaaaactgaaccgaactacaataagccaatatgaactaaggaaggcccaatgattcagagtcgacacgccgaaaaacactttgaacagaaagcccaacaattgttgtgtaaaccaaaaatgcatattttgggtcagatcaaaatttaactcaaaatatttgggcctaaaccttttctaaggcccataaacatcaaagcggcttaactgactctcattcttcggaagaaaaaaacactctatcttagcaatagctctccgccatagccaattagctgagctcaacaccatttccctaagcctcaccaaaaaccctaaacctttgaatcaaatctccccaaaatgacttcaatcaatttcaatcctttcgaaagctggttcaagaaacctcaaaacccaatccaactcatcaactttcactcactcgccgaatcattcatccccaaatcatcctcagcctcgccaaatttcgcttccattaaatcctccaacctctttaagcaaaagcccaagaaacccgacccggattccgacaagcccgggccttacaagcagatggtggaccagttcttttgggaatgcgagaacctccccgattacaggcacacccctgaagtggataaaattttgaacgaagaaccaatttttggaaacaaggagaatccaactgaggaggagattaaagagaatgagaaatggtggaatgatttcagggcaagtccagttgttcagtttttggctagagctgaggaaattgccgatgaggtcaataaattggagctt

SEQ ID NO: 1211 - DNA, 369 bp, Abutilon theophrasti
ctttccttcacaaacttcagaaaggtatacctccttgggttccccttaaaggacacgaggataaaacttataagcagcttcaagaagaagctatagagagcaaaagacgtgatttggccgtcctaaaagctaatgacggcatatggccaggagttaaaattcctagccatgccctatttctttgggctagtggtgcggaaatgacatctcttttggaatttgatcatatgccgaacaaatacatttcaaaagatcttcggtattaacttctcttcttatggcctaccttatttggtttggtttttgaagataattgtacatcatattgctgaacttgcatgtcgtcttgatcatttgtcaatacttaat

SEQ ID NO: 1212 - DNA, 368 bp, Abutilon theophrasti
ctcactcgccgaatcattcatcccaaaatcatcctcagcctcgccaaatttcgcttccattaaatcctccaatctcttcaagcaaaaacccaagaaactcgaccccgattccgacaagcccgggccttacaagcagatggtggaccagttcttttgggaatgcgagaacctcctcgattacaggcacacccctgaagtggataaaattttgaacgaagacccactttttgaaaacaaggagaatccacatgtaactcctgaaagtataggaaggaagataagaagctttggcaggcgattccacatgtaattgggttggatggtaggcctatgccttgaaaagctatcaaaaccagggaagagagtga

SEQ ID NO: 1213 - DNA, 1038 bp, Amaranthus graecizans
ataataaggaaccttataggaatgaagatgctaaactttggaaagctcttcctcatgttactgggttagatggtagaccaatgcctaggaaatctataaagactaaggaagaagcagagaataggttttgggatttcaccaaacagttcttttttgggttatggggttttaggcaacgtccttatcctcctggtagaccaattgattttgctcaggttattgggtataagcgcttggagaagcggtattatgattttgcaatgaagactggtggttggtactacaaggatcggttgggccgtacaagaggaccatgtgagctgattcaacttaagaccgcatggagtgcgggtataatcgatactcatactttcatatggggagaggacatggatgaatgggcacctatagggatgatttatggtgtagaacgggcaatcgccacttgggaagttaggttgggtgcagctgcaacagcgtttctccacaagcttcagaagggaatttctccttggactccattaaaggggcatgaaaagaaaacctatgagcaactgcaacaggaggctgtagaaagtaagaagcgtgatttggctgtgctcaaagccaatgatggagtttggcctggagtaagaactccaagccatgctctctttctttgggctagtggttctgagttgacaacaatgctggaagctgatcatatgccaaacaaatacataccaaaagatctaaggaagcaattggctaaagccattcctggcttaagaccttgggaggttctaagtgttgaacaagctatggaccgaataacatataatggagaatggtatcgtgagccactcggctcatacacaactggtccgccatatataaagcactggaatgacgatgttttgaatatgctatcagtattttcagtcctgagtaaagctgtaatcaaggacatgaggcgcaaaaatcccaggatttgatcaagccatgaatatgttccgagaagatgctattgcaagagaacaaagaatcagacagcagccg

SEQ ID NO: 1214 - DNA, 615 bp, Amaranthus graecizans
cttataaactccccacaactcaggttcattaggctggtgcctttcattcctccaatcattccgaccccctctcctatctcccctcacatcatcatcatcatcaacctcatccccatccctccagcgtcgttcctctctttctcggctatccccatgcctatctactaatccagtcaattttctctctttctagtttctatacaccaactttctcacaccaccagcagaaatcccagaaactccatagctaaaacctccgacctccaatagaaatcaccaatggcgtcaatgaacttaggtccatttggtgaacactggtttcactggttcgaaagacctccacaaccaatctcattcccaaatttattttctttagctctgtctcaaaaccctcctaaacccctcttcttttccctctctctctcggacccaaaacaacccaaacccgacccttcaaaaccaggcaaataccagaaaatgatggaccaatattggtgggaatgtgagaatttacctgattatcgacacgccccagaagttgataagattttaaaagaagacccagtctttgaacacaaagaaaacccaacaccagaagaaattgaagagaacaat

SEQ ID NO: 1215 - DNA, 1083 bp, Amaranthus hybridus
ctgataatcttaataaagctgagcttcaggataataaggaaccttacaggaatgaagatgctaaactttggaaagctcttcctcatgttactgggttagatggtagaccaatgcctaggaaatctataaaaaccaaggaagaagcagagaataggttttgggatttcaccaaacagttcttttttgggttatggggttttaggcaacgtccttatcctcctggtagaccaattgattttgctcaggttattgggtataagcgcttggacaagcggtattatgattttgcaatgaagactggtggttggtactacaaggatcggttgggccgtacaagaggaccatgtgagctgattcaacttaagaccgcatggagtgcgggtataatcgatactcatactttcatatggggagaggacatggatgaatgggcacctatcggcatgatttatggtgtagaacgggcaatcgccacttgggaagttaggttgggtgcagctgcaacagcatttctccacaagcttcagaagggaatttctccttggactccattaaaggggcatgaaaagaaaacatatgaccaactgcaacaggaggctgtagaaagtaagaagcgtgatttggctgtgctcaaagccaatgatggagtttggcctggagtaagaactccaagccatgctctctttctttgggctagtggttctgagttgacaacaatgttggaagctgatcatatgccaaacaaattcataccaaaagatctaaggaagcaattggctaaagccattcctggcttaagaccttgggaggttctaagtgttgaacaagctatggaccgaataacatataatggacaatggtatcgtgagccgctcggttcatacacaactggtccgccatatataaagcactggaatgacgatgttttgaatatgctatcagtattttcagtcctaagtaaagctgtaatcaaggacatgaggcgcaaaatcccaggttttgatgaagccatgaatatgttccgagaagatgctattgcaagagaacaaagaatcagacagcagagggaagaaaagaagaggg

SEQ ID NO: 1216 - DNA, 1639 bp, Amaranthus lividus
agtaagcctatctactaatccagtcaattcccttcaatcttctctctttctagtttctatactccaaatttctcacaccaccagcagaaatcccagaaactccatagctaaaacctccgacctccaatagaacccaccaatggcgtcaatgaacttaggtccatttggtgaacactggtttcactggttcgaaagaccaccacaaccaatctcattcccgaacttattctctttagctctgtctcaaaaccctcctaaacccctcttttcttccctctctctctcggacccaaaacaacccaaaaccgacccttcaaaaccaggcaaatatcagaaaatgatggaccaatattggtgggaatgtgagaatttacctgattatcgacacgccccagaagttgataagattttgaaggaagacccagtttttgaacacaaggaaaacccaacaccagaagaaattgaagagaacaataaatggtgggaagaatttagaagtagcccagttgttcaatttttaacaagagcagaggaaattgctgataatcttaataaagctgagcttcaggataataaggaaccttacaggaatgaagatgctaaactttggaaagctcttcctcatgttactgggttagatggtagaccaatgccaaggaaatctataaagactaaggaagaagcagagaataggttttgggatttcaccaaacagttctttttgggttatggggttttaggcaacgtccttatccccctggtagaccaattgattttgctcaggttatagggtataagcgcttggacaagcggtattatgattttgcaatgaagactggtggttggtactacaaggatcggttgggccgtacaagaggaccatgtgagctgattcaacttaagaccgcatggagtgcgggtataatcgatactcatactttcatatggggagaggacatggatgaatgggcacctatcggcatgatttatggtgtagaacgggcaatcgccacttgggaagttaggttgggtgcagctgcaacagcatttctccacaagcttcagaagggaatttctccttggactccattaaaggggcatgaaaagaaaacatatgaccaactgcaacaggaggctgtagaaagtaagaagcgtgatttggctgtgctcaaagccaatgatggagtttggcctggagtaagaactccaagccatgctctctttctttgggctagtggttctgagttgacaacaatgttggaagctgatcatatgccaaacaaattcataccaaaagatctaaggaaacaattggctaaagccattcctggcttaagaccttgggaggttctaagtgttgaacaagctatggaccgaataacatataatggacaatggtatcgtgagccgctcggctcatacacaactggtccgccatatataaagcactggaatgaagatgttttgaatatgctatcagtattttcagtcctaagtaaagctgtaatcaaggacatgaggcgcaaaatcccaggttttgatcaagccatgaatatgttccgagaagatgctattgcaagagaacaaagaatcagacagcagagggaagaaaagaagagggacgaggaagatgctttgt

SEQ ID NO: 1217 - DNA, 2072 bp, Amaranthus palmeri
gtcaactagttgctcgacaagccctacccagcaaatcaatttgggcatttggggttactttgattctcagtcccctagttctcagtaagcctatctactaatccagtcaattcccttcaatcttctctctttctagtttctatactccaaatttctcacaccaatagcagaaatcccagaaaactccatagctaaaacctccgacctccaatagaacccaccaatggcgtcaatgaatttaggtccatttggtgaacactggtttcactggttcgaaagacctccacaaccaatctcattcccgaacttattctctttagctctgtctcaaaaccctcctaaacccctcttttcttccctctctctgtcggacccaaaacaacccaaacccgacccttcaaaaccaggcaaatatcagaaaatgatggaccaatattggtgggaatgtgagaatttacctgattatcgacacgccccagaagttgataagattttgaaggaagacccagtttttgaacacaaggaaaacccaacaccagaagaaattgaagagaacaataaatggtgggaagaatttagaagtagcccagttgttcaatttttaacaagagcagaggaaattgctgataatcttaataaagctgagcttcaggataataaggaaccttacaggaatgaagatgctaaactttggaaagctcttcctcatgttactgggttagatggtagaccaatgcctaggaaatctataaagactaaggaagaagcagagaataggttttgggatttcaccaaacagttcttttttgggttatggggttttaggcaacgtccttatcctcctggtagaccaattgattttgctcaggttattgggtataagcgcttggacaagcggtattatgattttgcaatgaagactggtggttggtactacaaggatcggttgggccgtacaagaggaccatgtgagctgattcaacttaagaccgcatggagtgcgggtataatcgatactcatactttcatatggggagaggacatggatgaatgggcacctatcggcatgatttatggtgtagaacgggcaatcgccacttgggaagttaggttgggtgcagctgcaacagcatttctccacaagcttcagaagggaatttctccttggactccattaaaggggcatgaaaagaaaacatatgagcaactgcaacaggaggctgtagaaagtaagaagcgcgatttggctgtgctcaaagccaatgatggagtttggcctggagtaagaactccaagccatgctctctttctttgggctagtggttctgagttgacaacaatgttggaagctgatcatatgccaaacaaattcataccaaaagatctaaggaagcaattggctaaagccattcctggcttaagaccttgggaggttctaagtgttgaacaagctatggaccgaataacatataatggacaatggtatcgtgagccgctcggctcatacacaactggtccgccatatataaagcactggaatgacgatgttttgaatatgctatcagtattttcagtcctaagtaaagctgtaatcaaggacatgaggcgcaaaatcccaggttttgatcaagccatgaatatgttccgagaagatgctattgcaagagaacaaagaatcagacagcagagggaagaaaagaagagggacgaggaagatgctttgtatggacgttctgcaaatgaaccataaagcagaatgtgtcaaacgaaacctgatcaaaagagaatttgggtgaagagcatagttgagtagtgaccttgcgttggcggctagtcggctactaatggtggtcttgtgtgtaggaaaggaattctacatcagaaatctgtatgttgtatcccaatttatccttcgtttataccatatttgagctaggtgtatttacattagtttgtttttttgacagaaattgtaatcgtctttctaaatattgtgttagtagtgatacgagttttgtctcaaatggagagcaagtattactgttcaggaaataatttaagttcaattgtca

SEQ ID NO: 1218 - DNA, 4243 bp, Amaranthus palmeri
aaaaatctcttgtctaccttgatgaccatgcttgtccaactccaattatctcattttcttcataaaattcattctaatgcattaccattgggagatgttatattaggtggtaatgaaaatttgtatacaaaataacttttgtgatcaaagtttcattaccatgagaatgaaatgaatcttttaatgaaattttacactataaatcattttcattaccatcatttagtaccgctaaccaaacggattgtaaaggttaactaacaaataaaagacatctttaattacctcattgaattacatgaactgcaagttcaaacaactccacattcaaactttatggactaatttccatgagattgttggttgagagaaacttgcaagctgtaatttcccactaagatctttgtacacaactactttatccatattacaagctataataacattacataaacattcttgagcttaatatatactcgaattactcccttcgtccccctaattttgccccttagtttgtcccataactagttgtgaacatcatttgtaatatgctactaaaacctacaatttattttcattccgacataaattggaagctataattaccttaaggacacatgaccccacccacaataccccactaaaaatactcactttcctatttttcttaatctttgtgccatccccctagattgcggccaaataagtacatcaaaacacttgtataagtcaaatacgctagatcttgtgttgaccatattgacccgtaagttcaccacatgacctttttgagaacctatccgcgataggttcttccgttcaaacaactcaaatataatccgagtcaaatgtctcaacattgtcatcataacatatattttccgacaaacctcttcgttattacaaggataaggttgcatacatttgacacacgaaattttacctaggcagtagccaattgacaattgacattggtgtgacagcatgttgtaggctgtccttccctcacaaaatatcgattatgtattaattggtttttgaatctagtatatttatttaacatcactgttggtaaattaagctacaaaactaacttaaggaaacaaatgaaattttctttgaaatggatcattaatatagatttcttatgtgtggttatgatttccttcaagttcctggttgtttgcatcaaatgatctatgttgtgtattgtactgttcagttaggttgggtgcagctgcaacagcttttctccacaagcttcagaagggaatttctccttggactccattaaaggggcatgaaaagaaaacatatgagcaactgcaacaggaggctgtagaaagtaagaagcgtgatttggcggtgctcaaagccaatgatggagtctggcctggagtaagaactccaagccatgctctctttctttgggctagtggttctgagttgacaacaatgttggaagctgatcatatgccaaacaaattcataccaaaagatctaaggttttattttttgtttctttccctttgttcaactgattgatcagcattccaaatcattgttagagcattgcttacgagtacaacatttgaggtttaaaaaaatttattcaccatacccactcgatttactgactttgtgattcatacaatttttcaaatctcactatctaaacaattaccatatttagaggtgttcattcaggttatcgggttgatatgggttaggtttttcaggtcggttcaaaatcggggttttttccataatggtttttacataattttaaatttcattttgagtcgggtcaagttggattcagttacaagatcaggtaaatattgggttgtcggtctgttttgaacacctctaggctctaaccatatttcatcccttgaagttcaaaaaaatttactcaccatttccgatcaattagtgactttgtgtgtcatatagataacataagctcaatatctaactatgaccatattttgtgtcttttgaaatcagatatttctttaattttaatctatggtaactttaaagaaaataatatttggggttttcaatttctgttgtgataatgtgtaataatatacttgtcttggcaggaagcaattggctaaagccattcctggcttaagaccttgggaggttctaagtgttgaacaagctatggaccgaataacatataatggacaatggtatcgtgagccgctcggctcatacacaactggtccgccatatataaagcactggaatgacgatgttttggtatgtcttttatgtggataatttattctcatgtatcacctatattcctactttaatctcactttttaattagttatgaataaatcaaactttaggagatgattgcttaaaacatacctactaaaatttcataacgggtaattaccaaaaaaagtcaaaaaaaagaagaatagaatttaaagaaaagagaaatcaccacccctcccagtgactccatggtgttgatttgcatttctgcctgtgtttagcgcaaattatattgatgactaccattttctatatcattatatgtttcaaaagttataaacagaaaactttttagaataaataaatcttgtcacgagttttgatggttgtgcatggttacattactacatacaatgtatgtatatctgcggtgtgaatgaaactcatcaacttttgtgcttataaaatagaatctagtaagactgcatatcatattactacgtgtgtggaagtaatttgaatataaggctcaccaacatacctatccaaaactcaatatatacgttttctgttgatattgatgtaaggttgatttttttctgatgcaagtaaaaataactcggtcccatcaaataaggaaaaaagaaactgccattatcacagtaaaaacttatcccataaacgtaagagtacaaacatatttttcacctaccatagcccataggtgacagcctttaatccaaatttagcatctcaaggcattattctcatcaaattcacgatctaggaaggcttggaggaagagaaactccaagtcatagtgcaaaaattgcggtagcaacatagtgatgtggtaagctggtattgacacccagccgaagtcatgggatgtcccttgaaatgttccgaaatgcggttttttacagtttgatagcaaggtaatatcggttcataagcctgaaaatctttacaatgcggctttgtttttgcactatgcttcaaatgcacagcgtctatctgcgtacacgcatatctcatgaaccgactgcatctgcaggctactgtatacaactcatctgtaaatctatgactgtagtcttgataatagcagatcaaatacttgtatttctgtaacaaaggactatagatatcacaacgataataatgtggaacgaaactcatttttaacacaattaaatcagtggattagaagtgccttgcatgcctctatagagtaggtgaattaacctggaagtttgtgattttacagaatatgctatcagtattttcagtcctaagtaaagctgtaatcaaggacatgaggcgcaaaatcccaggttttgatcaagccatgaatatgttccgagaagatgctattgcaagagaacaaagaatcagacagcagagggaagaaaagaagagggacgaggaagatgctttgtatggacgttctgcaaatgatccataaagcaggtctcttttcataacattctcgacccgtttggttactggtatttttagcaaatggttactggtattaaatgatgataatgagaatgatttatagtgtaaaaatttcattaaaatttcatatcattcccatgaaaatgaaactttgatcagtttacgaatttctattaccaccgattattaccacctatcaaacaggccttctattctttgttggcctatttatgtccgacaataaactcttaacttcatttttaaccagcagaatgtgtcaaacgaaacctgatcaaaagagaatttgggtgaagagcatagttgagtagtgaccttgcgttggcggctagtcggctactaatggtggtcttgtgtgtaggaaaggaattctgcatcagaaatatgtatgttgtatcccaatttatctatttccttcgtttataccatatttatgaactaggtgtatttacattagtttgtttttttttgacagaaattgtaatcgtctttctttttttttttttttttttgtgta

SEQ ID NO: 1219 - DNA, 12443 bp, Amaranthus palmeri
taagtcataacccgtcgggtcaaaccgaccgacccggaaccgagagtgacccgatccgaaaatgacccgatccgaggatgacccgacccgaaaatgacccgacccgtaacccgaccgaccgaccgttttcccaggtctattcacaaccttaattaaaatacaacataaattgctatttttgagctaattgttgctaaatgttaatcatcaacaaaaaattacgcgtactttatttgatgagttatttttataagagactgtctctcagtaagataatttcaaaataagaaattcatgttagtcggactattaagtaactttagtttactcaagactttagcttagcatggctagttttggagtcacccttttggagtcatgaagtattagaagaattaattcagaaagaattgtcttgcccaaattaagctaagctttaaaatcaataaatcatcatgtgcatattttaagttgaagtgcctttggttgatgaaaaaatgtaaagtgcaaaagaaatctttgctagaatagtgcaagtataggggttcggcataatcttgcatcgacgattgcaggaaaccgagtagcaccgattcgtgcaatgtgtatttcatctcggtttatgatcaactcggttgatgaataggcaaccgatacgtagaagcctagtaagtgttcacctcatttgtgcccatagttccatactaagcttatttgtagacatattccattagggctcatttgttcttaactaaactcttagaaacaacatattgaacaaaaaatcggcttattcatcagcaataagcagttcaacacgccgagataacttgcaccaaaccatctacgatacaaagatcagaaacgggtaatgatgaacgaggaccctcaaagtgttcttgattaagaatctcgatttgaaggtataaagttacaacataagatcgagaaaggaaaagcttataagagaacgatagcaaaatatacagattacagaatagctagtctcgctacaaaaataagcagtgcgaaaacagtataatcatacacatataacatgatgatgaatggaataccgcgcaacaagttatggctttatcatcttccaagtcttattgcatatgtcgaaggaactttcttgttgtagatcgaattcaaatttctgcacgggctttttattatgctccacgatgtctaagaaccgatcaaggaataacaagcctagccgttttatgagttattataaatgtaggtaacagaagacgagaatattttgttaagagcagaaaggaccaggagaggtataggcaaaatataaccaaaatgtacattagtgatgaattaaggatacatcctgagatttttgactgattctcttcgcctggaagaatgtttgtgacagatgcatagaatgaaagtatcttcctgaaataataacaaaatatttagttaggaatgtggaacagccgaacaggtgtgtatcatcgaatacaaatttacaagcaagccagagaaaaataatagtgacccttaaattttcacccggtttgggactgtctcgatatgagaggagtccatataattagtctattcctgtaactgatcactttaagattgtaattaatcactttaagattatacattatcactttaaggttataagttcaccataaaactataaaaaatgatcactttagaactgtaaaatacagatccacaagtaagccagagaaaaataagtgaccctcaaattttcagccactcttgagaccgtagactactatgaaacgagtcaatatagttagtctattgatcagtttaaagattgtaattgatcacattaaggttataagttatcactttaaggttataagtaattactttaaggttataagtaattactttaaggttacaagtgatcaccacaagactataaaaagtgatcactttaaacctgtaagtgattactttaagacagtaagtttatattgggtcagcccaaaaaaaataaagttctgcatcactcttctgaaaaatacttactcgtctttctcaagatctgccttaagtttcttcagccgctgattatgttcctctatcgaaagttgctgattatctaagtcattaatcttgtcaacaatcactgtgttcatataaagaataacaatgagttaaaataactgaactaacaaacgaacaagacaaacaaataactaatctgatacttatctaagatcctctcgaagcaactgctcttttttgacttcctcgtcgagctctttctgaaggcggtccacttcttcatcagagactacttcagatcgcgtaacttctattttgtgtttgcaatcatttatctttttctcgtaatctatggaaagatgtaaacatgtccaaaataagaccaggatatcaaagtggctttaagcagcacaagatgacaagagtagctaaagcatgatcagacgaaagacatagtgtgtgctgtccactgtgataaattcaaacatctatatgaaacgggaaaatgctttcattgtatgctttgatttagagaatatacacataatctaccagtcgactacagaccgagctgcaaattttcagtttctgtttgaatataagatcaaatagtaaaccactcgactacaaagtaagggttgatgagttaagagttttagctagcagtttggaataaatatttcattaaaatgagccataaaaaatagcttgcagtatacaattaattcatgatgcatcacaaacaccattaaaataaaatcatatgtaaatatattaatatgaggatgacatagcaatactacataggttgcttttccatggcatttagcactcataatctaccggtccatccaatagtttaaaactaggctaatttgactctagaaaagtgtcaaattagtttaaagtgtgatataattatatttagtttgttcatttttctattatggatgatacacttccatgttcattataagtatcagatgtattgaaaaaggttggaattttaagagctcataaaagaaataagtaggttgaagatgacttgataacaaaagttaagaatcacatgaagaattgggatttacaagagcatatgataatagataggaatcgatgcatgagaagtatatatgtagatgatcattgtaatcaaacttcttatttgtagactagtattggatacggtcaaatgaagcaacattttccacgtttgtttgtctgtttgtttgttttatttagtggacctcaattgttgggattaaagttttggcattgttattgtgttgcacttgttacatgaagtatattaatagcattattccaaatcaaaaaggatgaaatagaaatcttcattcttgtaagttcctaccttaacagatatttggagctacaagtctaacaaactataactaatgtcccctatttgctttgagacatgaattcgacattgagaaatgatagtaaaaatcttttcaatcatgcatattttttattttcaacattgaaaaagtcaaggtatttctcctagcaataatttatcaatacgtcaagacttaaaattgccaaatctatatgctctaaattactaaacccatttcatgtaaaccaagtcagtgtttccacattggagaaggggaggcatattttaagctagaagacatacccttgccatgacaaatcggtttcaagtggaacctccttatgagcttactggtgacccaactctcctaactaagctcaataatagtcaagacaaccccttcctatcataatctatgaactaacaagtaccatatgtaaattgtagaacattagatgcctccaaaaggagttcatgctataaggcctaaaatttttagaccttgaaaatcaaaaatgccaaaacttctttcccaccaaagttgttgggaaacatacaattatcaacttaaacatgccatacattacatcgtttcatccatcgaagagctgtgggccctgtggcaagaaagtaacatatataggctgggtcactactaataagatgtgcttacctacttaacttctttaacaatttaaagttcaattgcacttcataaccaattattttcgacataaaaagtatatcttgaactttactcccctatactactcattttgcatcattttaaaaggctctcacatagtactcagaaacgatgcaaaataagtaagacaaatgagtgtctttttcatgaaacaatatagcttgatgtgcagactcaaaattatggaacaagattgtaatcaaaagcaataaaaagcaatctttacatagaagtctaccctcccatcgctaatcgtcacatttcattcctaactagcaacccagtatagaatcctgttccccaaaatcaaaaagttatactaacacaatatctgacactaacttatcaaattactaacaaaatctaagcttgatcactatagctaaccccaaaaatcataaaccataaagaaaaaaggtataagatgtcagaattacaaaggataaaaaaagtaaagaaaagattttaaaaaaatgaacctgaaatggcaacctgggtagcgttgaaatcagaatcagaaaacgatttgactgactttgaaagctcaaggcaaaaattgagcgcgttatagtctttcttgtcagcaagaacaccaacgaggtcgtcgcagtaagataatagcttctgtatatcagtttggggcgatttctcccccatttttctagggttttggagttgattaatgcagaatgaagataagaggaaatcaagaaaagataattgtggtagtgaaagagtaagtagaaatcaaggattgtgtcaaagcaacaaatgagaatttgtgaaaaggaattgtaatttgaaaatagtttggcgccctagatttcgtccactctcaccctcctgtggctcgttgtgtcattgtgtgtgcttgaataacttgaccgacaaaaaaattaaagcaatttcatttttggaatttttctaaatttaaaattaaaattactaatagtataattttttaaactataacccaaatgatttgccttaatgggttggaaaaattaaaaacttagtggatgataaaagtatataatttttaaattttaatcgtcctaatttgggtgattgtcggtaatcggtataaattgatatatattaatgagtgtatataggtatgaaaagttacatgtactattggtattatctacaaatgtactactttgtatcaatttttatatttttattgaaacctattgacaaaaaattaaggatattaatttaatttatagcattaaactataatttaaataaaattagatctataattacatttaaaagaatttcaattttataaaatatataacacatacttaaagaaaatgtgagtctgagttggccatagtaggtagggatgtgtttaaatacattataggtgagcaaatgtgactatgaaaagtttgttcatcatagatgatagacaagcaaattttagatgagatgagtttgaatgcatagtaggtgggcagacgtgggtatgaaaaatttacctacaaaatgtatggttggcaaacaaattttaggtgaggatgagtttgaatacataataggtggacatacatggttataaaaactttactcgccataaataataggcaagtaaatttaggtgtgtatgaccttatgagtataaagagagcatatttcatctctaccaaaatggtgttcatataattagaaaattttactaagctatacttttctattttgaaaaagtctaaaatagacttggttcatcatagtttaatgtcaaccaattcgttttcccttcccttcccaagcatgttacgtgatattgctcaaaccttcccgatctctttcataagaagattaaaaaagtgttcatgtccttctttttccttctcgtccttctttcttccactaacaatatagtccgaaatcagtcggcataggcctatagcgattaatatccaattattttaaacagtctgaataaatatagtatcggtacttcatttcagtaggaaaaactcaaaattttcgacttacatctatcagtcggaaagtttgtcaattattccaagtttccaactaagaagttggtcaaaatcacgactagcaagttattcagaaaatagtagaaaatttcggactatttatcagtcagaaattagtcaatttttttttttttatgaatttcatcctaaaatgacaaaaattagaaaaatttcgaaccattttgtctaccaatttccgaaaaaatgcaccccaaaaagaaaattaacaaaatttcggacaattgcaacagccaacaggcgtgagacggtcaactagttgctcgacgagccctacccagcaaatcaatttgggcatttggggttactttgattctcagtcctctcagttctcagttagcctatctactaatccagtcaattcccttcaatcttctctctttctagtttctatactccaaatttctcacaccaatagcagaaatcccagaaaactccatagctaaaacctccgacctccaatagaacccaccaatggcgtcaatgaacttaggtccatttggtgaacactggtttcactggttcgaaagacctcctcaaccaatctcattcccgaacttattctctttagctctgtctcaaaaccctcctaaacccctcttctcttccctctctctgtcggacccaaaacgatccaaacccgacccttcaaaaccagacaaatatcagaaaatgatggaccaatattggtgggaatgtgagaatttacctgattatcgacacgccccagaagttgataagattttgaaggaagacccagtttttgaacacaaggaaaacccaacaccagaagaaattgaagagaacaataaatggtgggaagaatttagaagtagcccagttgttcaatttttaacaagagcagaggaaattgctgataatcttaataaagctgagcttcaggataataaggaaccttacaggaatgaagatgctaaactttggaaagctcttcctcatgttactgggttagatggtagaccaatgcctaggaaatctataaagactaaggaagaagcagagaataggttttgggatttcaccaaacagttcttttttgggttatggggttttaggcaacgtccttatcctcctggtagaccaattgattttgctcaggttattgggtataagcgcttggacaagcggtattatgattgtgagtattacttattcaatcttttgatttggagttattgatcattatttctttttcaatttgcattgtggtagaatataggggattgtgtaaatagaagtatgttttagttgttaatatcatctatactagtacttctattagctaagagtatattaacctttcttgtttatagccttattggatagttttgagtactcttttgttcgcttgagtttgcatcaatataaaattgtgctttattgattcgtggatcggatttgaagaatgagatatttgaggtgtgtggatgtgatatacttgatatgtagatgagaattagtgagtgagcttggggttgtttccgaaagagaaaatgtcgttaattggagggaagaaacaattaaggggatagtagcaagatcaaaaggtcaaagtaacagagggagtatatataatgctttcttcaatgagaatagtcaaggaagtgcgtgattagttgggaacattatgctgagctatgggtatacttttgtgtttggttgagtcttaaagtaatggttaggaggtttccttttgagttggtgctggttgattttatcgaaacatcttgattatttgtagatcatgttatgctctttgatgctctgatgacaaccattttccttcatccttaaactaacaacaccaagattgaggtcattgacatggtgtagagattattgatctaaatatgttgttgaggtatctcctcactgcaatatttaatgatctgatggttcttataagtagaaagttgtatgtaagcccctgtatgtttttgatctcttgtatctatgccatccaaatttgaagattttgttatgttattatgagttatagtaaggaaaattgcttgaccataggcatctgttgcattacttcctatttgaggatttatttgtgaggtgtgcaagcatggtcataactgactaaagtttcttgcaacttttgtgagaagggaaaaagtatcggtattttgaatcttagaaactcaagtagttgttctggatattagcagaagttaatcttattgtcttttggagttttaggcttaagtttactatatataagtatatttaatgctattggtaacctctgcactttgaaaacatgatatgatgtttagacttaccatattgtagcaaaatttcctttacaacagattattgttattatattgatttttacacgagcacatgagaatagatgagaataaatggtggaggaatatacaacgtatggatgatcattggagttgattttcttagttgtagttcaaatgaagtataatctgttttggttcatatagatgactatgtgttggaataaggctttaggcctttagcattgtaatatagtggcggttttcttcatgacaattcgttcaaacttatacaaaaaatttacatttaaatggctaataccttgctctttcctccgttgggtcaattctcaaatcctagtgattttataatatttttttagtgctaaaatggtttatatttatttagttgcaatgaagactggtggttggtactacaaggatcggttgggccgtacaagaggaccatgtgagctgattcaacttaagaccgcatggagtgcgggtataatagatactcatactttcatatggggagaagacatggatgaatgggcacctatcggcatgatttatggtgtagaacgggcaatcgccacttgggaaggtgtgctgcttgtcacttatatattttttgtgtggcatttgggttttattgcaatagtaaaagcagttcgttacttttttactttgctcactaaatgcattaaatatattttataaaatttcaacttgatgcctacgttttatttgaaaatttcactagacggtaaaaatcttgtctgattgcaattttgactgaaataaaggccggtattgtacttggctacacttaaatgacttttcttgaccccctttttgcgtcattggagcacaatgaggagtgcaatttgtgctgtgtagctggctcagcagtagcatttcaattttggaatattagcttacttaattctttacttgagtcgggaaatgtttcatttcactaatcactcctggaagcttgttccatgtttttgtttgatacaattttgataaaatttactccatcatagctcgaaagtttgtctccaaattgcggttcttaaatttcaatggctgctcacttggaaaggagttctattctaatactttccgacacactacttcgacactccaccaattagctgtaatttgctactacatcactaatttcaaagcctaaatctcaacatatgggtttgttgtatgattctcaacacaaatcaatgcacgagatcatcggtaatgaagactagaatttattctgtgtatcggctactaatctacagctaacaaaatcattttcaatgatcccttggatacacttctcattctttcgtttctattatcatatgatctctaaatctcaatttttcatgtcatttgtcaagtaatttttggcctaccttttcctcttctaagctttacatgtggtgttctttgcatacagcctaaccaaacgtaagtaaatctttttgtcatcagttctgcaactctaaggctttgttctaacttttctatcttttagtctatgtccagtcgtccatccagatctttactatcctatcttcctacaacaatgttgtttataagtgtatcaagatgtacaagatttatgcttcatattttgatcaatatccatgttgtgaaaaattaagccaatatacatgaaacactcacttagaatgaggtccttcatatctaatcttacacctccagcttcatcctccattctataaggcaatgttaatgttcttcagaatcaacctttatatatttagtatatgaacactagaatgacaaaagagggggttcaatttgtgttttgatcgtgtttgaacctttctcatttactaaattactgctaataaatttttaagtgtttaagatgtacaagaagatctaagcggaataagctggaaagtgagaaaatactaatgagcaagtacaaagatactcaaacatggaagtatgtcctagcctatctagtctactctagacgcaaaaacctcgatgcaaactgtttggatttactgtctctaaattgagctagttcaatacagcctctctaatgtttaacttcagaaacaaactttccaaagctaactctagcttggatcacaaagttttgaagccagaatatgagtacaaaattaaattaatcaaacataaaaataaatgaaacgaacttgtagagaacctgctactgagaggttcttcagtatgttgggacttgcactttcccctcgatttcttggattttttttctttgacatgtcttcaagtctcagaattgtcttttgtgcaacttggatcatttatcgcatgtcttgaaacagctacccatgtcttctagcccttcaaccaagtaaaagtcgcggttgcgaaaacggacacagtgattcattaatagggttgatgcggtttttgcaccaccaaatgaaggttttttacacctttacaatgtggataatattgttttaataaatttgaaaactctactatatgaccgataagatacgatacaaccttgtttttgcattatgacttgaaccactaatcaatatatcacactctagttttcatttttgccaatcgttgtctgggctattaccctaacggcccgtttggtatgtggtcataaacgatggtaatagtaatgaaaaattagtgtaattttagttgaaaaatctcttgtctaccttgatgaccatgcttgtccaactccaatcatctcattttcttcataaaattcattctaatgcattctcattgtgagagatggtattaggtggtaatgaaaatttgtattcaaaaaaattttttgtgatcaaagtttcattaccaagggaatcatatggatcttttattgaaattttacattataaatcattcctattaccatcatttagtactactaaccaaacgggccgtgaaagtatttatgatccttactttgatgagacctcaatggggggaagttgttgcatgcaccactagtggaaaaaaagctattggctgctgcttattggctgcggttgttaggaaaacgcagcccatatgagaattaaaaaagcgggaaaaaagaacagtactaaggggctgcggtttttggcattgaccgcagcccttaaccccttaaaaaattcatcaataaaatactaaaggggctgcggttttatggatgtccgcagcccttaattattccaaattaataaagaaaataaaaaaaaaaattaaagcaaaggggctgcggtttttatggatgtccgcagcccttattaattccaaattattaaggaaaattaaaaaaaaaataaaatggagtaaggggctgcggtttttaagccatgtccgcagcccttaagcccagcccaaaaaaaaaaaaaacaaaccctaatatcatgggcgcgccgtatattaaaaagaaaaccctacataccctaataaacggctccctaataaatacctaacaaaccctaagaaaaccttcagccttcaaaacattcctaaacattcctaaacggcgcctcattcttcatcaatggcgccttcgtttttagaaaactttcttcattcttcattcttagatttcttcattcctaaaccgtccttattttatcattcttcattcttcattcttagatttcttcatttcttcatcaatggcgccttcgtttttgatagccttcgtttttagtaaacatctgcggtttcttcatttcttcatttcttcatcaatggcgccttcgtttttagtaaagatctaagaaaaccgtcccattattgaagattttgaagattttggtcaagatctgcggttttagatttcttcaagcattttgttttcttgatttagttttgatttagtttattcttagattcgtttattttgattgtgtatttcgtttttctgggtttattttgattttgattgttcttatatttaatgttttttttcgagtatgttcttagatctaatgttgatagccttcgtttttgtaattttttttggt

SEQ ID NO: 1220 - DNA, 673 bp, Amaranthus rudis
atataatggacaatggtatcgtgagccgctcggctcatacacaactggtccgccttatataaagcactggaatgacgatgttttgaatatgctatcagtattttcagtcctaagtaaagctgtaatcaaggacatgaggcggaaaatccccggttttgatcaagccatgaatatgttccgagaagatgcaattgcaagagaacaaagaatcagacagcagagaagaaaagaagagggacgaggaagatgctttgtacggacgttctgcaaatgatccatagagcagaatgtgtcaaacgaagcctactaaaaagagaatttgggtgaagactgaagagcatagtgagtagtgaccttgcgttggcggctagtcggctactaatggtggtcttatgtgtaggaaaggaattctacatcagatttctgtatgttgtattcgaatttatctctttccttcgtttatttacattagtctgtttcgttgacagaaattgtaaactttttttttcttttgagtgtgtaaaatcgtgtttctaaatattgtcttggtagagaatcgggtttttatttcaattggagagcaagtattacttttcagaaaaggttatcatattcaattattcacaaaaaaaaaagaaaaaaaaacaaaacatgtcggccgcctcggtctcta

SEQ ID NO: 1221 - DNA, 944 bp, Amaranthus rudis
atatatttgtgaggtgtgtaagcatgttcgtaactgactaaaagtttcttgcaacttttgtgagaagggaaaaggaaacagtattttgaatcttagagactcaagtaattgttctggacattcacggaagttaattttattgtgttttggacttttaggctgaagcttactgtaaagtgtgaatttaatgctattggtaatatctgcactctgaaaacatgatatgaggtttagattaccatattgtagcaaaatttactccacagcagaatttttttttttttgttataatagtgatttttatacgagcgcatgacaacagatgagaataaatggaggaatataccacgtgtggatgatcattggagttgattttcttagttgtagatcagtattacataggtcaaatgaagtataatctttgttaccgatgatctctcacgttgaattgttttggttcatatagtcggctatgtgttggaataaagctttagcattgtggtatagtggtggttttcttcatgacaagtcattcaaacttatacaataatattacattgtaatggctaataaccttgctctttccttctttgggtcaattctcaaatcctagagatgatgtaatattcgtgctaacatggtttatatttattcagttgcaatgaagactggtggttggtactacaaggatcggttgggccgtacaagaggaccatgtgagctgattcaacttaagaccgcatggagtgcgggtataatcgatactcatactttcatatggggagaggacatggatgaatgggcacctatcggcatgatttatggtgtggaacgggcaatcgccacttgggaaggtatgctgcttctcaattatttattttttgagtggcttttgggttttattgcaacagtaaaagtagttcgttacttttttactctgctca

SEQ ID NO: 1222 - DNA, 880 bp, Amaranthus rudis
atgatttccttcaagttcctggttgtttgcatcaaatgatctatgttgtgtattgcactgttcagttaggttgggtgcagctgcaacagcatttctccacaagcttcagaagggaatttctccttggactccattaaaggggcatgaaaagaaaacctatgagcaactgcaacaggaggctgtagaaagtaagaagcgtgatttggctgtgctcaaagccaatgatggagtttggcctggagtaagaactccaagccatgctctctttctttgggctagtggctctgagttgacaacaatgttggaagctgatcatatgccaaacaaattcataccaaaagatctaaggttttgttttttgattctttcccttagttcaattgattgatcagcattccaaatcattgtcagagcattgcttacgagtatattgaggtttaaaaaaatttactcaccatacccactcgattagtgactttgtgtttcataaagtttttcaaatctcactatctaaacaattaccatatttagaggtgtttattcaagtcctcgtgttgatatcgggttatgtgtttcgggttggttcaaaagcgggtttttttgtccacggtggtttttgcataattgtaaatttcattttaagtcgagtcaagtcggattcggttaagttcaaacaaaatttactcaccatttctgatcaattagtgactgtttcatatagataacagaatctcactaactaccatattccatgacttttgaatttttatatttctttatttttttttgaagtgatattttctttatttttaatctatggtgaatttaaagaaaataatttttggggtttcaatctctgctgtgataatgtgtaataata

SEQ ID NO: 1223 - DNA, 428 bp, Amaranthus rudis
aatccattagaatctaaaaggagtaaaaagttgtgaactttgacaattctcttcaatctttctagtctctatactccaagtttctcacgtcaccagcagaaatctcagaaactccatagctaaaacctccgacctccaatagaaaccaccaatggcgtcaatgaacttaggtccatttggtgaacactggtttcactggtttgaaagtcctccacaaccaatctcattcccaaatttattctctttagctctctctcaaaaccctcctaaacccctcttctcttccttctctctttcggacccaaaacaacccaaacccgacccttcaatctaggcaaataccagaaaatgatggacccagaacattcataatctggggtatttaggtgggataggcactttgatgcggccataacgttttttcttct

SEQ ID NO: 1224 - DNA, 202 bp, Amaranthus rudis
gaaaacccaacaccagaagaaattgaagagaacaataaatggtgggaagaatttagaagtagcccagttgttcaatttttaacaagagcagaggaaattgctgataatcttaataaggctgagcttcaggataataaggaaccttataggaatgaagatgctaaactttggaaagctcttcctcatgttactgggttagatg

SEQ ID NO: 1225 - DNA, 230 bp, Amaranthus rudis
gttactgggttagatggtagaccaatgcctaggaaatctataaagactaaggaagaagcagagaataggttttgggatttcaccaaacagttcttttttgggttatggggttttaggcaacgtccttatcctcctggtagaccaattgattttgctcaggttattgggtataagcgcttggacaagcggtattatgattgtgagtattacttgttcaatctttttgattt

SEQ ID NO: 1226 - DNA, 311 bp, Amaranthus rudis
tgaatttacagaatatgctatcagtattttcagtcctgagtaaagctgtaatcaaggacatgaggcggaaaatccccggttttgatcaagccatgaatatgttccgagaagatgcaattgcaagagaacaaagaatcagacagcagagggaagaaaagaagagggacgaggaagatgctttgtatggacgttctgcaaatgatccatagagcaggtctctcttcataacattctgttctttgtcggcctatttatgtccggctataacctctgaactccatttttgacctgcagaatgtgtcaaacgaaac

SEQ ID NO: 1227 - DNA, 343 bp, Amaranthus rudis
aatatcgggttgtcgggtctgtatttaacacatctaactatatttcatcccttctgagttcaaacaaaatttactcaccatttctgatcaaatagtgactatgtttcatatagataacagaatctcactaactaccatattccatgacttttgaatttttatatttctttatttttttttgaagtgatatttctttatttttaatctatggtaaatttaaagaaaataatttttggggtttcaatttctgctgtgataatgtgtaataatatacttggcaggaagcaattggctaaagccattcctggcttaagaccttgggaggttctaagtgttgaacaag

SEQ ID NO: 1228 - DNA, 817 bp, Amaranthus spinosus
agcttcagaagggaatttctccttggactccattaaaggggcatgaaaagaaaacatatgagcaactgcaacaggaggctgtagaaagtaagaagcgtgatttggcggtgctcaaagccaatgatggagtctggcctggagtaagaactccaagccatgctctctttctttgggctagtggttctgagttgacaacaatgttggaagctgatcatatgccaaacaaattcataccaaaagatctaaggaagcaattggctaaagccattcctggcttaagaccttgggaggttctaagtgttgaacaagctatggaccgaataacatataatggacaatggtatcgtgagccgctcggctcatacacaactggtccgccatatataaagcactggaatgacgatgttttgaatatgctatcagtattttcagtcctaagtaaagctgtaatcaaggacatgaggcgcaaaatcccaggttttgatcaagccatgaatatgttccgagaagatgctattgcaagagaacaaagaatcagacagcagagggaagaaaagaagagggacgaggaagatgctttgtatggacgttctgcaaatgatccataaagcagaatgtgtcaaacgaaacctgatcaaaagagaatttgggtgaagagcatagttgagtagtgaccttgcgttggcggctagtcggctactaatggtggtcttgtgtgtaggaaaggaattctgcatcagaaatatgtatgttgtatcccaatttatctatttccttcgtttataccatatttatgaactaggtgtatttacattag

SEQ ID NO: 1229 - DNA, 1078 bp, Amaranthus spinosus
actttgattctcagtcctctcagttctcagttagcctatctactaatccagtcaattcccttcaatcttctctctttctagtttctatactccaaatttctcacaccaatagcagaaatcccagaaaactccatagctaaaacctccgacctccaatagaacccaccaatggcgtcaatgaacttaggtccatttggtgaacactggtttcactggttcgaaagacctcctcaaccaatctcattcccgaacttattctctttagctctgtctcaaaaccctcctaaacccctcttctcttccctctctctgtcggacccaaaacgatccaaacccgacccttcaaaaccagacaaatatcagaaaatgatggaccaatattggtgggaatgtgagaatttacctgattatcgacacgccccagaagttgataagattttgaaggaagacccagttttgaacacaaggaaaacccaacaccagaagaaattgaagagaacaataaatggtgggaagaatttagaagtagcccagttgttcaatttttaacaagagcagaggaaattgctgataatcttaataaagctgagcttcaggataataaggaaccttacaggaatgaagatgctaaactttggaaagctcttcctcatgttactgggttagatggtagaccaatgcctaggaaatctataaagactaaggaagaagcagagaataggttttgggatttcaccaaacagttctttttgggttatggggttttaggcaacgtccttatcctcctggtagaccaattgattttgctcaggttattgggtataagcgcttggacaagcggtattatgattttgcaatgaagactggtggttggtactacaaggatcggttgggccgtacaagaggaccatgtgagctgattcaacttaagaccgcatggagtgcgggtataatagatactcatactttcatatggggagaagacatggatgaatgggcacctatcggcatgatttatggtgtagaacgggcaatcgccacttgggaagttaggttgggtgcagctgcaacagctttt

SEQ ID NO: 1230 - DNA, 1780 bp, Amaranthus thunbergii
cggtcaactagttgctcgacgagccctacccagcaaatcgatttgggcatttggggttactttgattctcagtcctctcagttctgagtaagcctatctactaatccagtcaattcccatcaatcttctctctttctagtttctatactccaaatttctcacaccaccagcagaaatcccagaaactccatagctaaaacctccgacctccaatagaacccaccaatggcgtcaatgaacttaggtccatttggtgaacactggtttcactggttcaaaagaccaccacaaccaatctcattcccgaacttatcctctttagctctgtctcaaaaccctcctaaacccctcttttcttccctctctctctcggacccaaaacaacccaaaaccgacccttcaaaaccaggcaaatatcagaaaatgatggaccaatattggtgggaatgtgagaatttacctgattatcgacacgccccagaagttgataagattttgaaagaagacccagtttttgaatacaaggaaaacccaacaccagaagaaattgaagagaacaataaatggtgggaagaatttagaagtagcccagttgttcaatttttaacaagagcagaggaaattgctgataatcttaataaagctgagcttcaggataataaggaaccttacaggaatgaagatgctaaactttggaaagctcttcctcatgttactgggttagatggcagaccaatgcctaggaaatctataaaaactaaggaagaagcagagaataggttttgggatttcaccaaacagttcttttttgggttatggggttttaggcaacgtccttatcctcctggtagaccaattgattttgctcaggttattgggtataagcgcttggacaagcggtattatgattttgcaatgaagactggtggttggtactacaaggatcggttgggccgtacaagaggaccatgtgagctgattcaacttaagaccgcatggagtgcgggtataatcgatactcatactttcatatggggagaggacatggatgaatgggcacctatcggcatgatttatggtgtagaacgggcaatcgccacttgggaagttaggttgggtgcagctgcaacagcatttctccacaagcttcagaagggaatttctccttggactccattaaaggggcatgaaaagaaaacatatgaccaactgcaacaggaggctgtagaaagtaagaagcgtgatttggctgtgctcaaagccaatgatggagtttggcctggagtaagaactccaagccatgctctctttctttgggctagtggttctgagttgacaacaatgttggaagctgatcatatgccaaacaaattcataccaaaagatctaaggaagcaattggctaaagccattcctggcttaagaccttgggaggttctaagtgttgaacaagctatggaccgaataacatataatggacaatggtatcgtgagccgctcggttcatacacaactggtccgccatatataaagcactggaatgacgatgttttgaatatgctatcagttttttcagtcctaagtaaagctgtaatcaaggacatgaggcgcaaaatcccaggttttgatgaagccatgaatatgttccgagaagatgctattgcaagagaacaaagaatcagacagcagagggaagaaaagaagagggacgaggaagatgctttgtatggacgttctgcaacagatccataaagcaggtctcttttcataacattctcgg

SEQ ID NO: 1231 - DNA, 1473 bp, Amaranthus viridis
agcagaggaaattgctgataatcttaataaagctgagcttcaggataataaggaaccttacaggaatgaagatgctaaaactttggaaagctcttcctcatgttactgggttagatggcagaccaatgcctaggaaatctataaaaactaaggaagaagcagagaataggttttgggatttcaccaaacagttctttttgggttatggggttttaggcaacgtccttatcctcctggtagaccaattgattttgctcaggttattgggtataagcgcttggacaagcggtattatgattttgcaatgaagactggtggttggtactacaaggatcggttgggccgtacaagaggaccatgtgagctgattcaacttaagaccgcatggagtgcgggtataatcgatactcatactttcatatggggagaggacatggatgaatgggcacctatcggcatgatttatggtgtagaacgggcaatcgccacttgggaagttaggttgggtgcagctgcaacagcatttctccacaagcttcagaagggaatttctccttggactccattaaaggggcatgaaaagaaaacatatgaccaactgcaacaggaggctgtagaaagtaagaagcgtgatttggctgtgctcaaagccaatgatggagtttggcctggagtaagaactccaagccatgctctctttctttgggctagtggttctgagttgacaacaatgttggaagctgatcatatgccaaacaaattcataccaaaagatctaaggaagcaattggctaaagccattcctggcttaagaccttgggaggttctaagtgttgaacaagctatggaccgaataacatataatggacaatggtatcgtgagccgctcggttcatacacaactggtccgccatatataaagcactggaatgacgatgttttgaatatgctatcagttttttcagtcctaagtaaagctgtaatcaaggacatgaggcgcaaaatcccaggttttgatgaagccatgaatatgttccgagaagatgctattgcaagagaacaaagaatcagacagcagagggaagaaaagaagagggacgaggaagatgctttgtatggacgttctgcaacagatccataaagcaggtctcttttcataacattctcggcccgtttggttactggtactaaatggtggtaatgagaatgattaatagtgtaaaattttcatcaaaagttccatatcattcccatggtaatgaaactttgatcacaaaaagtttttttgtttataaatttccattaccatctaataccacatctcccaatggtaatgcattggaatgaattttatgaagaaaatgagatgattgaagttagacaagcatgaccatcaaggtagtcaagagatttttcaactaaaattacactaatttttcattctcattaccaccatttattactatctaccaa

SEQ ID NO: 1232 - DNA, 575 bp, Amaranthus viridis
ccaggcaaatatcagtaaaatgatggaccaatattggtgggtcggtttggggttactttgattctcagtcctctcagttctgagtaagcctatctactaatccagtcaattcccatcaatcttctctctttctagtttctatactccaaatttctcacaccaccagcagaaatcccagaaactccatagctaaaacctccgacctccaatagaacccaccaatggcgtcaatgaacttaggtccatttggtgaacactggtttcactggttcaaaagaccaccacaaccaatctcattcccgaacttatcctctttagctctgtctcaaaaccctcctaaacccctcttttcttccctctctctctcggacccaaaacaacccaaaaccgacccttcaaaaccaggcaaatatcagaaaatgatggaccaatattggtgggaatgtgagaatttacctgattatcgacacgccccagaagttgataagattttgaaagaagacccagttttgaatacaaggaaaacccaacaccagaagaaattgaagagaacaataaatggtgggaagaattta

SEQ ID NO: 1233 - DNA, 1226 bp, Ambrosia artemisiifolia
tggttaactaatgctaacgactaatcgatgcaatgctattgttaaaaatttaatcatgcctctttgtgccaatgatttttaacttgtttgttttaattaaagttttttgtattatacaggaaacagttgcaaaaagcaattccagggttgaggccatgggaggttttaagtgtagaacacgccatggatcaaataacgtatggcgatcaatggtacggtgaaccacttggtgcatttacaaccgggtccccatacatccggcactggaatgatgatgttgaggtatctattttgttaaatttacaacttttataaatggtttatgtgtagttctttcattcgggtcgagttggtccgtcctgcaaacactttgttcttttctacaagtttataaataatttgtgtttaatatgattacagaaccacattattacaaacattaatctggtctttctagtaaaaccgattttgcagggttacgcatttgaatgtctgtcttatttgacccgttagagataaaacatatctttaaattgctaccacgttgacattcgttattcttgttcactattgcaggacttcattaacgcgtaccagcaattcacagatctgatgtgtgattatctagaagaagttatcccggggttcaacaaggtaatggagaaagtagatgcagaggctgaggagaaataccgaagacgaatggaaagtgcgaagaggaaactagaagcaagaaagcgggccctccgcccacaaagagtcgatcccaatgccgacgaggatgatgatgctttatgaggttggttattctggacagtttgcataacataaattgtacctgggttcagtttttattgtatgatctagattttgttttgtcatctaatttgattatgtagtcatttgtattgaagatatttgttatttacgaacagaaaaatatatgttggcttgataatatacaagatacctgaagtcaagcatgatggattgatgggttgccgaatgagcttgattcatctatgatggctgtaaaaatgccgcctaggcgagtactccccacctacgccgagtactcggcgaatcatctctgagtactctccgactatggccaagtacttgtaactccccagctaaccaagttggcaccgcctagtgactttgacaggcttaggattgtataacgcgactcggttcattttattttattttattttcacttctct

SEQ ID NO: 1234 - DNA, 886 bp, Ambrosia artemisiifolia
caacaacctccttacttttcgatatttagattttaagtttatcaggtgtgctttttttttttaaattacagtgagactaggtgctgcagcaaccgctttccttcataaattacaaaggggtatacctccatgggtcccactaaaagggtttgagaaaaaaagccgtaagcagcttcaagacgaagcttatgaaagcaagaatcgtgatttagctgtactagaagctaacgatggaatttggcctggtgttagaattcctagtcatgctctgtttctttgggccagtgggtccgagctcacttcaattttggaacaagaccacatgcctaacaaatacatccccaaagatatgaggtaatgtcccagtttttacaatttaaggtggcaaaacggacggattgggtatcgagctcaggccaaaatggttatttcaacatttgtcttttgttttcacttttcaacatacaaatgattgatatgcaaaagatgataacaaaaacctgtgttataaaaatatgaatctaatttttcgaagctgtgggcttttaagctgtgggcttttcgtacttttcgtacccgaggcgcaagacaattatatgtgtttttttatatatcccataggtttttagcttcccatacccaaaatatagctacaaataagctttttatatggttttataaggtttttatatgattttaccttcatatacaaggcaaaaaaacccaaggtacatcatgttgctgcataaaaacaccatgggtacatgaggcgccacgcctcagagcaaaaaacccagaaaaaagtccaaaaaatgcgcctttttggcgacttttggatttcctcaaggcgctgagcaaaaaagcgacaggccttgagccttgatgc

SEQ ID NO: 1235 - DNA, 551 bp, Ambrosia artemisiifolia
acactaaactcctaatctctctcccaatccatcaatggcatcaataaacttcaacccatttggcgaaaactggttcaagaaacccccaaacccattacaacccattaacctccacaatctttcagaatccttaaaccccttcaaaccccaccactccccctttgccgccatctcccttcccaacccatttgccaaaaaacccgatcctggacccgattctaaccgacccaaacccggaacttacaagaaaatgctcgaacagtattactgggaatgtgaaaaccgacccgattatcgccacactcctgaagttgaaaagatattgaatgaagacccgatttttgaaaagaaagataacccgacccgggaagagattgaagagaatgagaggtggttgaaggagtttagagagaacccggttgttaagtttttggcccgggccgaagaggttcttgatgagattaatgaaatggagcttaaggagaattccgaaccgtataggtattcgttattatagcttacgataccaaaaaaataataagaataagaat

SEQ ID NO: 1236 - DNA, 1241 bp, Ambrosia artemisiifolia
aaacttggttttcaatgaaatttataggtgggaggataagaagtattggaagtcgataccgcatgtgattgggccggatggtcggccgatgccaaggaaagctataaagactaagcaggaatcggatgataagttttgggattttgctaagcagttctttttcgggttgtggggatttcggcagcggccgtatcctccgggccggcccattgatgttgctcaggctgttgggtataaaagattggagaagagatattatgattgtgagtttcactaatttgttatattatgaatcttgtttatacaattttgaatgtttatgcttgaggttatgcatatcatattgataaatttggtactcaaagtagattagtaatggactaatggcttgatagaagatatatcttttctagaataaagaatgtaggacacaaagtgcttgtaaactagattatatttgcttatgaatttgcaaacgatagtgagtttagtgatttatcatttctaggatgaagaatgtaggacacaaaatgcttgtactctagtttattttcgtttctaaatttgcaaacttgtaaattatagtgtattttaagagttttggtattgccacaaaattctactgttaaatcattgatcaattgataataatgctatgtcgagaccattgtgaacttacattttggaagcagaaaaatgaattggacggtcattagttaatttttaagtttgaccttttactgaacactgatgtaggacctggttttgaaatgttgcttttgttatagttatcatgagatctagtggatggtactacaaggatcggataggaagaacaaggggaccttgtgaattgatacaacttaagactgcttggggtgcggggatcattgataaatatacttttatttggggtgaggatatggatgagtgggtcccaattggcatgatttatggtatggagcgtgcggtcgccacttgggaaggtttgcgcttaaactattttatttttccttgtaatctttggtagcgtttggtatgctggaattagagaagggatggaatgctccattccattggagagaaaaatatgtgtattttgtttgaatgagttatttgtttaagtaaccttacaatcaataccctgaagcaacaagttatcggataatttgattctgcttcttcatgttacgataatcactttgacaacggaagtccaacaacctccttacttttcgata

SEQ ID NO: 1237 - DNA, 1078 bp, Ambrosia trifida
ttgtggggatttcggcagcggccatatcctccaggccggcccattgacgttgctcaggctgttgggtataaacgattggagaagagatattatgattttatcatgagatcgggtggatggtactacaaagatcggataggaagaacaaggggaccttgtgaattgatacaacttaagaccgcttggggtgcagggatcattgataaatatacttttatttggggtgatgatatggatgagtgggtcccaattggcatgatttatggtatggagcgtgctgtcgccacttgggaagtgagactaggtgctgcagcaaccgctttccttcataaattacaaaagggtatacctccatgggtcccactaaaagggtttgagaaaaaaagccgtaagcagcttcaagatgaagcttatgaaagcaagaatcgtgatttagctgtactagaagctaatgatggaatttggcccggtgttagaattcccagtcatgctctgtttctttgggccagtgggtccgagctcacttcaattttggaacaagaccacatgcctaacaaatacatctccaaagatatgaggaaacagttgcaaaaagctattccagggttgaggccatgggaggttttaagtgtagaacaagccatggatcaaataacatatggcggtcaatggtaccgtgaaccacttggtgcatttactaccggcccaccatacatccggcactggaatgatgatgttgaggacttcattaacgcgtaccagcaattcacagacctgatgtgtgattatctagaagaagttatcccagggttcaacaaggtactggaaaaagtagatgcagaagctgaggagaaataccgaagacgaacggaaagcgggaagaggaagttagaagcaagaaagcgggccctccgcccacaaagagtcgatcccaatgccgacgaggatgatgctttatgaggttggttattgtggacagtttgcatcacataaattgtacctgggttcagtttttattgtatgatctggatttgttttgtcttctaatttgatcatgtagtcatttgtattcaagata

SEQ ID NO: 1238 - DNA, 296 bp, Ambrosia trifida
tttttttgcgctttgcgcctaggcttcaggcgaggcctatgcaccttgagtgcgccattgataactatggtcttgctttgaataggaataagaataaaaatcggtttttaatgaactttataggtgggaggataagaagtattggaagtccttaccgcatgtgattgggccggatggccggccgatgccaaggaaagctataaagacgaagcaggaatcggatgataagttttgggattttgctaaacagttctttttcgggttgtggggattccggcagcggccgtatcctccag

SEQ ID NO: 1239 - DNA, 1036 bp, Ambrosia trifida
ctttttgtttacattttttgaaagaggggttttttaaggatcaggttaaagattttgattttgatcatttgtgggggttaaactttggctaccggctagttttcccaaacgtatccaaaatattaaaatattaaaatagttagtataagcccaaatcaatgagtccatcaaacatcgacccaacaaaacaacccaatttaacatttcccccaaagcttcctatcttcttcttcttcaccatcatcatctccatcaaaacctcaccaatctctctccccatccatcaatggcatcaataaacttcaacccatttggcgaaaactggttcaagaaacccccaaacccattacaacccattaacctccacaatctttccgaatccttaaaccccttcaaaccccaccactccccctttgccgccatctcccttcctaacccattcgcaaaaaaatccgaacttggacccgattctaaccgacccaaacccggaacctacaagaaaatgctcgaacagtattactgggaatgtgaaaaccgacccgattatcgccacactcctgaagttgaaaagatattgaatgaagacccgatttttgaaaagaaagaaaacccgacccgggaagagattgaagagaatgagaggtggttgaaggagtttagagagaatccggttgttaagtttatggcccgggctgaggaggttcttgatgagattaatgaaatggagcttaaggagaattccgaaccttataggtattcgttattcgttattatagcttacgataccaaaaaaataacattagtcttgctcatagttattaaaagcctcgcttcatgcgtctaggacctttattatagcttacgatacactataggtattcgttattatagcttacaataccaaaagattgtaaaagaaatagtcttgctttgagtaggaatctatgcagttaatgcggtaaaaaaatcggatatcggtcaaggactggcatttgagatataggttatcatggtgggtcattggtaattttaatat

SEQ ID NO: 1240 - DNA, 389 bp, Ambrosia trifida
acatatggcggtcaatggtaccgtgaaccacttggtgcatttactaccggcccaccatacatccggcactggaatgatgatgttgaggtatctattttgttaaatttacaactttgataaatggtttatgtgtagttctttcatttgggtcgagttggtccgtcctgcaaacactttcttcttttgtagaagtttataaataatttgtgtttaatatgattacagaaccagggaacttgctgaggatgggtactctggtgttgaagtcaaggttacacctatgcgtactgagattataatttgagctacccgtacccaaaatgttcttggtaattttctgatatgttttaaacttgatttgaattagacattataactctttggtttat

SEQ ID NO: 1241 - DNA, 801 bp, Ambrosia trifida
atatggaatatagcattttagtgaattgacttatatgaaatttatcatttctaggatgaagaatgtaggacacaaaatgcttgtactctagtttatttttgtttctaaatttgcgaacttgtaaattatagtgcgtcttttaagagttttgaaatgtcgcttttgttatagttatcatgagatcgggtggatggtactacaaagatcggataggaagaacaaggggaccttgtgaattgatacaacttaagaccgcttggggtgcagggatcattgataaatatacttttatttggggtgatgatatggatgagtgggtcccaattggcatgatttatggtatggagcgtgctgtcgccacttgggaaggtttgcgcttaaactcttttatgttacaataatcactttgacaacacaagtccaaacagccgccgtacgtttcaatatttggattttaagtttaaattcaggtgtgctctttgttaaattacagtgagactaggtgctgcagcaaccgctttccttcataaattacaaaagggtatacctccatgggtcccactaaaagggtttgagaaaaaaagccgtaagcagcttcaagatgaagcttatgaaagcaagaatcgtgatttagctgtactagaagctaatgatggaatttggcccggtgttagaattcccagtcatgctctgtttctttgggccagtgggtccgagctcacttcaattttggaacaagaccacatgcctaacaaatacatctccaaagatatgaggtaatgtcacagtttttacaattta

SEQ ID NO: 1242 - DNA, 1467 bp, Chenopodium album
cgttaattcccctcttcttcttcctcttctctttcagtcacaccataaccagaaaacccagaaaactccataaccaaaacctccaaaaatggcttcaatcaacttaggtccatttggtgagcacttcttccactggttcgaaaaacctcctcacccaatttcattccccaattttctctctctatcaatctcccaaaaccctcctaaacccctcttctcttccctttctctttccgactcaaagaaaccaaaaccaaatgaagaaccctcaaaaccaggaaaataccaacaaatgcttgaacaattttggtgggaatgtgagaatttacccgatgttcgacacaccccagaagttgataacattttgaatgaagacccagtttttgaaaccaaagaaaacccaactccagaagaaattgaagagaataaaaaatggtgggaagaatttaggagtaacccattagttcaatttttagctagggctgaagaaattgctgatgcttataatgaatttgaggttaagaggaatgaaaagccttatagaagagaggatgctaagctttggaaggaagttcctaatgttattgggttagatggaaggccaatgcctaggaaagctataaaaactaaagatgaatcggatgataagttttgggattttgctaagcagttcttctttggtctctggggtttccggcagcgcccgtatccgccgagtagaccgattgatgttgctcaggctgttgggtataagcggctcgaaaagcggtattatgattttataatgaagactggtggctggttctacaaggatcgattgggtcgtacacgaggaccatgtgagctgattcaacttaagactgcttggggtgcaggcataattgataaaaatactttcatttggggagaggacctggatgagtgggcacctataggcatgatttatggcttagagcgagcaattgctacttgggaagtcaggtttggagcagctgctacagcatttctccataagcttcagaaaggaatgtctcctttggttccattaaaggggtttgaaaagaaaacctacaagcaactgcaagaggaggctatggaaagtaagaagcgtgatctagccgtacttaaagctaatgacggctattggcctggagtaagaactccaagtcatgctctctttctatgggctagtggttctgagcttacaacaatattggaagctgatcacatgccaaacaaatacataccaaaacatctaaggctgcaattggctaaagccatccctggtttaaggccctgggaggtaataagtgtagaacaagccatggaccaaattacatatggcagagaatggtatcgtgagcctcttggctcctacacaactggtcctccatatataaggcgttggaacagagatgttaagaggattttcaaggtgttcgaggacctgagtttccaggtatacaa

SEQ ID NO: 1243 - DNA, 1272 bp, Conyza canadensis
cgtatccgccgggcaggcccattgatgtttctcaggctgttgggtataagaggcttgagaaaagatattatgattttattatgaggtctggtggattttactacaaagaccggataggtcgaacaagaggaccctgtgaattgatacagcttaagaccgcatggggcgctggaattattgataaacatacttttatttggggcgaagacttggatgagtgggtcccaatcggtatgctttatggtatggagcgtgcaattgccacttgggaagtgagattgggtgctgcagccaccgctttcattcacaaactgcaaaagggtatacctccatgggcccccctaaaaggtttcgagaaaaaaagccttaagcaacttcaggatgaagcatatgaaagcaagaaacgggatttagctgtactagaagctaatgatgggatctggccgggcgtgagaatccctagtcatgctctgtttctttgggccagtggcgctgagctcacaacaattttggaacaagaccacatgcccaacaaatacataccgaaagatatgaggaaacagctgcaaaaagctattccagggttgaggccatgggaggtactaagtgtagaacaagccatggatcagataacttatggcggtgaatggtatcgtgaacctcttggtgcatatacaaccgggcctccatacattcaggattggaatgaagatgtcgaggacttcattgactcgtaccaacaattcactgaagtgatgtgtgagtttttggaagaagctattcctgggttcgacaaggtattggacaaggttgatgcagaagctgaggagaaatacagaagacggatggaaagcgggaagaaaaagattgaagcaataaagcgggctcgacgcccaaaacgagttgatcccgatgacgatgaagatgatctatgagctattatgtaattctctttctttcttatcaaagaaactgattttggaggttcacatcacgggctatcagctatattggtaggttatgtacctgataagtgcgttgtaactaggtctagatgttacattaatcctacttgtgttccatttttgttgtatggtttgaagttggtttcaaggaaattagcattatgtcttagctgggagatcgattacgtgaaaatgaattattaccaaatatttgtttgtcaagaatttgttgatatgataaggcaaaagagagaatgagcaaaaaaaaagaaaaaaaaacaaaacatgtcggccgcctcggtctcta

SEQ ID NO: 1244 - DNA, 761 bp, Conyza canadensis
agatgaagtatcagccatcatgagcatgatcagaaattaaatgttcttcttcctaatctttcccttgccacggtatttctttttgctgagtttgagcttctttttcatccttctacccatgggtttcaacgattttttggtttgttcatccatctccacatccatatcaccggtggtggtgatggcggcgggggcatcagaatccatggaagtggtggggggagtgcgaacagggagtttaggggcattaagagcagcttcaatggcagcatatttagcttcatcttttttctcataaataggttgaaccaactctctttttgattgacctcaatctcttttctcttttgcatctcattgactccgcctgctatcttcctcatctctcaaccaacaacttacagtcactaaaaatggcatcaattaatttcaacccatttggtgaaaactggttcaagaaacccccaaaccctttacaacccataaatttccaatctttaacagaatctttaaacccatttaaacccaattccaattccagcccatttgcagctatttccatttccaacccattcaagaaaaagcccgacccagaacccgaaagacccaaacccggaacttacaagaaaatgcttgaacagttctactgggaatctgaaaaccggcctgattatagacacacccctgaagttgaaaaggttttgaaagatgacccgttttttgaaatcaaagaaaacccgacccgagaagagattgaagag

SEQ ID NO: 1245 - DNA, 19170 bp, Conyza canadensis
cttacgttagaaaaagacataaattataaatcagttagaaaataatttaaactttaaatataatgatgtcataaatcaaaaagataaaaaagataaacttgatttaaataagtgtaatagtaacaagtaagcattatttaaaaaataatgatgtcataagaatcttattttatttatacaagagatactagattgtttgtgtatgacattcaattcttattattcttccaatatatatctatatacaaatactccgtagttcttagtttctttgtgtactaggatgtaaattgtaaacatttgcatctctactgtttagcaggatcataatatcccaactttaaacaacaagttttgttttatcaaaacggtaatatataaaaggtagagataaaaacgataatttttaaccctcgacaacaaccaaaattgtaattaacacttttacgagtatttattattgaaaaccacgtgtgggttttatgaaagggtggatgacacattgatagtttgacaccacaaatcatcacctacccagcacacatcaacacctaccctgatcaacaatttacaaaatctcattttataatttagtcgatatgtattcaaacctctcttactctgctcacaaaaaattatcccatccttatttttgcaacaaaatcattcaccaatatcattatgtcaatttcttttttgctatttgggccaaagtaaagaaaatggtttcccgttttgggttttttcgacagtaaacgaaattgtcgatgttgattttatgattattattgtttttgattcgtcaatgctcatccaattgtggagatattatttttccggcgccgtcgtcattttgcggccaccaccgtcatcagtctatctcagccacccacaacttaaatttgtttatgagattcgaatgatagatccaccccaaaccgctggtatatggtttaaagattgttggtggtggtgttttgtcattagttttatagatccagttcaggtggttatcgatggtggtggtcaaagtttttgaccgacagttttggttgtggtcaaggtagctggccggcggtggtgggctgaataattgaactggtatatggttgaaggaaattgaagggttacaagtaaaaaaaagagagagaaggttgtggccaaagttaaaaactcaaaagtttctgtggtaataattgaaagatataaaaatttaaagtttatagggaaaaaaataaaaataaaattactacagtgcttagctacagtagccttagctaaagtgaaagctctcacagccgccttttcgtgaattgttatatatataatttcgcaggttgagtttgtcctgcaaaaatccttaagcacactgggggatgtgaatttatcaactgcatacaacgatgtacttatgaaatgttaacaactaaaaattcaaacgttaattaaacgcatatatttccactaagatttcagataattagcacaaagctgatttttagctttagatcactaccatcgtacttgaataagagtcaacaaatcgttgtcaaatctagaatcaatatgttatagtaacttatgagtttacataagctagaagttatagttgaacggtatggaggagtgcctgttttcaccacgatagcaaacgctggagtttctctctttgacagaattagcctcgagtacatgttgctcacaagctttcggtctgttttgtccattgtaggctttgcaaacgtatgcagcaaaatttgggtaatcctgcagcatataatttcggttacttgttaattaattagtacaatcttatactaccatgatcatataataaaagttttttatagcagactttagttggtttattcttccatatatatatatgccaattttcggcgaaatgaggtacagtagttgaacagagaatttacctcttgaagtgggttgttattgaccagaacccatggtacaaatctatgaggtggtttcagttggtttgtctcctcagcaaactttagctcaagctgcattattatatatatcgcaccacaacatgaataaatatggatgcacacgaaatttcaaactatgatcgataagcaaattttaaatttaaatatacgtgaatatttatggcatacgtgttttcctacaagaaatggtacaacttttttgcatttgagggaattttaaaatagtgttgccagaatagctgcatcttaacataaccattaagttttcttctagtgatgagaggtgtcgatctactacatcaattagttgtattaatgaatgagtgacaacacatgacctaacattttcatccatacactatcaaatcatattgtgtgtcatcatatatatgatatatatacaacttcattatataaaatttgatgatatattagataaaaaatggtaaggtactagcatttatagtagcggcgtcatcctttttaaagctggtgttttctgtcaccaactcaccaccatgtgagcattttaaatggtggacaaagcatacagcatcacatggaaaaagttttaaaaaagagatacacactactataaagtaaaaggatatataagaatagatgtacttacatcaaagccctgtttagtttgatgacaatccatgatgggttttgggttcacttttagtaagcccatacaagatttccattcattatgccttccttccaaattcaagttttcaatgcactcaatcaacttaaacccttgtccctgttaaaaaatatatatatgaattaaaattaggcctggcaaagtggacaggtcgggcgggtttggataacgggtcaaagcaggtgcgggtcaaaacaggtgcgagtttaagcgggtcacttaagaaatgcgggtcaaaacgggtttgggatataggatataggcattctgaaagtttcagaaaaaactcagatatattcacaccttatagggttagcattatgcaataagccaatatcaagaaaaaataggtttacaaaacgagaatatcatttagaccacctacatcagaactagacatttgacatatcgagtaaccggaacatgaatcttaacattttactaataaaaaagaagtcgataatgaaggtcctagttgattttactatgacaacaacttcaaatatgaatttgtttttgttttttagacacgaaaggatcgacagagtaatataaatggatgcactatcatatatcattaagactatagaaatacattattacaaaacaaaagattactgtagtatatcacgtatttggcacttcttaacttttgtcagctgatgcacgtggcttccatgtgggtatcttgatgggggttgtgtaattaagaatgaaaaatcagttacattttgattacgagtattatgttggcttaatgaaaatttaatattgatgcgttattgattatgttagcttaaaaaggtgtattaaaatataatgattgtatttaagaggttttttttttttttttaaagtcatcaacgacggctaaatgactaagacgtctcagtgcactgattcgagccttaataacaccctaaagggtttgctctacatgtgttgaatgggtatagtgttgataagactcattcaccacatttgcatgtggctagattcgaacctgagacctaaaaaaaaacatattgtgaaataaaccgctagtgtaacactctaatggcgattgtatttaagagttatacatgatattatgtacaaaatatatataagaaaagaatatagttttactttaaaattcgacagcaatattctacttttatttattatagttagatagattaatagatagatgtaacgtgataacacacttaatatactattggtatgaatattatttctttaagtatatttgtcttgtcttaattagtatcgtttcaatctggatatctggaatggtaatgagactcacttttgttagttcgcaatacttgaaactatgggactgaaaataatatcgaatgagaaatgagaccgaaattaatatcaatttttagaaaaattccaagagtaaaatatggtataatgataagatgccctgaaagcctgaaccaaattacacactagtattttattttttcattttgacattatacttttgatttgctacttttttataaagtttttaaaaagattaatctattttgttatcattaaattgaattcatggttctggtttaatttggaaaatctgacaaatacttggaacaataaacctttaaatggaatgtaaaacagtaaaagtcataattagataccagtaactacttgtaattcttgaacgtacggttacgcaatttacaaaaaagtcttatactaaccaaaaatattaaatgttgccagcattattttttaatgggatagaattcaacagtgaaaaaatgaaactgaaatccatatgctttactagaattagtctacaacttaaatcgtacgtacctgttgaggcaacaactcgattgcacaagcttctgctacgtcaatcgaacattcatcagggccatgctgcaaaattgataatataagtttgtttatatcacgttcaattgttaaaaggacagattagttattttaaaccatttggtaaaataatctatgtacaaaggtgacatataatacaagtaatataaacattacatatatatatatatatctaagccttttgttatagttttatactccacgattttctcatatcaataattgaaaaatccaaaagactggattcttttatccataaatatttaaatgttatccatctatgttaattgatggatcatcatcacatgttcaaaacattacaatgtacaacatgtattaaaagatgtagtacttacttgacaaatccaagcattgttaggggctaattgtgtattaccccaagggaccatcttaaggtctacaatagagactagattgtcttgaaacaatgctttcccaagttgattcacaatgaaatctgaacaatatggacataaagcttcatagtacaatgctacactcactttctccttaacacaatatgattttgccattgtcaatatgaagaacaatataagcatcttataagaagaggccatagtttttctttgatagtgtttgagaattatctaatacaagaatttcttgcctttatatagaagtggatcttactttgtttcatatttagctttcttgggtcaaacacttttttgtgggtgatgaaataattggggtatggtgtaaagttcagcttttcaaacatattgtataagttttaattgcataaaagtatgtcaactagataaggtacgcaatttttgtgggtaaataatggttgggatttgctaactagtgcacggggcactagttaagaagcatttaataaagtccaacttttattaaatatgaaaatatgtattaattattgatttaaaattaaaaattgttaaattgaattaatacacattaaatacaatttttatttaataagaaaataacatgtttattaaatattttttaactagtacactaaggacactaattaggcaaatcccataatggtttggcagtaaatatttggtaaaactttttttttattttttctgttctttaatgtgtttgaatgagtcaacagaatttatatcgcatttattttatttgttacttcattccgatagaatattttgtgaccactttgaaaaaaaaaattaaaaaaataaaaatcgtaagtttttattatcaaaactcccattataatggaatgtttttttcttgatcgagtccacattgtgtaaactaaaaatgtactcagcaacgtatggtgtggcttaagttttaatttttaaaaggaaaatgtgtttttgtaatgttcataatattctttaacttcacacggtatatgcatcaaaaaatgatggtgataagccaccataggttttaaactgtataataattaaagggtaaataaaaatgtgtgttattattgctagagtattaaaaattaaagttgattatgcaaatttatatatataaacaatataacattaaatgataagataaaaaaaaacgaatccttcaaaagttaaaaacccacaaatttgtcactgtagaactgttaatgcataaggagcatccaacatgttgtaccatcatcacaagtgttgtgtcgaaagagcgctaaaaactattgcactatttttcgttttttgtggcgcctaatcacacaatacatgtgtttagactttagatataaaaaacttgtaccgttatgcaaattacatgtaaacttcaaagatacttaaaataattaaaataatatggcctataaaggctgtttatacgtcaacaaaaaacgttttctttataaggatacattgataattctaaaacaaccaagtcaaataaataagagttaaagggcggtagttgtgtagtcattcccatttacttaccaacatacgttgcgaaatagttcggtaataaagtgataaatattagcatattagtggttttttcttttcagatatataatcaggaattttggtaagtgttttcaaaaaactttttatgtttaattattacaagatgttttataaatatggttccaataaattataactaataaaaagcatacatgcgcgttgtgatgtcagtggccgcccaatcaaatcggaggcctaaatcaagtacttattattggagcatttttcaagtaacaaaattattgatattttgaatagagtttatttcaaacactaacttaaaataataaatcactcctaattgatagaattgttatttcatttaatctttgcataagttgagtttttaaaaatttgtatccgccgaaacaactatcacctaattgataaaaattaagttctaattctcattactacatagttacatgcataactagaaaaatatgaggttttcggatacttgggcctaaagcccttgcttcatttgctttacccttgagccactactatgtgatgtcgacgggtgttggcggtgggtgtcggcggtggtgacaacgagtggtaccgatagtcgtggcgtcgggtagtttggggcaacagtggtggtggcggtggcggtggttgtgtagtgatatagttatttacaattgagtaatttatgttatagataaaatatatcattaaaagtattataaatatattatgtgagaatatttaaattattaaataaagataaaaataatataaagacgtttaaatattgcttccttttcctattctagatctttatatttaactaaattaagtttttaatgaaaatgaataaaatggtttttggctataatatatgactacttgagctttaaaggtagttgtatacttgtatgtacaaaaattattatcttagaaatttacaattattttcatttatataatttaaactaataattaaatttcaaaagtaaacatttagagtatgataattaacaacaaaaaaaataaaagtaagatcaaatgccgttaaaaaaaataaataaaaaacacaaaaaatgattaacattaacatttaacgatgaaaagatctaggattgcacgtttgccttttatttttattttaattactatatctatcaatgaaatctagttgaaaatgaagggagtagttcaccacatcgatggtgttttgcaatgacatttaaaaagttacgagtatttatttagcacgttatataatgatgtgaagtttaaagtagaggtgtaaaaactagttaaccagttttggttaattattttagtaatcgtattcgtttttttttataaaaaattaaccaatttcggttaaccggtaccgttaataaccggttactatgtatggaagttctaactggtggacccgatttcggttttaaataatcggttaactgcttctgattaactgaccagttaaccggaaatccacattagcagaattcctaaacgaaacagaacagaaccagaaacaaacaaattaagcaggaacagaaccaaaactaattaagcagaattccaaaacgaaacagaacaaaaccagaaacaggacagttccaaaactaattaaccaggaacataacagagtgtttaacagtagccaaaagtccaaaactaattaagcagtagccaaaactaattaagcaggacaggactaattatatgtattaaacaaacagaaccacaacagaacagaaccagaaacaagaaccagaaacaaaacagaaacataaattaagcaggaacacaaacagaaacaacagctaacattaagcagcaacacaaacagcaataggagcaacatcaactacattgaattgggagagtgggagactggggattgatcgatcgattgatttattggggattgaattggggtttttttggatttggggattgaattgggaattgatcgatcaatttggagagtgggagactaggagagtagatcggtgattcggtggctaactaaatattctaaaataataaattaaggtaccaattaatctttatatttaaaaaaaaaataaccggttttcgattaaccgattaagaatcggtttttgtttttgaaagttcaaatcgattactaacctgcggtttttcctaatctataatcgatttgtacggtatcggttactaactggtttcggttataggttaactttcgaatcggttcagttaaccggtttttttgtgcacctctagtgtaaagtgtcatatttttaagttttacacaaagacaatgaggcttagtttagatgttaagtggattattgatagcttatcttatagggctttgaactaaaaaagttggcccaaatcagtgacccatcaacccgtttacccatttcattgatttgtaaattcccccagaaacaaacaccatcaaacctcactactccgcctgctatcttcctcatctctcaaccaacaacttacagtcactaaaaatggcatcaattaatttcaacccatttggtgaaaactggttcaagaaacccccaaaccctttacaacccataaatttccaatctttaacagaatctttaaacccatttaaacccaattccaattccagcccatttgcagctatttccatttccaacccattcaagaaaaagcccgacccagaacccgaaagacccaaacccggaacttacaagaaaatgcttgaacagttctactgggaatctgaaaaccggcctgattatagacacacccctgaagttgaaaaggttttgaaagatgacccgttttttgaaatcaaagaaaacccgacccgagaagagattgaagagaatgagagatggttaaaggagtttagagaaaacccagttgtgaaatttttggtccgggcagaggaagttgcagatgagctaaatgacatggaacttaaggcgaattcggaaccgtatcgatgggaggataaaaagtattggaaatccataccacatgtgattggcccagatggtagacctatggttaggaaagctataaagactaagaaagaatctgatgataagttttgggattttgctaagcagttttttttcgggttgtggggttttaggcaacgcccgtatccgccgggcaggcccattgatgtttctcaggctgttgggtataagaggcttgagaaaagatattatgattgtaagtttttgtatatatgtttgttatatcgtaaattgtgtgtatgcatagaaattgtatatattgtgtactataagacttattatctttaggttctgccatgagatatataggtagaagtatttagataaaatgtagtgaatacggtgatggactttgttgaatcgacattgtccaattagaatgaatcttgtacgttcgagacaaagttgtgtcaagtttaaatgaaatttataaggttaagcttcgagttgaaatatatctgctaatgaatgataatcagtgcttacgcttattgcatattttgaaagctgaaatgtgggttttaggtgttttagcttatttttacactaaaaaaagtatgtatatttaaggaccgtggctgtgtcttatcttgaatgcgataagcacttacaaataagcaaacccaagcatcatcatacgagtgtcttaggtaggtataggatggagtggtcatgatcagagaaaatgaagatcaagttttttaaacagcttgaacgatttgcgtgtgaaaacaatcatgaactcgtcttttaagaatgaagaatgtaagatacaaaatgcttgtacagtcgtacaatgcactttttgctgacgagtttctgaaatttgccgaaatgtgcttcattttgtccactttagcaaataagcattgcaaaaatttaaaaaaaaaaacaagaatggctgaattccaatcgcattcggaagttaagaggtgttatgctatctgaaataagcctctcctgagacctttataataatatatattggaagaaaaacacatggcttgaataggatgagtcagtatcaaatttttacctatttgattttgacaaccgagttttgagatattccttttgttctagttatcatgaggtctggtggattttactacaaagaccggataggtcgaacaagaggaccctgtgaattgatacagcttaagaccgcatggggcgctggaattattgataaacatacttttatttggggcgaagacttggatgagtgggtcccaatcggtatgctttatggtatggagcgtgcaattgccacttgggaaggtttgtctctgtgtccccttaaaccattaaatacctccttgcaatgtctttccatatcttgctttttgtaagagctttttctttttatttttgcactaaacggtcgatgaagtggactcgccgagcattgaaagttcataatatatttatgtggcctttggattgtgcatttaaaatgatatttaagctttagataatcattaaaggagtagtgaaataaatgttgaaatctatgcgactatcattcactttaagcgactgattttctgcctatttggtttgattattgaagttttagtcacccctccaaacattctctttactttttaaatgatatttgtagtgcatagtgagataagttcatatgaaatgatagtttgctagggttgtagcatcatatattgtgcacagcggatttgaataatcatgaaagtcggcttaggagctaattagaggtggaaaaatgggcaggctgggtaatgggtgtgtatgtgttccggtcacaacagttggtttttcaggcgcatctgcaaacatttttttttatccaatttcagtaacatctgttagtagttaattcgttgaatgaggttacaaaagcatgttattctgattacatacaatccagccatttatctaaggaagcaatttaagaggtttatgtaattgaaatactattgatgacttttcacccatttgaacagttttgtttttacttcaattttctagcttaacctgttagagataaatttaaccaaatcaaccaaatttataggtgtatgggtcaaaattgtcatctctagatctaataaaaacccgaactcggtattctttcgtgctattatttgatttatgcaagtcgaccacaaggtgaaatttctatgctgacttagtttaattgtcagtgagattgggtgctgcagccaccgctttcattcacaaactgcaaaagggtatacctccatgggcccccctaaaaggtttcgagaaaaaaagccttaagcaacttcaggatgaagcatatgaaagcaagaaacgggatttagctgtactagaagctaatgatgggatctggccgggcgtgagaatccctagtcatgctctgtttctttgggccagtggcgctgagctcacaacaattttggaacaagaccacatgcccaacaaatacataccgaaagatatgaggtaatgccattgttttgcatggtttgattgcatccgaggtggcaagatgggtgggttgagccattgggtatcaatttaaacttatcttatccaataaatgttaacagttggtgtgtaagatatgattacaagttgtattataatatgataatattcttattagagatacaagttataagatggcttgggtggttttatacattgaaagacactttgggcgagttttcattcattctattttcttttcagttttattttcattttaccagttttaccaggtagagataaaaaacctgaatatcgtgaaatggatcagcattgccacctcaagtttctttgcatgcacacggaaaatttgtttttccttatttgccgtcatgttttcagatgtcaatacaactagtattctctatcgcttgcttctgttaatgagaatcatagatatgagctacaaatattcaaattctttgcttcaatcttacatattaaccgatattatctcccttaacactttaagttttcatgtgaaaagtgttttacaaaagttaatcagctgtggtagggcaatagatagcagtaggctacacttcagttctttagtcactgaagttcagaaatcattactaaaaccactgtaccgttattcttaaggctaattatgttcaaaaaaacctgaaacattagtaagggtgggtttatcttgtcattgtttataaagatcatttgttaactaatgctattctaaatttctaatctaaaatggagtggcatggtctttttgtacatgttaaaatctgtttctttacgaagtctttcttttttctatggagaacaggaaacagctgcaaaaagctattccagggttgaggccatgggaggtactaagtgtagaacaagccatggatcagataacttatggcggtgaatggtatcgtgaacctcttggtgcatatacaaccgggcctccatacattcaggattggaatgaagatgtcgaggtatttaatagtcttcacagttgttttgaatcttttagacaatgttataccctgtctggaaaaacctgttgaatttacaactttgaatgagactgaatgaccggtcaggtaatggatcaaaaatggtagtttttcagattggttcgtggtgggttggtccaacctgcaaagaccatttttctcatttccaaactgatgcataactaatgtttaattctgatcaacaagttatgtcatttgaataatatccgaagggatatctttttgctattgaccaatgtagaaggttttgtgtatttgaatacatgtcaaatgactttggacctgttttacatgtttcttttcttcgttaaatcatttaacctacctcatttggcccggtagagatgatacaatcagtaacttttgttggcaaaataggaattgaaaaatctactcttcatccaatcttttaatgaaagatcagcaatataggaaaacatcgaattacttcgtatttatatagtccggaaacagtcggggggtttagtgtttagggcacaaggtcagttatctttaaccatatattgggaatagtacggacctgtaagaatgattttaaccttgctagaataatgtaatatcaaaatacaaaagaaactttgtacaaagacccacatgcgtgtccatagtatatagaggtgagaattacaatcccattcacctataagtggtaacttcgggctgtaatatatatatatatatgtatgtattcgatctgtaaagttttgaaatgtatctataatgaaaacgggtcaactcgttcaaaagagttaaaattactcaaaagggttttcacttgcttaattctgtaccttctaaacactttatcttaaatattcattttatattgacaaagtttttttttgtaatcataattaatagagtaactcaaaagtgttacatgttttgaccagaacccgagtggtgagaatatgagtagtttattagcgaactacaaaagagaccagacatgtcatagtcttaacaagattatattctattttactcaatctaatgtaatgtattattgcttagtcttaagaaccgccacatagtattgacaggccagcccgacccggcctgttttgaaaagtgatcaattttgacccgttatcacattgctacatctttagtactcggtaaatggtttccatctacatctagttttcttgtttgactatttcaggacttcattgactcgtaccaacaattcactgaagtgatgtgtgagtttttggaagaagctattcctgggttcgacaaggtattggacaaggttgatgcagaagctgaggagaaatacagaagacggatggaaagcgggaagaaaaagattgaagcaataaagcgggctcgacgcccaaaacgagttgatcccgatgacgatgaagatgatctatgagctattatgtaattctctttctttcttatcaaagaaactgattttggaggttcacatcacgggctatcagctatattggtaggttatgtacctgataagtgcgttgtaactaggtctagatgttacattaatcctacttgtgttccatttttgttgtatggtttgaagttggtttcaaggaaattagcattatgtcttagctgggagatcgattacgtgaaaatgaattattaccaaatatttgtttgtcaagaatttgttgatatgataaggcaaaagagagaatgagcaaaagaacatgaataaacataaagttctcagatcatcctcattcacaacccaaccaactaatattagtcattaagaaactaatttttctctcttatatttagggctgtaaacgaactaaacagttcacgaacagttcatgaactgttcggcgggaagttcgttcgtgttcgtttgcgaacatgaacaaaactctcattcgttcgtttacgttcgtgaacattcgataatttgttcgtgaacgttcgttcgtttctgttcatgaatctgttcgtgaacgttcgttcgtttctgttcatgaatcgtcgttcgtgaacaatagtttgtttatgttcgtgaacatttgttccttatgtttatttacaaacataaatatttactttatataacatctatatatattattaatacctaactatttaagaaaaagtttaaataaatacatttaatttataaatatttcgttcgtttatgttcgttcattagtgttcgttcgtttgtgttcgtgaacagtccttcatgaacacaaacgaacgaacatgaacaagtcattttgttcgtttatttgttcgtgaaccgttcgttaagttaaacgaacgaacatgaacaaggtcttgttcgtgttcgttcggttcgtttacaaccctacttatatttgaccaacccaactaaatctaacttttacaccccattcacaactcacccaaactatatttttaataaataataatgttatataattaacatttcatatattcaaagttagttaaaaaaagaaagataaaaaacatttttttatataaaaattaaggtatttatcatcaacaataaaatatattaattggattataaaaatatttcactttcattatacatatttaacaaaataaataaattattttatatataaatataaattaaatgatatacttagaaggtaaaaaactgagaaaaacaactacatcataatcaattagtcatttcattgcaagtaactttacctacaaacaaattactatatatcaaaaatcaaacgataaaaagtactcgtaaaacataaaagtttgcagaattacagtaacttcattttaagagtacattgtaaattgaaatgtcacgttggaagttatagcaaaggcaccatcgtcatcatataaaaaaaatatacgtgtaccaaatatatacaatgtagtctacagtcggttaatcgaacgggtggatcggatattacatggtccccaccataaacttcccactatcttcaaccaaccgaaacaaaaaaactatccatggtcttatgaagctttcaatatttaaaaactctataaatatttattgaaattgtagttatagctatcatattaaatatttttgaaaaataaaagctttaactaaaagttttgtataaaaaatagagctacgattaaaagctacaaaatataactacaagttacaattaattttttcaaatatatccataataactttgatgattattttgtttcattagttggtttaatttaggattttatttaaaaagtatgttcatagttatctacttatctatcattatactaaaagtctaaaacatgattgaagggtcttgaaacaaggtgacataacttttaatcaacacgttttttttttttgttagcattatgttttaaaaatagtaaactactaatactagctaaaaagacgtaaccaaactatgtttttaattattttatcctttaaattaactaatattatcttaccttattttttttatcagagtgttagttggttagtggttcaaattcttacagtgacataagataattgacctaatagttattgactaatcacaactctcaattttcaaaatgaattaaattaccatatgtttaaattaatttacattttttttattttttatcatcaatttacattttaacctaacgctaaatacttaatactttattgcataatggacatatctgtatcctaatatagatataaatatagatatagatatatactttttatgtaaactattttttaataaaagtgttatccataaagccaccgaccactcacacgtccattaatcggcgtgtcctccgcaacatcattcgcacgtgatagttaaaattgtactatattttctattaagaggggaaaaaaacaaagaaatggaatcaaatatgaaacattaaaagttagtcaagcacctcgcgaacaaaatccattgaaccgacaaaaactttaagatatgcaattttttaatgcaaggtatatatctttcttagaatacatgaatatttggatttgaagttgtttaagttttctttttctatctttattgagtatataaaaaaaatcatataattaagttttatgtcattttctttctttcccatgacactactattggctttatcttatcatcaaagactatttcaaaacgctttattgataataagatattacatataagtttaggatgacaaggcaaatactagtctttttattatataccaacatatactttttctgcttatatatatgtgtgtgcaagtgagaagataagagaatagataacactattgcttttgaacaagagtaccattagactcttaaaagttaaacttgctagctttttctcagattcttaaggttaattttcaaaagaaattaagttatggaagatagtatgatagataggccaagtatggcatttgatgagaaagtaaatattattggcaacaagagagatagaaatggtgatgaagaaatcgttttgggaaggctagaaaagaggccaagtggaattttaggtgttgatgaagaaggaaaacaaaataatggtggtattattgacactttcatttcaaatgtgtttcacaataagaataatgaaagtgttactacaaaagaagaatgtgaagtagtcgaagacaaaggagacagtttaggtgtcgatgagaatgtcgaaaatggtggtcgtgaaggaggaggagaaggtggagtcgtcgtcatcaaagatttcttttcaaacatatttcaacgtaatggaaatgatgataacattaatgaagcaaaaaatgatcctgttaacgaagttgtggacaaaaaggaagacgaggtaggtactatatatattgatggcaacttcgaaaatggtggtggtgaagaactaaaggatcttaataatgctgaaaagctagtcgagaagcacgatgtagtagtagggtctgatcatttgcctagtaaagatcttgaagcaggtatatatttcatttctatattcccttaattatataaatcaattcgttattcttgatattatattttatgatgtatatatatatgtacaacaataattaatgtaacaggaaacaagtcgaaaatgaagccagatgattattccgaaagagtatttttcttgaacaacaattgatcgaattaagtagaacgcaactaattaatgaccatatatattcgacctatgtgggaagcttcgaaggagtccaacaatatccaagagctagcttgttgtttatcaaagagacttcgatacgacagtttggtagttttaagttttcatatatgtaatttgtactaatcacacaatagacttataattagttcctgtaatccgcgctatatgtacgttctttgtctttcaaaagatttacctaatggatgagatttaattagatattgttaattttaagatataaagttgtgtaatttgaactttataaactttttaattatgaaatgatgaatgctattaagtttctattctacaacacaatgtatcagttatatatataaaattggaaatgatttacactttttatatctgttttattatagagtgacttaaatgtttcaattatcaattatttacgaaattattgaccatcagctaccaaaaaaaacaacaacaaaatttttttgtctcaattatcgttttaactaaatatataactcattttatattgaaaaataatttggatctcactaaaatacaactgaaagtagaatataagataattatatataccgtagctatattaacttaaatggattgatgaacagtaaaagtgaatgaacagtaacacccgatcattataataaatgatacatggaggagaatcaaaagcatttttagaagaagtggtggaggcactggctttgtagagggagctcctcagttcgagttgtagatccaaatcttcttttgttattttcttaaggtctttaatacgagtgactaagttattgtacacttgacactcctaattccttttaatatgagtaactaagttgttgcacactttttttttttttaacggcaagttgttgtacacttggcactccatacgatacgccttttcttattttctttaattttttgattatttttatttggttaataatagattaattaatagatgctatagggtgtgtgtgggggggtgggg

SEQ ID NO: 1246 - DNA, 890 bp, Digitaria sanguinalis
ttgggattttgctaagcagttcttttttgggctgtggggatttcggcagcgaccgtatcctcccggccggcccattgatgttgctcaggctgttgggtataagagactggagaagagatattatgattttatcatgagatctggtggatggtactacaaggatcggataggaagaacaaggggaccttgtgaattgatacaacttaagaccgcttggggtgcggggatcattgataagtatacttttatttggggtgatgatatggatgagtgggtcccaattggcatgatttatggtatggagcgtgctgtcgccacttgggaagtgagactaggtgctgcagcaaccgctttcattcataaattacagaagggtatacctccatgggtcccactaaaagggtttgagaaaaaaagccttaaacagctacaagatgaagcttatgaaagcaagcaacgtgatttagctgtactagaagcgaatgatggaatttggcccggtgttagaattcccagtcatgctctatttttttgggctagtgggtccgagctcacttcaattttggaacaagatcacatgcctaacaaatacatccccaaagatatgaggaaacagttgcaaaaagctattccagggttgaggccatgggaggttttaagtgtagaacaagccatggatcaaataacatatggcggtcaatggtaccgtgaaccacttggtttatatacaacagggccaccatacatccgggactggaatgatgatgttgaggacttccttgactcataccagcaattcacagatctgatgtgtgattatctagaggaagttatcccggggttcaacaaggtactggataaagtagatgcagaagctgaggagaaatacc

SEQ ID NO: 1247 - DNA, 270 bp, Digitaria sanguinalis
aatgtccaatttccgacctgaaaatcgggtctgacatttaatgtagttcctgtctgcccttgaaacattcaaatttgcttacaccccttcccttcttgggtgacaaattccattttggagaaattaaactttgttcagttcccattaacggtctaaatcctttctgaacagttataatgaagactggtggctggtactacaaggatggtttgggtggtagagggggacaatgtgacctcattctgctgaaaacagcctagggtggtggta

SEQ ID NO: 1248 - DNA, 324 bp, Digitaria sanguinalis
agaaaaccctacgcccgaagaaattgaagagaataatcaatggtgggaggagtttcggaacaacccagttgctcagtttatggaaagggcagaggagattactgatacgctgaatgagatggagcttaaggagaatgagaacccttataggagagaagatcggaagctgtggaaggttgttcctcttgttaatgcgttggatgggaggccaatgcccagaaaagctatccagtctaagtgggaatctgatgacaagttttgggatttttgtaggcagttcttctttggactttggggtttcaggcaacgaccttacccccctgg

SEQ ID NO: 1249 - DNA, 1765 bp, Euphorbia heterophylla
cggcattttgagtttatcgtcactcctatcctctcctccttgctgttcttctgaaaaagcttggtgcacagcttctgccctaatttctcaatctttagttatggcatctatcaatttcaatttcttcgacaattggtttaataaacccccaaacacacggcctcctattaaccttctccctcttattaactccttatccactaaaacatctcgtcctactagttttgcttccattagctcctccctattcaattctaaaaaacccgaaccccaatccgaagaatccaaagagccgggctattggcagcaaatgctggaccagttcttctatgaacacgaaaaccttccagattatcgccatgctccagaagttgagaagattctaaacgagcacccctatttagagaaaaaggaaaacccaactgaggaggaaatccaagagaacaagaaaatgtgggatgagctcaagtcgagccctgtggttcagtttttgctccgtgctgaagaaattgctgataccatcaatgaaatggaggtcctagaaaacatgcttccatatcgttgggaggataggaacatgtggctaaatgtacctaatgtgattggaccagacggtcggccaatgcctaggaaggcgataaagtcgaacaaagagagtgatgataagttttgggattttactaagcagttcttttttgggctttggggttttagacagagaccatacccatctagcagacctatcgatgttgctcaagctattggctataagcaactagagaaccgatactacgactttatcatgagaagtggcggatggtactataaggatcggttggggagaacacgaggacccatggagcttatacagcttaaaactgcttggggtggtgggattattgataaggacactttcatatggggtgaagatatggatgaatgggcacccatacatatgatttatggcatggaacgcgctgttgccacttgggaagttaggcttggtgcggctgcaacagctttccttcataaacttcagaaaggaattcctccgtgggttcctttgaaaggacgtgagaagaaaactaacaagcagttgcaacaagaggccatagagagcaaaaaacgtgacttggcggttctacaagctaatgatggcgtgtggcctggggtaagaatacccagtcatgccttatttctgtgggcaagtggttcggaattgactactactatagaagcagaccatatgccaaacaaatacattccaaaagatctcaggtaccgattggctaagattatcccagacttgaggccgtgggaggttttaagtatcgagcaagcaatggattatttgactttcggtggaaagtggtatagggagcctcttggttcattcacaactggacccccatacatcaggcattggaacaaggatgtcatgagattattccagttatacacggaagtgagttacagtttataccagaaactaatggattcgattccgggttttgataaagtcatggagaaagttagggccgatgctgaggctgaagaaggcaagcgtgaacaaaaggagcccaacaagaaatggtttaattttaaatttttgaccaaatagtcaccgaattctctagttttgcccgaaatggtgtgcttatgagctttattttctttaaggttctctagagttggtagagattactatcccttgtaagacgtttgtaccgaataccaatcgtgaatttttgtttaggcagatggt

SEQ ID NO: 1250 - DNA, 1711 bp, Euphorbia heterophylla
  unsure (1)..(1711): unsure at all n locations
acacttgaaagttcagggggtaaatatagccctttttgaacaagttctgggagggttttcatgtattaggcctactatgtttttgctttcttagagtagtgataaatgataacgtgatttgggattttcaatccacctctcgaagtatactctgttagtgaaaaagaattaccgccttgaaagataacatagttgtacgttatagctagctcatctttcctagtttcatttaacaaggctaataggcacaaaattccatcattgaacatttcattcatatgaagcttgtttagcattattatttttttcaacttggaattttggttatgtgcagttaggcttggtgcggctgcaacagctttccttcataaacttcagaaaggaattcctccgtgggttcctttgaaaggacgtgagaagaaaactaacaagcagttgcaacaagaggccatagagagcaaaaaacgtgacttggcggttctacaagctaatgatggcgtgtggcctggggtaagaatacccagtcatgccttatttctgtgggcaagtggttcggaattgactactactatagaagcagaccatatgccaaacaaatacattccaaaagatctcaggtatttttattctagcctccagaatttaagttgttcaatagtgttgctaaaggcacgcctcgaatagggtggtgctcgccttttggtgtgtgccgctatgcgccctaggtttgccttggggacactttttttggggtttgaacttagggcgaaattcaaaaacataccatgtggtttcggccaatttcaaaaagacacctgtggtttttttgttttcgaaacgaggactggttgaaaaagttagcaaaaataggattttttcaagacggcgtcaaaatcgctgatgtgacaaggggtaaaattggaaatcatttattttgccggaaaaaaatgcagggacccctttcttcatctctctccatttggattcaagatttctaaaataagtcttcatgcttaatcatggattcaagtttgcagcaaattacaagtacctttaaaattaggctaaacttcaaaaacaatgccttgtggtttggccattttgcaaaaaggtccttgtggaattcttttttcaaaatggtgtccgtggtttcaaaagttggcaaaaacatgctnnncaaaattttgaaaccatatttggaatggtaatatcaggtatttcactaaattcaacatttctatatttaaactatattatttgtaaattatttatnnnnntttgagtaaattttggaaaattttcatgatatgattttttaaagttatcggcaatatttaatttatttgtacttttcaaataattctataatttatcagtaaagtttattgtatttttataatcaaagctacaaaatatcacttcaagatggacaagattacccttccaaatatggtttcaaaattttgaaaaacatgtttttgctaacttttgaaaccagatacacccttttggaaaaaaaattccacaaggacctttttacaaaacggtcaaannnnnnnnnnnnnnttttaagtttacccttaaaattactagggattctaggttcctaaattaaatctttatgcttgatcatggattcaagattcgaatttgcaacaaattggaacttttgcaaaattcaaaactagggatggcaatggaccggattgga

SEQ ID NO: 1251 - DNA, 1501 bp, Euphorbia heterophylla
tattcctaatgcaatatataaattttgcacacatatgtacatctaacaagtatcttacttctttttatggtattgttattgttaacttgcaattttttttgtgcttcgccccgccttgacaactatgtgtttgatatatgtatatacaattcaggtttaatgcattgaatgtattgaactggttttgtcaggtaccgattggctaagattatcccagacttgaggccgtgggaggttttaagtatcgagcaagcaatggattatttgactttcggtggaaagtggtatagggagcctcttggttcattcacaactggacccccatacatcaggcattggaacaaggatgtcatggtatgttttgtttcttctcttcttttttctaacccaagatttcggcaattactcgtgcaaatcgagtaagccaacttgtcaagtttaactagtatggcacaaggttcgaaatcctaaaacggttgtgttcatagttgtcaaatcgagaattgaaatccaaattttctgaatcgtgaatcgcgatgattcgtacgattcggttcaagttcatgaaactatgaaagataaaatttttaaaatgttcgacttaatatattaacctataaaactagactagctaataaactctacagagtatattttaagggtattttggaacccaaatatgagtatccaaatatgagtattttggattatatgctttacatatatatgtaaacaagttgttgacttactgtgagtgcagagattattccagttatacacggaagtgagttacagtttataccagaaactaatggattcgattccgggttttgataaagtcatggagaaagttagggccgatgctgaggctgaagaaggcaagcgtgaacaaaaggagcccaacaagaaatggtttaattttaaatttttgaccaaatagtcaccgaattctctagttttgcccgaaatggtgtgcttatgagctttattttctttaaggttctctagagttggtagagattactatcccttgtaagacgtttgtaccgaataccaatcgtgaatttttgtttaggcagatggtcaaaccaaactttttttcttcaagtggtcttcatctcggtagcactacatacctataattctgcattttgaaaccaacacttgcggaaatcggcttataattctgcgttttgaaaccaacacttgcggaaatcggcttataattctgttttttgaaactaacacttgcagaaactagtaagaaatgttttggagctgttttcataaataataaaagttggaaactcgtttctttatgtctacggaaagcaaattatcgtaaaaatttattgctgttacccttaacaaaaaaataaatttctttctcgttgttcactctggatccctaatttgaaaaaaaatttatactttttctttcagagtaaaaccatgattctctgtttattaaaatataagtacgaatatatatatatatata

SEQ ID NO: 1252 - DNA, 3685 bp, Euphorbia heterophylla
  unsure (1)..(3685): unsure at all n locations
aataatcacttaattaaatttgtcattcattgtttaatgttgagtataagagtacgagtaaggatgtatttgacctaaaaaacacacgccaaagtcaaattactaatttaaaaaaaatgtttattgttaattacaagtcaattattctaagattatttttcaatgcttataatcaaattacacgttagacataacttttaagctcataatttaagtattcctgaagcttatttttttaatttataaaatgtttttaagttataattaaaaagctcaagattgaagtttttttaaaaagtgcttaaaagctgtagtatgaaaaaacaaaagctacgagaaacatctttctcttgacgaggttatgtttcaaattttaattactaaaaagtacgttaagctctaaactatcatttttcaatccttcaagttaactagtttaagtttatattaaggtaggcaaaaatgtttgaagggaaattataaaaaaatatacgtgtctcattaaaatatttannaaattgatcattaagttaaattagttatatatttattactttttaatcataaataatttataaattaacaaaaaataagagaaaataaatatatgaatacagtctgatcagataaatacaggcatagcaaaatttggattgattcaaaaaccgaaccaaaccgaaaactatgtaggacgaaagtagaaataaaaaatgaaaccacaataatgtggttcggttcggtttgccgttctttcctatttgtttcatattttcaaaaactgaattaaaccgaaccgaaccaaatcgaaactaaaaagtacaaatttcataaacaaaaaataaaccaaatatatttggttcggtttggtttgattcaatttttatttttttgctctctcccatagaaaaatatcagacgattactaaacgattactagtgatgtcaatagggcgggtaatacctgaaaaccgttacatccgaaccagtgtgagcgaggaataatgaaagattttcattcgaatgggcgggggatgggtgaaattttacctccgaaaagaaaaagtgggcggtgtgggtagagccatatccgcaacgttgggtagcccgcaccatagccgaataaatctccgaaaaaaacatgaatacacacacataatatatacaagattttaattgaatatcacatataattcattataaaatcatctttcaaacaattttatcaaatattattaagaaaatcaatgaaaataataaacacataattgaaaccttaaatcttatatatatcaaagaatagttagttagttacagcaatttgaaaattaattatgtaatttggaattgatcttcttgtgtagtttttgttattagttcattaactaagccatcatagaaaaataagtgcttttctcgtacttaattgatatcaataaactttataaatttctttgaaattcggttatgttcttcgatttaattatttgatttccttgataaacattaagttatcaaattttgatcaaattgaattatatgtgtatatgagaataaattacaaatttttaattatttgaattaattataatatttatatataattttattcgagtaaattgatatttagtttctatagctaaaatttatggatatatgtacgaatgtgggctcctgtcattaatagacatgagaacaccacttcaagttttgtaatatttattggtgggcggagattatccgaaaatcgcccgcactcgtgtgggtgcagaatgggtgtaagaaaatacccgatacactaattggagaatctccaaaaccaaacccgaaannnnnnnnntgtggaatagggattgagataccccgcaccgaacccgcacagttgacatccctaacgattaccagatatttactaaaaaaattaaaatattactaaaaaattactatatatttataaattaaaaatcaaactgtactttttttattatttaccttataattataaatttataaattatttataatccatcaaataattttgatttttcctaacaaccccgtgtcgaaaacacgcctttgaggggccaaaatcaaaattctaaactctgaagcgataaagcccaaaagttgagcccatttacttatatctgtttggttcttcctctttggagcttaaccaaagccatttttgcggcattttgagtttatcgtcactcctatcctctcctccttgctgttcttctgaaaaaggttcttctttatcttccatcggtttctccttgttttgcagctttttagcttcaatgtaatgatattcttgtgtaccacttgtttattcgttttattattttaatatcacatagataggatttccccctttttcatttcaactttcagctaattctatccgttttcattttgtttttgcttgctgatagttggcttttgtgtgttttgcatcatttgttggttgctaattgagtatttcttttggttaatagtaaaatcttagtgttcttagtcttgtgtttcagcttggtgcacagcttctgccctaatttctcaatctttagttatggcatctatcaatttcaatttcttcgacaattggtttaataaacccccaaacacacggcctcctattaaccttctccctcttattaactccttatccactaaaacatctcgtcctactagttttgcttccattagctcctccctattcaattctaaaaaacccgaaccccaatccgaagaatccaaagagccgggctattggcagcaaatgctggaccagttcttctatgaacacgaaaaccttccagattatcgccatgctccagaagttgagaagattctaaacgagcacccctatttagagaaaaaggaaaacccaactgaggaggaaatccaagagaacaagaaaatgtgggatgagctcaagtcgagccctgtggttcagtttttgctccgtgctgaagaaattgctgataccatcaatgaaatggaggtcctagaaaacatgcttccatatcgttgggaggataggaacatgtggctaaatgtacctaatgtgattggaccagacggtcggccaatgcctaggaaggcgataaagtcgaacaaagagagtgatgataagttttgggattttactaagcagttcttttttgggctttggggttttagacagagaccatacccatctagcagacctatcgatgttgctcaagctattggctataagcaactagagaaccgatactacgactgtaagtttaagttgaagtttatataaaattaccaaagttgtttattttgtatgaccaattttcatgtttaattgatgttattgtcaaagttatcatgagaagtggcggatggtactataaggatcggttggggagaacacgaggacccatggagcttatacagcttaaaactgcttggggtggtgggattattgataaggacactttcatatggggtgaagatatggatgaatgggcacccatacatatgatttatggcatggaacgcgctgttgccacttgggaaggtccgtgtttttcctttgttatattatgttggcctaatacgtgacaaccccccaaaacttgattaaaaagggctatttacccctgagcttttaagtttcccaattaccccccccgaacttgtaaaaaag

SEQ ID NO: 1253 - DNA, 1864 bp, Ipomoea hederacea
ccgccattatcaaatctccctcgttccattgctactcaagcacaagctcggaaaccactataacccgaaacaatggcatcggttaacttcaaccctttcagtgataactggttcagtaaacctccaaatcctattaaattcgtcgatgtgcatacattttttgagtctgtaaacccctttaaaccccaaactaagaatcctccctttgccgccatttcactcccattttctcgaaaaccgaagaaggaaaaacctcctggccctggaatgtatcgccggatgcttgaccagttctactgggagtgcgagacgctgccggaccaccggcacacgccgaaagtagagaagatactgagcgaggattcgatttttgagacgaaggagaacccgacccaagaggagattgaggagaacgagaggtggttctcagaattcaaggaaagcccggttgtgcagtttttggcccgcgctgaagagattgcagataagattaatgagactgctcttcgagagaattcagctccttaccagagagaagacaaaaattgtggaaggcagttcctaatgtgattggattggatgggaggccaatgccgaggaaggccataaagacgaaagacgagtcagatgataaattctgggattttgcaaggcaattcttttttgggctctgggggttccgacaaaggccatatccacctggaaggcccattgatgctgcacaggctattgggtataagaagcttgaaaagcggtattacgattttataatgaagactggtggatggttttacaaggatagattgggtcgttcaaggggtcccatggaattagtacagcttaggactgcttggactggtggaatcattgacaggcatactttcgtttggggcgacgacatggatgaatgggcacctatatccatggtttatggcttggaacgtgctattgccacctgggacgtcagactatttgctgctgctacaaccttattccacaaagtccagaagggtatacctccttgggttcctctcaaggggcaagaggaaaagacctataatcagctccaacaagaagcttatgagagcaagaagcgtgacttggctgttctggaagcaaatggcggtgtgtggcctggcgtaagaactccaagtcatgctctgtttctctgggccagtggatctgagctgacatcaattttggatgaggatcacatgcctaacaaatacattccaaaagatctcaggattcaattggctaagataatccctgggctacggccatgggaggttctgagtgttgaacaagcaatggatcaattaacatttggacgtgattggtatcgtgaaccccttggttcatacacaacaggccctccttacatttatgattggaatagggatatctgggccttggcgggccactacaatgacttctgggtaaaaatgcgtagcatactaatgcgtggcatccccggttttggcgctgtgttggatataattgcagcttataacgccgccagattgaagaggagaatgaggatcaaggaagcgaagaagaatgccgagctggaaaggaagtaccttggtcatcgtcgtggtgaaaagtgatcagcgatgtttgatcggatcggcttgcagacagtaaaatactagaaaagattgttgccaagattctgctgtggcaaaagcattcattagcttgctgcttctccatgacctataaactcgacgctgcataatagcatatatatgatttctgatacttacaattatccaaagggttttcccttgtgtcatttttggccgtctattcacaacctaaaacctttgatttttacggcaatggaaacttgaaacaactc

SEQ ID NO: 1254 - DNA, 8758 bp, Kochia scoparia
agttccaaacattgggtacccgataccagaaccgaaaccaattgggtacccagaaccggtaccgggtcccaaattttattactcggaaccggaaccaattatgactggttctcattttttggacccataacgggacccagttacaccagtttcgatccagaatcgacgggtccagaccggttccggtaccgggtacccggattttatgctcacccctacttgacactcatatacacacttcatgacatagaagcaagaaaagacatgcaactgagctagagagcgaaacacaaaaaacgcaacaagaatactcttactctgattttgctaaacacttaagctaggggttttaggatagttgtaggtgtgtgatcctaaacttgtaaaccctagttgtaaggggtttggggaagcaaattgagagtggttagtagtgtggatactagttgattactagcacaagttgtaatctatagtggttagattagagaacttgtgagatagtattgcaatggcatgccattgatacttgagttgtgtgtgtgtgtgtttgatcatctttaacttcgataatcacaaagtgcagtgtgggtttttctcccagtccttggggtttcccacggtaaatattgtctattcactcatttatgctttgtttgcttattttctagcttttacatctttcggtagattattagttggctacggtgtatcactaattagtcgaacacgagccttcgatccccaacattaagttgcttacaacattatctccgtgaggaaacaatcttacctcaaacttatgtttttttctctccatagagacacaatttcttaggaatttgattaccacgcattagcaattgggggagtggaaatgcaaatttaagaacaaaattagacttattgggatgaaattgcattaccatgggaataaacataatacttcctcacaaatttacatacaaaatcattctcattaacccatcattttctaccaacaaccaagcgggttgttaaggtgaggttaaaattttggctaaaaacttaaatagtcgccaaaacaacgtttctagcgacaaaaatcgttgattatacatcacgtaaatgaagttttggcaccaattttttatgaaagagttgagaatttgtggttggttcccataatagtataaggctatcgcgcgaaaatggcgtccaaaactgtgagatatgatgaggtttcgaaaactttttctctaaactttcaaccgtcgaaacacacataggaggcacgcacaacacttttcgtttgggactgcaacttggcgagggaaaatcccccatgacctttaaggtggtgtaggagaaattctagctaaaaactcaaacaatctccaaaacgacatttttaacggccaaaaacgttgattatacatcacgaatatgaggttttcacatcagtttttttgaaagagctgagaaattgtggatggttcacgaaaaatttgggtgcaaaactatgagatatgatgaggtttcgaaagactttttctccgaactttcaatggtcaaaatgcgcatgaaaggtacaacactcttcgtttgggaattaaacttgacgatcgctaaaacattaattctcgcggccaaaaacatgattatacatcacaaaaacgagatttttggattgatttttgctaaaagagacaaaaaatatatggttggttcccacaatcgtatgatgtcactcaaaatttgggtcaaaactatgagatatgacgaggtttcaaattacttttcatttgaactttcatttaaactttcaaccgtcaacacgcacgtgagatgcacaacactcgccatttggagctgaaatttgttgttgggtggaaatggagaaaaaaagtggatgcacaacactcgtcgtgagatgcacgacgaggttatttttttgtgagttaattgaagatgaagatgaaatggagaaatggagaaaaaaagtggaaaaaaggggagaaatgaagaaggaaggtagaaaaaagaggcaaaatgaaggagagagtgaatcattgcggaagaggagagagagagtacgggattatggtcctggaatcatagtagacctattgactattgtcccatcaataagtaatgcatgtttacttgggctgggctgggctcctgggctggctaattacaaataggcccactttatttccttgtgaacgttcactgaatcagtgaatttatcttcaacctttgaattctcactatcttctttcatttctcacgaaaactccattgttaaaacctcaaagctcagcaaactaaaacccagaaaaacaatggcgtcaatcaacttaggaccattcggcgaacacttcttccactggttcgaaaaacccccgcaccccatttcattccccaactttctctctcttactctctcacaaaaccctcctaaacccctcttctcctccctctctctctccggcccgagaaagcccaagcccaagcccgaccccaactcaccctcctcagaaaccccgggaaagtaccagaaaatgctggaccaatactggtgggaatgcgagaacatgcccgattttcgtcacgcaccagaagtcgagaagatcatgaaagaagacccgtttttcgagcacaaggaaaacccaactcaagaagagattgagcagaacaggatttggtgggaggaattcaggaaaagcccagttgttcagttcttaacgagagctgaagaaatcaatgatttcatcaatcaattggagctcaaggctaatgagaagccttacaggagtgaggatgagaagctttggaaggctttgcctcatgttcctgggtttgatgggaggcctatgattaggaaagctattaagagtgatgaagagtctgatgataagttttgggattttactaagcagttcttttttggcctgtgggggttccggcagcggccgtatccccccgggaaaccgattgatgccgcccaggcgatcgggtataagcagcttgagaggcggtactatgattgtgagtgttgcttttgttcaatcccatttttggtttgtgcaatttgtttggagtatttgagtgtttgtttactgttttatgatgattgttttatgcttagatgaaattatggaagttcatgatcaattttggttcaagtagctgaccccaattataggactcgggctttgattgattgattaatgttactgcatttttagctgtgcaagttttatgggatatatgagtgtttggttatcattttatgatgatgattttttcatgtatgttatgttatgtatgagttgagtacttcattgctattatctgatgccaatctaataattgatactgaggccttgtttggttgactatagaataatttcaatggaagatgatcttccattgaagacataattgacggaatgtacaattgaaattcagtatcagttacgtgcaaggataggaaggaagaaaagaaaatgggaatggaggtattcaaatgtatgagaaaagatatattgggatgtaagaatgagaaattagggtgggaaatgggattgtatctttcaagccatttgaaaggttaaaatctctggatttaggctagttgactagagagtgattcttagtctggggtctggagctcaagctctcaagtataatttcatcacggctatcctggtcacatcatggtcataaactcctagagtttaccctatagaagcttgtgttttcactcctttccatatggctttttcaaggagttacttttgagttttccgatctgttttgccgttgtaaactggtttatcgttcttttctaagactcaatttgctttgatgcaaaacctttttcatggaaaataataatttttttatgggaaacaattttcaatggaaaacataattgtataaaacatgttcagttgtgtttgggtgaaggatgagaatagagagcaaggggagttaggagtagagtaggaattgtggcataccttgtttttggaagaaaaaaaaagattttcctttttcaaagagcaattttccacctttaggggaaaatgatgattttccttcccttaacaaaacaaaggaaaatggaaaggtgatggcaaaacaaatggagcctaaaataaagcacaacgtgcaaattctgctatatatttgtaggtttttaatggatgtttgttctgacctctaaagagccctttggccaaggtataaatgaggcgtggaaatccaaagccttgtgtaaaggccactctgtttttgactcaagaaaagtttagtaaggtgtcaggcagaattgcaaagcactggaacttccctgcatcattgttcgatcttcctgaaaaagaaatttcgaagccctgcgaatctaggttaatgttgtgcaaactagctgatagagttagcaatttgtatggggaattagataaatgttagtaggctcaactttattttggattcaccgcgtaattttcctgtttccttaaacatgatagagtttggaccacctagcataatgttttcattactgaaatatattcatccgaagaaccgaagttgattatatatgcaacattctctttggatgtatcactcttttactaactccctgaacatgcattttttaacgtgtatagttataatgaagactggtggctggttttacaaggatcgtttgggtcgtacacgaggaccatgtgagttgattcaactgaagactgcatggggtgcagggattattgataaacatactttcatatggggagaggacatggatgagtgggcgcctataggaatgatatatggcttagagaaggcaattgcctcttgggaaggtgtgctactaatcattttttatcttaccatctatgattttagtatccattgcaacagcaaatgcagtccttatcctgttcactatatgcatagtaaatatagctaaactcaatgtaatgcaaaaagaaacattgttataaacctgattgtaagatcttttcatgtgcaagatgctaatttaacaacattaaagtctttgtgtacttggcttctcatacacagcaatgtgttccattctgagctgagacttcttgccatagtactttgacatccaccagcttaccgcctttcctctttagttctttggagaaaaagctgcaatttaatgattgataagttaattttaaaacgtcattctaaactagtaattggtgactattatcttgtgaatcgatgtcttttcattttgttaaggtaatgaggttcaatctagtttagtcaataagtgtgttatgtagatactcaagctcgctaaagtttcattcttgttagtgtttatactttatgtataactaatggtatattggtatgtaaacaatgatagaaaactgacccttttatccctcgtcccttctttttcccagctagatctgtaaaaaaatcataggaatgaggtaccatcacttatcttcttcttctctcttctattttttttttaaaaaataaaataaaaatcaaaacacattttaaaatgtaaaaggagcacctttttttccctaacttgtgatgcgattttcttatccttcccttctctcatttttggaacaaaatgtatgcgaggaggagaggggcaagtgtggcacacaatgtattatagattgcgaaactttaaaacctgtttccaattatgtatgtgtagttttctattgcctttctaaatttgggtggagccccgcttgggacatgggaagcggccagggagttttgaggatgttgggctggcggttgtagtttgttacagaataataagacatcaataattatctctaccaattactttagctgtgttctcgtcttttggtccttctggagtcttcttgatcatatactccacactaattacctttccatcaacacttcctctgtgatgagatacttgcaacaaaggggtatttttttgtgagtattgaaaaagtgatattttgttacggaggaagtataatcttaaaaaacttgaagcaaagatgaaacaacagttgctcaagtatggaacatcattggaagggatgtctaatctgtggtactttatattcttgagttcctggttgtctgcatcaaatgacctatgttttttgttgctttgttcagtcaggtttggagcagctgctacagctgctctccataagcttcagaatggaatgtctccttgggttccattaaagggtcatgagaagaaaacttataagcaactgcaagaggaggctttagaaagtaagaaacgtgatttggctgtactcaaagccaacaatggcgtctggcctggtgttagggctccaagtcatactctctttctgtgggctagcggctctgagctgacttcaatattggaagctgatcacatgcccaacagatttataccaaaacagctaaggtgtttatcctttttctgaactctataattatgtgacattggagttcctgaaatttaggtactaagttgctaaatcaggagtatataggaagcagaatctgcttcatcatccagttgataataattacattatcttgttgacaataatttcatttttacaccatgattccctgctttgagaatctaaattttcttcaaagtgttttcaatttgtttgatcgatcaatcaatcaatcaaagccttattcttagaagtggggtcggctaacatgaaccaaaagtgataattttgtttgataatatttttaaaattatttttttgtttttgcattacgctagtcaatggatatgtaattattcttcttttctgagcagggagcagttggctgaagccatacctggtctaaggccctgggaggttttaagtgtagaacaggcaatggatcaaataacatttggtgggaagtggtatcgtgaaccgttgggttcctatacaactggtcctccgtatataaggcattggaacaatgatgttattgtatgtccactatgctttgtcttcttttccgactgttttcaaatctgttgtcgtcactccatcatgcttagtttgctaataaagataacaagaagaatgtcagaaccttattttgaaatgattgtgttagctacagtggagtttcatgaattttataatcaatatcaatcaagcaattaatcgaagcgttagtctcataattttataattaaaaagcattactaggccatgcttggtatgtaggtaatatactaaggggtaataaaagtcaaacttgagaaaactaagaagaaaacatgtgaattaagatggtgatagagggataattgcattttttttgtgactaaaaaagggagaagtaacacggtaataagatggtcattattaccccaatatgagggaaacaattaccctagtgtggaggagggtaactatctccccccaaatgagggtaatagttccccttttcctccccaccaccacttcgtctctttatttttacctcttaacacctttgttttctcaagtttgacttttatcacccccttaatacattacccccataccaagtgcgacctaaattgtttattttaagcaggtctgacaaatttttattgggtagctatggaatatttacgctgcactagggttgcttccatgctgcttaatttcgacttgttatgtcttatccttaattccttgtgatcgccttcgttgttcagtatgagcataatgacatccttgtcagttgtcacttgtcaaaatagaaaatctgccaagagtgcttctttcataactttgattctattttgtgattctgcagagaatgttcaacatattctacgaactgaccactctggtatatgcaaaactgtcacgtgatattcctggatttgataaagtaacggagaaagttcatcaagaacatcttgaaagagaagaaaacaggaggaagcggaggaaagaagagctggaagcagagcaggaagcaatatatgggggaccgagactggatccataaaagaactctttacatcgcttcgtttttggcctttgtatggcttccaggcttaattatcttgcttttaagatctagtttagaatgttctgctcatttgcagtatcttccaaaaaatgagtttaaattttctgagttctgttatctcaactaacaattactataagttataactaattcagaaaaagcaaatctatagcctaggactccatagttgagaaggtaagcattggtgatgattgttttcctggcatggttttgcagaatgtatcaaatcaaatggcgacaccgattttggatgccgaggctggtggtcttatactcttatcgtgcgggaagggtttatcgatcagatccctgtatgtagtttgtgttgtatttttttgttgagaaggaaatgattgcaaaaattactgaaatactgtaagtttatgcaagtgattaaaatactgtaaattattatgcaagtactcttaactcggaagtgttgtgcttgtgcaatctttcggaaattgttccagttcaatcataaaattaagaagcacttcgtattaatttcaaaaactaagaaactactttcttttgctttattttcccgtgtttttaaattggaagtcaggtgattttggaaattctcatctattataatgagtagtgactgtctttggtctaattcgaattcggggagtcgatttcggcacactaacttcccattacacacatgacacaccctttcccccccccccaaaac

SEQ ID NO: 1255 - DNA, 8089 bp, Portulaca oleracea
  unsure (1)..(8089): unsure at all n locations
tttaatgaacaccaactctaatgataatcaagcacccttacaccgatcaacaaacagttctggaatgaacatccaacattcagggatgatcatcaatccccttacaacgaacaacaaaattgaccatcatgtggttgtgtactcatctttataacatatgaacttaaattaaaaccactgaaacagtattaaaaagataaagatgatcataaacagtattccaactacaaaactccattctttgacaattatgaacaacaacacaaaaaaatgaacatcagaatacaatatgtgcatcatgatgacctgatttgcatctttcaacctgttatcaaactcaccatcataaacccactcaaacgcttatgagaatatacaaaattcagataaannnattcatgtattcaaatcacataaacaaaattcagaactacataaaaaaaatttaatgtttttgtttcatatgttgaaaaagaagaagaaaaatagtttcatacttagcaaattcatgattatatatctagataaaaaaaattaaatgaatattgctcataaattgagacatcatattcttacttagaattttataatctatttatttcatttcatgggtcatcccttaaggttagcaatccttctaacttgggttattgactgccaaggacggcccaaaagctaatttgccctttaaggatgtgattgactctaaggtccaaattatcaattaatagaggagcccaaatgctgactcagcaccccaattttcctcctcattctctctctagaaaacaggggaaggacatgactggctaaggatgcggtcgccgtctccgtcaccggtgaaaagaagctccggcgggaggccaaaccaaagtccaaaccgaaaatctgaagctccaaccatggtggagttggcgaccacttcataatttttatgaaacaatatgaaagtaaccaaaactaattacccagatgacaaaaattgccaaacacccagatcaaatcaattcaacatgaaagcatcgccagattaacccagaaatatatgatattaatggacaaacaggagatttaccatcaaaaaaagtaaacccagaaaaacaaattgagaaagaggagttaagcactggatgtagaggtttcttgatcgattgttgcagtggctgtaaaccaaatcagtccaggaacagattgatgaactgctgcctccagtgccctcaacccttgccattctcaacatagatgacctataataatcaacaaaaactaaacccaggaaagaaaaggaaacaaattacccatatcgaatacaatgttcttcaaagacaaggagcaatcagatctcacaacttgaaaagtatcaaactttctacagattcatgattataatacacatagtgttgatcaagcgatcgtgacagtacactaccgcagataatacacactaaaaaaatgaggtagagagagaacgaggggcctatcttgtttgcatttaaaggggaaagagatatggtatcaatcattcatcagtaaccaaagaggaatgatttgcagaagctgtgtgtgttgattgcttaatcgaagaagctcgggtgcactccaaagtccaaaccaaaaatctgaaactccaaccatggtggagttgtttgcggaaacagaggagataaaatacaagtatacaagtatacagaaggacgaactcatcggcctcccgtcggagcttctattcgccggcgacggagacggagacggcgaccgcgaccgcatccttcgccagccatgcccttcccttgttttgtagggagagaatgaggagggaaattggagtgttgagtgagcatttgggcccctctattaattgataatttggaccttagagcccacatccctaaagggcaaattagcttttgggccgtccttggcagtcaataacccttctaaattttcccagttcagtcgtagttgcggtggaccgaacccaaagccgatccgaatcggcccaacccacaattggccttccctgtccggttgtccccattctcgctttcgttatcctccatttctccgtttccctgttctgtgtcacgaacaactccatagctaaaacctccgagctcagaaaccctcttcaaatggcttccatcaacttgggtccattcggtgaacactggttccactggttcgaaaaacccccacatcctctctcaattcccaacttactctctcttaccctctccaaagcctcctctaaacccctcaacttctcttctctctctctctccggacccaatgaacccccttccaaacccggaaaatacaaggaaatgttggaccaattctggtgggaatgtgagaatttacccgacgttagacacaccccagaagttgaaaagattctcaaagaagacccagtgtttgagcataaagaaaaccctacgcccgaagaaattgaagagaataatcaatggtgggaggagtttcggaacaacccagttgctcagtttatggaaagggcagaggagattactgatacgctgaatgagatggagcttaaggagaatgagaacccttataggagagaagataggaagctgtggaaggctgttcctcatgttactgggttggatgggaggccaatgcccagaaaagctatccagtctaagtgggaatctgatgacaagttttgggatttttgtaggcagttcttctttggactttggggtttcaggcaacgaccttacccccctggaaagcctattgatgttgcccaggctattggatacaagaagctcgagaagcgctattatgattgtaagttatttgcttggcttgtgaagctcaaatgaagtgaaggtcttttgcttttcattgcttgtttgctattgtttgcctttctcattggttgctattatgtgatggcaatgtcaaatgccaatgctttgtttgattgacagcttgacattcaggtcattagtctactcatgatgctgccttgtttagctgctggatcagtttgctgtgttattggttttcagtttgttatgggactatgtttttgattggccaattaatactgatttctctgtggtgtaatttagtacccttggacaaaaatcccacattttgatctccactattacttggtagaatatggagtgaagagagaatgagttgacttcaccagcaaagtgattaaatctagtgatctctgtcaaggagatccggagtcaggtcaagtatttgggaatggatgttggaatacttttataacaatgtggtaatttagagagagagagagagannnnnnnngagagagagagagagaggggatataactatttagttgtcaaatacaaaatttgtgtttattatgtgtgctagcggggtctagctgattgaaaccttcaggaactaatttgtttagccttctggctgtcttattttgtgcattgtttcataatacttctgcaacatcccgattaattaatggaattcatctttttgttacataaaacataattgttgaagacttgtgaggtgacctgctgtataatgtccaatttccttgctgaaaatcgcaactgacatataatgttgtgactgtctgcccttgtaacattcaaatttgcttacaccccttcccttcttgggtgacaaattctatatcggatgaattaaactttgttcagttcccactaacggtctaaatcctttctgaacagttataatgaagactggtggctggtactacaaggatcgtttgggtcgtacaaggggaccatgtgaactcattcagctgaaaactgcctggggtggtggtataattgacacccatacttttgtatggggagaggatatggatgagtgggcacctattggcatgatctatgggttgcaagaagcaattgctacttgggaaggtccgttaaactgtttatctttttgttttttttgccatcactttgaagttctgtggtaactaggcaactgtggtaactcatctattagaaggataagttttaagatctaagtccactcttgttactcatgggcaagaggtaaattggtattggggtggcaattcatccttcttgccaggactctaatcccagatgttaggcgggcttttgagcctaggttttgtagccacacaaacgcacacagtggccttgcaaaaaaaaaaattataaaataaaataaaataaaataaagaaagaagaagaagaagaagannnnnnnnaagaagaagaagaagaagaaagggcaacccattttagttggcagttttggagtagcattaagcttataatccactgttgatttctataatggtggatagtgttagtaaacaaaggcaaaggatcagttgtcatttgatgcttcaccattcattcagcaatattgctattatatttcttttccaacttggaaagaaatttcatgagccaagctttttagcaaaagataaggctaatgtgttgcaaatggtgtggcttcattgctaaagttctaatgctagtgttggattgttgaatatttttccaaacgatgactaatttttctaagagaaagcattagcttgtgcacttgttagtagtgtccttgagctctgatgtattataaattcaaaatcgtctagttgtcttggctcaggtcaatattttattatttctacttttcctgagcatctttgaaggggctattattttggcttggaggggaattgttgagagtactaaggaaatcaaaatgatggaagaagacctgaaagagccacgtatctgaattttgttttatgaagctttgtggagctaccataacattaaaacttaggaatcaaagagtgctattcaggagtttgagtgtctattcaagatacccatgtatctttgactctatcatatcactaatccatggataggataaatgactctttaagtatagatttagaactagccctaacacccttgctatgcattacattatttgtttacttaatttttctaaatttacttttacgcaattgttacataaagttatctataaaattgataacttactcataaattaatctcttttaaatttaatagttaaaaaatataaatattttgattattacattacatatgaaactgcattttttttcaacccagtttgacttttgagtttttggattagcataattatccttttatcaataatatatttagctttcttatcaacatattgctattatatatttatattaacattatactccctcctatccattttatctgtcacttatctaaattttcatggtctccaatgtcatttcttgaccaaaaatctcccacatgacattttatcaaaaaatactgtattataattgtatgatactaatatttttttgtttcgaaactaatgacaacagttttatataatagatcattgtatatgttagagaaactaatgagcaaagttttcaaagtttgattgtcacacatttcagagtgactgataaaatgaggagtattttattatttaatactatgtcacgcatgctccaatccccccacccccccggcgcccgcacggaaaaagagagaagagaaaagttgtgccgttgtgcctaactcagtaacatagttgtacaggtgtgttgacttctaaatcatgagacaatcatgtacacgaagtagcaattgtaatacagaaatgcttgctcctgtttgaaagttgaaacctattcagcgaacgcgtgcagtatctttgaaaccaagaagatagattgcttgcacttttcttttctcaatgctggtgttggcatcaaacatgatctgtgtatgttgacactcttcagtcaggctgggagcagcggctacagcatttctgcacaagcttcagaaagggatatctccttgggttccactgaaggggcatgaaaagaaaacatacaagcagcaacaggaggaggctatagaaagtaaaaaccgtgatttggctgtattgaaagccaatgatggcatctggcctggtgtaagagctccaagtcataccctctttctatgggctagtggttctgagctaaccacaattctagaagctgaccacatgccaaacaaatatataccaaaacatttaaggtaattgctcacctctttttctctccatctttgtgtgaaatcgttgtttacatagcatggattttaaaaagttgcagcaattcattttgcaaatcttgggtactggtgatccagaaaggatggaactgataatacattctccaataactggcttcctataatgtgcaagggttcttctaactctttccctcccattctgccaaataaagagaccacaaagagcggaaagttgttatcagactcagattgtagtttctctcttgtttcttttttcattgtgttcatgatgggtttatgtgcccggggcttcctctgtgtgtgaacatgttatagggtatgtttgtctggtgcaggaagcagctggctgaagccatccctggtttgaggccatgggaggtactaagtttggagcaagccatggatcagataacctacggtggagaatggtaccgtgagcctcttgggtcctacacaactggtcccccgtacatcaagcattggaacaaggatgtcatggtatgccattctcacgtacaattaatttttaatagttggcgtgtttatatttgagttctcgcatcccatgcattgccgtatcatcctattctctccatttgtttggatatttaagtacatatgcaagttttttgctttcactctaatgtgcctatcagactgtcactacgaattgtatatcaactagttgatgcttttccatatgctatgggctaatgaatttatgatcttggtttcgactgagtgatttcccggatgtgaacccatagattgaagttactataggtgttcactggacttgctgcctgaagtagttatcatattcaagcatctaggatagaaacgaagtttatgcactgtaatttgtaatgcaagtgtttatggcaatcgtttaatgattacaagaatgtgatcatgtgcagtgattggatttgtttgacattaacatatttgattgtccatagcaaggatgaggttgcattcaccttgacctcccccgttcctgcctcatcagaatacatgttgggagatagttacggttatcatagtgatgatacatcattgagtactccctctacgtgttattaatttcttaaggacttttggaattaaataatccatggggtaatggttacgacgaactgacctttggaatttggacttgatgaactatgcttaacatcctattagattgaatgaactttcatcgattcaactatttaaatggtggcagtaaagaaaaaacaacttgatcaccaccgcaagtcactttttcgatgagttgaaatcggtgaaagttcattcaatctaattggatattaagtatagttcatggagtccaaattcaaaatgtcagttcgttgtatccaaattgccccaaaggttggattatttaattccaaaaatccttgcttaacatatacaatgttctattatacgaaagtactatcatttgattcacaacaccaaataccattgtaagagtataattctgtaatcttttgatgaaatatgttataagaaattcttagtcaaaggatattgaatacaattaatatggaacggagggagtatttttaaattgcaagcttgacctgatataaagcccatattttgtttccttttctccgattctattctaggagttttgatttgaaattcaaaatgctaacaaaattgtagctttgacatcttagctacatgagatgctttccttatttatatcctttgtactttcagggggtgagggcttatatgtattacctgaatgaaacctatagccttggaataaggaagtgtactagagtttactatgtgttttttgtaatgatttaaggctgaaatagtatgcttctcagtcccaaatgtgcacaaaaatgtcataactaatgcaaaatatcatattgacatattctgtgtctgtgtatacagagattattcaggatatt

SEQ ID NO: 1256 - DNA, 8965 bp, Portulaca oleracea
cttctataacaatgtgataatctttagaaggggggggggggggaggatataactatttaattgtcaaatacaaaatttgtgcttattttgtgtgctaacagggtcttgctgactgaaaccttcaggaactaatttgtttagtggtttggctgtgttattttgtgcactgtatcataatacttctgcaacattccagttcattaatggaattcatcttcttgtcgtattaaaacatgattgttgaagatttgtgagatgatctcctacaaatgacagataatgttttgactgtctgcctgtgtaatattcaaatttgcttacaccccttcccttcttgggtgacaaattccattttggagaaattaaactttgttcagttcccattaacggtctaaatcctttctgaacagttataatgaagactggtggctggtactacaaggatcgtttaggtcgtacaaggggaccatgtgaactcattcagctgaaaactgcctggggtggtggtataattgacacccatacttttgtatggggagaggatatggatgagtgggcgcctattggcatggtctatgggttgcaagaagcaattgctacttgggaaggtctgttaaaccgcttatttttatttttatttttttgccatcacattgaagttctatgataaccaggcatttgtggtaactcgtctgttagaaggataacttttaagatccaagtccatttttttactcatgggcaagagctaaattggtattgagtttggcaatttatccttcttgccaggattctaatcccagatgtagacaggcctttgagcctaggttttgtagccacacaaatgcacacggaggccaaaaaaaaaaaggaagaagaaagggcaacccattttagttggcagttttggggtaacattaggcttataatccactgttgatttctataatgatggatagtgttagtaaacaaaggcgaaagatcatttgttatttgatgcttcaccattcattctgcaatattgctattatatttttttccaacttggaaagaaatttcatgagccaagctttctagcaaaagataaggctaatgtattgcaaatggtgtggctgcattgctaaagttgtaatgctagtgttggattgttgaatattttttccaaatgatgactaatttttctaagagaaagcattagcttgtgcacatgttcgtagtgtccttgagctctgatttattgtaaattcaaaatcgtctagttgtattggatcaggtcaataattttattatttctactttttctgagcctcattgaaggggcttattattttggcttggagaggaattgttgagagtactaaggaaatcaaaatgatggaagatctgaaagagccatgtatctgaattgtgtggtgtgaagctttgtggagcttgggagctactataacattaaaacttaggaatcaaagactgctattcaggacttagagtgtctgctcaagatatccatgtatctgactctatcatgtcattaatccacagataggatgactctttaaatatagatttaagccctaacaaccttgctatgcatgaaattaaattattgttttttacttaatttttcaaaatttacttttatacaattgttacataatgtcataaagttatctataagatcaataacttactgataaattaatctcttttaaagatagtagttaaaaaatataaatattttgattattacattacctatgaaactacatttttttcaacccagttcaacatttgatttgctggattagcataattatcctttttttttcaataatatatttagctttcttgtcaacaatattgctaatatatatttatattaacataatactgcctccatccattttttctgtcacttgtctaaattttcacggtctccaatgtcatttcttgaccaaaaatctcccacataacattttaccaaaaaataaagtattatcattgtatgatactagtatttttcatttcgaatctaatgacagcagtttcatgtagtatatcattgtttttgctagggaaattaatgagcaaagttttcaaaatttgattgtcacacatttcagagtgaccttgtgcctaactcagtaacatagttgtacaagtatgatgacttccaagtcactagacattcatgtacacagagtagcaattgtaatgcaaaaatgcttgcttctgtttgaaagttgaaacatatttagagtaacacatgcaatatctttgaatacctagaagataggttgcttgcacttttcttttctcaatgctgttgttcgcatcagacatgatgtgtgtatgttgacactcttcagtcaggctgggagcagcggctacagcatttctgcataagcttcagaaagggatatctccttgggttccactgaaggggcatgaaaagaaaacttacaagcagcaacaggaggaggctatcgaaagtaagaatcgtgatttggctgtattgaaagccaatgatggcatctggcctggcgtaagagctccaagtcataccctctttctatgggctagtggttctgagctaaccacaattctagaagctgaccacatgccaaacaaatatataccaaaacatttaaggtaattgctcgcctctctttctctccatctttctgtgaaatcattgtttgcatagcatggatttaaaaaaatcacaacaataaattttgcaaatcttgggtactggtgatccagaaaggatggaactgataatacattctccaataactgacttcctataatgtgcaagggttcttctaactcttcccttcccattccgccaaataaagaaaccataatgagcggaaagttgttatcagactcaaattgtagtttctcttgtttcttttttcattgtattcatggtgtgttaatgtgtccgaggcttcctgtgtgtgtgaacatgttgtatggtttgtttgttgggtgcaggaagcagctggctgaagccatccctggtttgaggccatgggaggtactaagtttggagcaagccatggatcagataacgtatggtggagaatggtaccgtgagcctcttgggtcctacacaactggtcccccgtacatcaagcattggaacaaggatgttatggtatgccattctcgggtccaattagtttttaatagttgccgtgtttatatgagtgctcacatcccatgcattggcctgtcatcctattctcttcatttgtttatgcaagttttttgctttcactctaatgtgtctgtcagactgagggagtgatttctaatatgtgaacccatagactgaagttactatatgtgttctctagacttgctgcctgaagtagttttcatattcaagcatcgaggatagaagcgaagtttatgcgccgaaatttgtactgcaagtgtttatggcaattgtttaataattacaagaatgtggtcatgttcagtgattcataggttgtttgggattaacatatttgattgtccatagcaaggatgagattgcattcacattgacctccccccgttcccacctcatcagaatacatgctgggagatagttgcagttatcacactgatgatagatcattgagtactccctccgttccatattgattgtcatctacgcattattaatttcttagcatatacaatgcgctattatacgaaagtactatcatttgattcataacaaaaaataccattataaagcccatattttgtttgctataagaaattcttagtcaaaggacattgaagacaattaatatgaaacggagggagtatttgtcaattgcatgcttgacttgatataaagcccatattttgttgcttttctcctactattattctaggaattttgatttgaaattcaaaatgctaacaaaatcgtaactgtgacatcttagctacatgagatgcttgccttatttatatcatttgtagcttttggatgtattacctgaaatgcggcctatagcctcaggataaagaagtgtactagagtttactatgtcttttttctttagtctgcaatggtttaaggctgaaatagtatgcccctcagtcccaaatgtgcacaaaaatatcataactaacgcgaatatcatatcctgtgtttgtctatacagagattattcaggatattcttcaacctgagcacgagggtatacagcaagctggagcgtaccattcccggattcgataaagtaatggagcaggtccagaaagatgctatggaaagacgagaaaaacggttgctgaagagggaagaggagaagaaagctgagggggaagcccgatatggaccgcctacgggcgatccatagttcatagtgaaaatagtgtgttgagacttgtgggggactagaccttgcaattttgcccggtggacggcggcggtatttgagttgattcttgtgcaaagctaggcatcattcgtgtttgtattattgggtttagtcgtgtatcaatgcaaatacacctctaaatgggcatttgtttttcaagattgtgttttacattgtgacaggaaaggaaaaaaaaaaaaagggtcattgctccctgtacctaactgtcttcaattggttttacgtgggatgttcattgggttaaactcggacctaactggaccaagcaccagccataccactagaaccacaccccataaaagtttgggttgattcaactggttcgtagtaaggatgagtaaaaaaatcgggcattcagaatcagactcaaaaaaggttagaatctaatgggttcgatactaaagtagattgggttaaatgatttcatatcctactcaataggaaaagattaactattggtctattacattaaagtttgatagttgaattatgggttattgaacacgaaggatggctcataagtcaaatcgacagaaaatgttctctaggattatgaagtcctaatttgtattaaataatagaatccacattgttaagttggcatgatatatttcaatgaatttttattttttatgtctttttttgcagtttgctgctttacttaaaactttgaagttgcccaaggagagagagtgcaggtgggattctttgcaaagaagaagaagaagaagaagaagaagaagtcgcctgggctctaaacttattaacattaataatggctaatcctacagaacctcttcttcttcttcttcttcttcaattccgtcatgcaggattatataatgtgtatccatgatttgttatatatgagtaatgcatgaatattaatatggtaatccattgtttttgttcgttacggagtacctttgataagacatcaacaaattaataacatgtcattgacaacattgttgtaacagaatgtaatttatttggataagtacatataaaatcaataaagcactgattcatagttgatggaagacgaaacacatataactatgtatgacacaatatcgaaagcttcaatccatagaataaaacactctaaaagtccttaaatagtccttaaatacatgatcatctatgacaatacaaaatgtaacctagcaatgtgtaccggtttacggttcagccgtgaaccggcaagttgatcgttctggttataggtttagcttggatgactaggtcaaccgggaaaaagaggccaaaaccggttaaaccagacgattcacggccagaccaagaatttggtaatttaatttaaaaattccagtttttgacctgttaaatccagtttttgacccgtccatgccggttttgatcggttcatgtcgatttaattattttggtagattaattattcttgaagtatatgaaaattttgtaactcatgatcggttcatgtcggttttgaccggtttaaccgtgatcccagtcaaccggtctaatctgaccaaatcagtccgatcagttgaatcattgacccattgaatcaaccagtccagttctgacaacatagctgatttccgtaaaatagcatagtttacacaaggtcgatgacgatcatatatgatttaacctttctgatttccactatttttgggtctgtaaatatggaagcagggttaaatcctctataaaatcctgtaaatatacaaaacagggtgctgtaagatggcaagatcatatacaaaatgaattcgagagtgcttaacttcagcatgggaaacccctgcatgaagaaattcaacagcagaagcaggatgtacagcaatatacttggccaatatccaaaaacagctttatagacaatgaatgtgtgaggctgggtatcaatcccaacacagaaatttgcacccctagcttcaaaaaattgcctggtcattttatatttcatatttcacatggcgaagccacctcgctctgctctccagctttcttgcttcggtccagccaaatgccacagaaattagattcgatagtgttcatcaaaatgattttgtaaaataggaacaatcttggacaaaaacagttgatgcccttgtatagaagttcatccatatcttgtgcctggcatgattgtcttacaatgattgtccttccaaggcttaggaactccatgcggaagtttctgatgcaattcaaaatagaacaaaatagaaaggtcagaaaatgaatagccgctgagacaacacaatgttcaaatgcggattcagtgaaaaaacacgaatccaaggaaactcttgatgaccctcttttaatagacaaggcactgtactcacagcaaatcttatgtgagtccatctcaacataaatttatcatgagacatactaagaatgtatttgaagtaaccgacaaaaatcgtctcttgataaattattagtctcattagcattgaagtcattctaatatggcttattagtcgtagtaaaatacggagtactaaatacttttacgtgagacggttacacatcacgtataggaggatgaaaaagaaccacttcacatatgataaaagccctttagtattcctactattatcatggcttggaagaaaagtgcctcaccagatccctttttcccttcattggattatagcataaagaacatgatcttatccctattgaaaatgagttttgttaatgtctatcaataaactacaggatattagacgtgaattcttcacatagcaaaggggaaaactatggcaaggtgatgtagttaaaagttaaacactgaaaataaaaacaagagatgggagctattgcaagtcaaacaaggcttcgtctctcaatatccatacaatttcaactatggtaccactatgtagttaaaacaatgagataacttatccaagaaatatgaataaccaaccaccaaacaaacaaatcagccctcttgtgcctgctagggaaacacagttggggaatatacaaatagtgtttttctatgggacattgtcttagaaaaatattggtcgcctactattacaaaacaactgcacaacacagtttggtgaatcctatgctggagtacaaatctacgatacaaactatgggtaacgaatcgcccaatatagacttttcattttgcatatatggaaagtagatgcaaaacaaatcctagaaaaaagacacaagcattagcaattgagttggggacattgtcagtatggtctcattgctcaatatagacttttcacatacatggaagttggaacattgaaagttggaaactcgcttggtgaagtatcatcaattaatataaattttaaactatgtgcaaaaaagatgagatggccacctgtaagtagatgaaaaatcctcgtagcagattcaaaaccttgtagggatcaggctcggccttgttgatttcatctttcagatctgagacatcaaagtattcagaagatttagaaacaacaaataagattcttcctacagataaggcgacataatcacattataacagcagaaaagcaaagaaatatcaaaaaatctcgacaggatgcaatgctcagatagttgcttatgacacaaagaatagataggatttccggacttcccgagcttctctcattttcctttattaaactgtctccctccccaaaacacacacacacgcacacacaggcaaaccaaaaaattaataactgataaatacaaataaagaaaaagagccccttctcctgagaaagggtgacaaattcacattgctcaagagcctcataactttcagctccaacaaaacttgggccacaaatgaatattgcaggaagccacacgaactaagcgtcatggaagactgtttaagtaaattctgaaaaacacaaacaaaaaaggaatctcactgttgaccaactgaacacataaacaaagaagtcctactttgttagacaacaaatttaaaaatgttcagagagaagtaatgagacactgaagttaggcaagctaatcaatcacaccaatcacactaaccaggatatgaatccaggtaagaatttcccagcttagaaacctctggttcgtagcctccacggcgcgtctctctatgcacctttatgggtttccgaacacttactacctccaaaagatcttcgtactccttccattcaaacggccttcttagatctttctctacagctttccaaaaccaagcaaacttaccagtagggggttttgtactttgtcggaccacagcctgcatgacgataaagaacacacagtcagataactgtagattcaattcagtagagtatcctaactgaaaattgtttaagctatagctaaagaaagcactcacagatgtcttcaacctatgactatcttctttggctgtttgtgttcgagtaggcggggttactaatctcgtcggaggaggtggccgtttcggaggaggtgtttgtggtcttggggttgttatctgtggagttggagaactgtctaagggtttcccttcaacattgtttcgcctcggctcatca

SEQ ID NO: 1257 - DNA, 1895 bp, Senna obtusifolia
agtacacacagggaagaggcgccgctcaattggagaagaagtgaacaacaaagaaaatggtttagcctttcgtcttcaagcttcactgctcgagcttacccatcctctttctttgctttttctctgagtttctgggttttgcttcttattctcgtccggccaaagacactactatcgttggggtttgcaatttctcatttgtagcgtcgattttatgtcaatttgttggtttctctctgaactctgaatgcgcgaagtgtagcggctagcatttcttcactcattgatgggttctattagctttaaccctttcaataactggttcagaaagccacaaaaccccattcctcctctcaatcttctgggtttctcggattcgcattctctaagaacacctcatgaaagttctccaaatttcgctgccataagcgtccccaacctattcgggaaaaagcccaaaaaatccaaggaagaaccaggttattacaggagaatggcggagcagttcttctgggagtgtgagaatttaccagaccatagacacacaccagaagttgagaagatcttgaaagacgatccagtatttgacaagaaagagaatgccactgaggaggaaataagagagaatgaaaggatcctgcaagagattaagagtagtcctgtcatgcagttcctggttagagcagaggaaattgcagacaagatgaacgaattggagctacaagagaatgaaaaaccttatcacaaagaggatgcggagctctggaaggctcttccacatgtgcctgggttggatgggagacccatgccaaggaaggctctgaagacgagaaaagaagcagatgataagttctgggattttgcaaggcagttcttttttgggctgtgggggtttaagcagagaccctatccacctggtcggccaattgatgttgctcaatcaattgggtataagaagcttgagaagcggtactatgattttgtcatgaggactggaggatggtactataaggatcggctaggtcgtacccgtggaccattggagctgattactcttaaaactgcatggggtgctgggattattgataagaatactttcgtgtggggtgaggatatggatgaatgggcaccaatccacatgatttacggcttagagcgcgcaattgccacttgggaagttagacttggtgctgcagcaacagctttccttcataaactgcaaaaaggtataccaccatgggttcctttgaagggacatgaaaagaagacttataagcagctccaagaagaggctgtagaaagcaagaaacgtgatttagcagtattggaagctaatgatggtgtttggcctggagttagaattccaagtcatgccctgtttctttgggctagtggttctgaactgaccactcttttggaagaggaccacatgcctaacaaatatattcccaaagatcttaggcagaagttggctaaaattattcctgggttaaggccatgggaagttctgagtattgaacaagcgatggatcaaataacatacaatggtgagtggtatcgtgaaccacttggttcgtacagtactggtcctccatacatcaggcactggaataaggaccttttgagattgtttaaagtatttgacactcttaacgctcgggtgtataagaaaatggagaagacaattcctggctttgacaaaataatggacaaggtaatgaatgattatttagatagacaagtcaaattggaggagaagagaaaagcaaaaagagcagcctaatatcatttctgatcaaagttctgcaaactaaatgctttcattataaggcatgctcaagtaataactatgatgacacactctctgcctgacttcctcagaaagaaacatgtat

SEQ ID NO: 1258 - DNA, 5322 bp, Spirodela polyrrhiza
cgagatcttatcggcttgggtatttgacgtaactattaaatttaagggttaaaaaagtcattattagttattttagggactaattattacatatgaaatttataactttgtaggggcctaagagaaaattgttaaaccctctccacctcctgtgatgttgtgtgtgctgccaggtctatctatcatctcttcttcgctcgcccttcgtctccggcgacgcctccgacggacggccattgttagggttttctgggggccctggagaggtgaggacccgtaatggcgtccctgaatgtcagttggttcggggacaactggtttccgaagccccccaggcacagcaatgtctctaagtttgccttcatcggaggaaggaacctcttcttccagaagcccaaggagcccaagggcgcgagcctctctgcctcggccgcggaggaggaggcccccggtgggtactcgcagatgctggatcagttcttctgggagtgcgaggcgcgacccgacttccgccacgcgccgcaggtcgacaagatcctcgccgaggacccccttttcgagaagaaggagagcccgacgcccgaggagatcgaggagaacaaaaaatggtgggaggagttccggcagagccccgtggtccagttcctgatgcgcgcggaggagattgccgatacgatcaacgagatggagctcaaggagaacgagcatcctttccggagggaggaccgggatctgtggaagaagctcccccacgttccgggccccgacggccgccccatgccgaggaaggcgatcaagacgaagaaggaggcgtccgacaagttctgggatttcgcgaggcaattcttcttcggactgtggggcttcaggcagaggccttaccctcccggccgccccattgatgtggcacaggccatcggatacaaaaggctggagagacgctattatgactgtgagtttctcagcgatgatcgatgatctttcctagttcatgacagatacgcaggtacccaacaagactcctctcagtatcaaacgagggtgctgggaaaaaagtcaacttactgtcgggtcaactcccgcagaaacacttcgatattttcatagctcatatagcagtactcaagcatactcagtgaattggcatgccctgctgacactatctaacatagaagatattgcgttcagtaggaggtttttttgtgcacattaattgatttttttcttcatatttttgctttttgacctgttagatgtgaagggggaaacgatttgggttgaaaacatggaagatttctcagtcttatctcccccatatgattcttatctccttcatttcttcttccacccatctttcttttcctcccttttgagtcaccaaatgctgttcttttacagttttgagaaagataatccagtcgtctgattcgtcaattcttctagtttgattctcgcataaatttatgaaatcataggaatgaataatctgtctttgatccttgaaaattattgtgatgcggcactggtgggcagttcttgaagcaaacggtctgccatttgggcactggatctgccagtctggctcaactggggatgcatcagtggggatccttgttttttcatcttgatccaagaagctgaagatgagagagagagagagagagagattcatccaccaaaacatcaaagaatacaagaattagctttggagatggaagttttgctgctaaatctggggatcccagctttcctttgatccaataagcttaggatgaaccggaagatttcggctctatgcacagttttagacataatccgaataatacaagacatgcttccatggagtgtcccacaatattatcggcaattttggctccatcttcatcttattgaaaccgagcgtgcttctttttctcctcgaccaatcatttcccttggaaagattggggccaaacatcatccatccccttcttcacttttttctctaaagctgctatttttcatacatacatacgtacatgcatatactgatttccatccaaagtatgcttcatgaatcttggttggattttttattagtttaggctaattttttttagatgggttcgtttctgtaagtgaggccagcctgttttctgcagtcatcatgaggagtggcggctggtactacaaggatcgattaggtcggaccaggggaccgttggagctcataactcttaaaactgcgtgggcagctgggataatcgacacccacactttcatatggggtgaggacatggacgaatgggcacctatcggcatggtgtacggtctagagaaggcgattgccacatgggaaggtctgtagattctgttttttttcttcttttttttcgtaattttttgtggccgtgatttaaacgttcataatgccagatgattattaatattattattaccattcgcatgcctcgaagtttctaaacttcgaagatcaaaatattttgtgtattatcctctgaagaacaatgagtgggttcgtgaattctatcttttttgggggggatatgggaaaacatatttatctcaaattgatttcttttcaattgggtttcgttgctctcatcgccactcaatgcatgcatgcagatctttctagcgtcgactagggttccaagtttctggcctccccacatgaacttttttgtgcgctactttgaacatctactcgctcaacagataatatttatcttctgaatttttctggagatattagttacaatctcaattcccctctcttcttgatcccacgcatgctcttgtgtgtcttgattcagatcattaaatccatatgatcttgatcttgatcttgtttcttgttccttcttcttcagttaggctgggtgccgcggccacagccttcctccacaaactgcagaagggcatgtccccggtggccccgctgaagggattcgagaagaagacgtacaggcagctgcaggaggaggccatcgagagcaagcggcgggacatggcggtgctccaggccaacgacggcatctggcccggggtgaggacccccagccacgccctcttcctctgggccagcggcgccgagctcacctccgtcctggaggcggaccacatgcccaacaagttcatctccaaggagctgaggtccgcttcttcctctccttcttcttcgctggtttagggtttctgcaatggagctgaggtccaatggctgcgcttcttgtgcgtcaaggaaccggctttcggggatcatccccgggctgaggccatgggaggtgctcagcgtggagcaggccatggacaagatcacctacggcggcgagtggtaccgggagccgctcggttcctacacgacgggcccgccctacatccgccattggaacaaggacgtcaaggtgccaccttcttcttcttcttcttcttcttctcctcctcctcctggctcttcttcttcgtcttcgtcttcgtcttctcgctctaaaccagagcattctcgcccttctctctgcgcagcgtctgttcaggaccttctacaatctgagctacagggtgtacaacaagctggagcgctccatacccggcttcgacgtcgtcatggagagagttcgctccgactcggaggacaggtacacccggcgcaaggacaagagagacgcccagaagcgagccgaggccgaggaggccatctacggccgcagagtctcctcaacccctccctgaggatcaccttcttcttcctcctcctccctcccaccatcgctgttcttgcccgaggcctctctggttcgtcaggactgatgcgggatgatgctcgggttctggatgatcgatgcctttgggtgcctcatggtttgaagatcttgatcagtcgatccgccctggaggaacagagtagagagagagagagagagagagaagatgaagcgagagctggggatcagtgaggagatgatctgaggaggggaaaggaagtggaggaactcgtggtcgtctcatcggcgaagagtttgtcggctgatttcggtgtgacaatttgtaccctaggaaagagaacaatgaatggattggattgcgaatcaggagatttgaattggagaactcggaggatgaagagctaggggttcatcaaaggattattctaaaatttcagcaatatttttataccggttacaaaatctacgtgcaattcatgctccaggtttaggcgagacgatcttgcgggccaagcaagcttttcctatctggattccagaatttttgcgagaaatgaagaaaagaggggacgaggtatcctttgtgatcagatcactcaccattcagagcgtctcctctctcggcttcatcgaactcgttcgcagggatcaggatggactgcagctctcctgcagatcgaactcgttccgagtacacgagcagatccgcatccagaaggagagacgatccaaaaatgttggcgggggggattcgtccgcaaggaccaggtcctcagcgtgctcgcggtcctcgctgctcgattccttgaacaaaaacccgtgaagacgagagggatggccgaatctaggagacaaggcatcgagatcgggggaggaaggggagggattagggttcttcaggctcacctggccaggcctttgatggcggcactgctcttgccgacgaagtacgacgagaacatcgcgaggtaggcgaaggaagcatcgcatctgacgctgtggatccaatcttcagcaagaacagcgcagattcctctcggattcaagcgcgcagatggcgaagttttctgagagggaggacgaaatcttgaggcttcgagagagagggtatggagagcgcagtccaaccagagagggcgggaaaggtgatatccacagtggacgacacgtggacgggtaagagtattccattcatccacgtggattcctagagagagagagcataacgacagagggcgggagggaaaggtgatggccacggtgatgggacgtggacggtcgggattaatggatccatccacgtggatgcctgtcatgcgacgacagtatatctgggaatccgctctattctactgaggggttttacctcaggggaagctttcggagcagagggaaggcttgggctccggggagaggaggcaggagagggagagcgaaggccgccggcgaggaaggaggaagaaggggaggggaggcggatggtcggaggagtggggtgctcggattccatggcggtggcctcattttgcctcttctcgcttctgatctcccttcatccgcgagggtttggggcggcgacggtgggggtttactgggg

SEQ ID NO: 1259 - DNA, 2289 bp, Taraxacum officinale
gagctgaaaaacaccgatcaaaccgtcaaagtccaatatgaaaaatagataggaccaacccaaagttgatcccaagaaaaccagaccgttttgaaatcgacccgagaccgattggtcacctgcagctctaaattaatttattttttggcaaaatcggctcccctaaattttacttaacagcccataaactcattgagtgatagccgaggcccgagatgtctcaagcaagcttatgctgttttaaatggattggatttgttaggctctcttattggacttaaacgaaaatagcttaattaaactagtccatgaaaagttcaacattccaccgatgacccattcatttcccccaaaacatacgactcgcgagtcactccgccttctatcttcttcatctactccagtcttcagaatttccacccttttctcgacttctgtcactgaattcccactttcgctaatcaatggcttcaattaacttcaacccctttggggaaaactggttcaaaaagccaccaaaccctctacaatccataaaccttcacgcttttgcagattccataaacccattcaaacaccaacctcaattcgatccactttcttcaccatttgcggcactctctatttccaacccattcaagaaaaaaacagaacctgaactcgaaacacaaagacccaaaccaggatactacaaaaaaatgcttgaacagttctactgggagtcggaaaatcgacccgattaccgtcacaccccagaagttgagaggattttaaacgaagacccaatttgggaaaagaaagaaaatccaacccaagaagagattgaagagaacgcgagatggttgaaggaatttcgcgagagtccggttgttcggtttctggcaagggcagaggaggttatggatgagattaacgaaatggagcttaaagagaactcgaaaccgtatagaatggaggatacagagtattggaagtcgattccgcatgtgatcgggcccgacggccggccgatgccgaggaaagctataaggactaaaagggaatccgacgacaagttttgggatttcgccaagcagttcttcttcggattatggggattccagcaacgaccgtatcctcccggccgtccaattgatgtctcccaagctattggatacaagaggctcgaaaagagatattacgactgtaagtctcactcatttcttaaaatctcccaattctgttcatcaaagtcttccattttgctatagaaatctggtaattacatttgaaagtgaattactacaatactacattttcgactctaacatttccacttgaaaatgggctattgttctagtcatcatgaggtctggtggatttttctacaaagaccgaataggtcgatcaagaggaccctgtgaattaatccaactaaagaccgcatggggtgctggaatcatcgataaacatactttcatttggggtgatgacatggacgagtgggtcccaataggcatgctttatggcatggaacgtgcaatcgccacttgggatggttagtatctgtgaactttacaatctttgatcaattaattaactgattattgagataaataaatgtattgaagttgtttaaatttgtacagtgagattaggtgcggcagccacggcttttcttcacaaactacaaaaggggatacctccgtgggtcccgttgaaagggtttgagaaaaaaagccgaaagcagcttcaagaagaagcatatgaaagtaaaagaagggatatggctgttttagaagctaatgatgggatttggccaggtgtcagaattcctagtcatgctttatttctttgggctagtggatccgaactcacatctattttggaacaagaccatatgcccaacaaattcattcccaaagatatgcggtaattctaattcattgacatcagtttcagtctcagttcaatgcatgccgatgtagtacaagattgtctgttatagatcccttttacaaaatttgttaaatatcttacgatcaattttttttgttaattaggaaacaactggaaaaagctatcccgggtttgaggccatgggaggttttaagtgtagaacaagccatggatcagataacttatggcggtgaatggtatcgtgaacctcttggcttttatagaacttggcctcaatacatcgaggaatggactgaagatgttgaggtatacatttgtttcacagttgcaatatcagtatcaatatcagtatcagtatttgagtgtttttgtttggtgattgcaggagtt

SEQ ID NO: 1260 - DNA, 2958 bp, Trifolium repens
ttggctttgtagattttggccgtgtttggtgaaaattagcagatagttgataagatagtttatagcagatgaacttatagcgaataacttataagataggttataacaactaagctagctgattgaattggtagtgtttggtaaaattagttattaaactaacttataaatatgaaatgacataaaaatatatgtttaataataattagtttttgtcaagtaagatgattatcaaaattgagagaaaaagtgataagctaaaagctataagctaattgaattagcttatcaaaataagttataaacctgtgaagaaaaaagtgttaccaaacgggtcttttttcccatatgagcttataagttgcaagtcataagctcaaaatatggcatcgggtagttgaatcacatgtttgatacaatcatatgatttggattgttgtataaagattccattgtttggataaggaacttaattaagcgcttatagtatatacatttgtcatatagattcatataaagtcaaattgaattcgaataagttgtaagttgtttttgtaggttatcctagtggagagcttatgaaaataagttgaaaataattatggacatatcataagttgtttctgtaagctctttcaaactgtctcacaagtgtttgtgctagtagataaactcaaataagtctattaaaacatatatggttcacgtttccaagttttgtaaattgtgtgtaaaatataaagttggattggagttgtccaatgttgatttgatggcttaaatgggaggttttctgattgtgtgaatttaaggaattcgaatttgcaaatatgtgcttgaatatgtgttttgaaatgtttaattatttagtattatttagataaattagtttctttgatatagtgttggtaaacatagatgtgagactcatttctaagccttgttaggatttgtagccacacatttgtagattttggctgttagatgaagatagggcgactaatatttaagatgtattgtagaatctatttggtgaagttagaatacgagaagttcaatcttcatccagtagttggaacttggaataccttcaccgtattgtgtgcattctctaactgtatggaattcgagtgtctttgcaagaggccgagacgtgatatgtatgtaattgtattgaacttgactaatttgaagtgaacattaaagagtaaagtaagatatttcaagcattgatgagaaaatcaatcttgatattccaacacattcatgatttgttattcatgggcacatagatatttcaatccttgcctcaaaataaaagatcaattactatgattgattactttataggttaccgagatgatccaaaattggctattctatgattcaaacaagcaaatcccgaatactaggagtaatgccactttttttacaaacatattttgtactgaatagtagctctatggaagtatcggtccatcagcttctaatttctcagttatgcagacaggttgagacaacttagaacatatgaaagccgtattatcatttgcggattgtggaaatagcaggttgttcaaatcctgcgatgctacaatgctatagtgcccttatagctgctatttaagaacactttgtattaaatcacatatcatgagacagtagcagtttgttcaaattatactacggtttagcgccacaatttgacaatacttattcaaattataccaatgttgaacaaacgccatatgttttgattcctgatctaacatatctactatctcatgtattttctcattgtttttgagttatttctttgtgtatgactttgtttctattttctatttgatttagttatcatgaagagtaatatatggttctataaggatcggctgggtcgaacgcgagggccattggcattgattacacttaaaactgcttggggtggtggggttattgataaaaacactttcatttggggtgaggatatggatgaatttgcgcccatccacatgatttatggaatggagcgtgcaatcgcgacttgggaaggtaagttgagttccatctattttaatttatataatatattttctttgataaaatctgattcttggttttgcgattctttagttcgacttgctgcttcagcgacagctttctttcacaaactacagaaaggtataccaccgtgggttcctcttaagggatttgaaaggaaaagttataagcagcttcaagaagaggctatagaaagcaagaggcgtgatttagcagtgattgaagcaaatggtggcatttggcccggagttagaattccaagtcatgctctatttctttgggctagtggcactgaactcacccctactttggaagaagaccacatgcccaacaagtacattcccaaagatctcaggtatatctgctgggactttattatataaatataattattatgtgttttgacttccatttgcacaaaatgttctgcaaaatacagtaggaagttttaataaatgactgtgttgttaaatagcggtgcaacagcgctatagtgtagcggaatttgaccaaattgctattgttctgcgatacgctatttttagtacaaaagtttgtcaaatagatgctatactatagcattgttgtgtcgcggaatttgaacaaactgctatgtctgtgattgacaacaccgataaattgtgattgttatgttctccgctttattattgttataaactcttgccttcctacctgccccttctggtatttactaatatgtttaattattttatttggtttggggggatggctgtgagatagacagaagttggctaaacttattccaggattgaggccatgggaagttctgagcatagaacaagcaatggatcaaatagcattcaatggtcaatggtaccgtgaaccacttggttcgtacaccactggtccgccatt

SEQ ID NO: 1261 - DNA, 292 bp, Trifolium repens
accacaggtcgaaaaaatcctcaaccctaacccaacagaacaagaaataaaccaaaacgtagagtttatggataaattatttgaaaatccagttatacagtttcttatgagagcagagtatattgctgataagatgaatgagattgaagtgaagaagaatgataaaccttttaggaaagaagatagggatatttggaagaaagtgccaaatgtaattgggcttgatggtaggcctatgccgagaaaggcgctgaggaggaattcggcaagggatacgttttgggattttgct

SEQ ID NO: 1262 - DNA, 797 bp, Xanthium strumarium
cttaagaccgcttggggtgcggggatcattgataagtatacttttatttggggtgatgatatggatgagtgggtcccaattggcatgatttatggtatggagcgtgctgtcgccacttgggaagtgagactaggtgctgcagcaaccgctttcattcataaattacagaagggtatacctccatgggtcccactaaaagggtttgagaaaaaaagccttaaacagctacaagatgaagcttatgaaagcaagcaacgtgatttagctgtactagaagcgaatgatggaatttggcccggtgttagaattcccagtcatgctctatttctttgggctagtgggtccgagctcacttcaattttggaacaagatcacatgcctaacaaatacatccccaaagatatgaggaaacagttgcaaaaagctattccagggttgaggccatgggaggttttaagtgtagaacaagccatggatcaaataacatatggcggtcaatggtaccgtgaaccacttggtttatatacaacagggccaccatacatccgggactggaatgatgatgttgaggacttccttgactcataccagcaattcacagatctgatgtgtgattatctagaggaagttatcccggggttcaacaaggtactggataaagtagatgcagaagctgaggagaaataccgaagacgaacggaaagcgggaagaggaaattagaagcaataaagcgggcccgacacccacaaagagttgatcccaatgccgacgaggatgatgatttatgaggtgtcat

SEQ ID NO: 1263 - DNA, 855 bp, Xanthium strumarium
aaacaactcactcctcttcctatcatcatcatcttcttctcttcttccaatcaatcaatggcgtcagttaacttcaacccatttggcgaaaactggttcaagaaaccgccaaacctcttccaacccattaacatccacaatcttttacaatctttaaaccccctcaaaccccacctccaacccctttccccctttgccgccatctccctttccaacccattcaccaaaaaatccgaacgtggaccccactttaaaagacccaaacccaaacccggaacctacaagcaaatgctccaacagtattactgggaatgtgaaaaccgacccgattaccgccatacccctgaagttgaaaacatattgaaccaagaccccatttttgaaaagaaagataacccgacccaggaagagattgaagagaatgagagatggttgaaggagtttagagagagtccggttgttaagttcttggcccgggcagaggaggttcttgatgagattaatcaaatggagcttaaggagaactctgaaccctataggtgggaggataagaagtattggaagtcgataccgcatgtgatcgggccggatggccggccgatgcccaggaaagctataaagagtaagaaggaatcagatgataagttttgggattttgctaagcagttcttttttgggctgtggggatttcggcagcgaccgtatcctcccggccggcccattgatgttgctcaggctgttgggtataagagactggagaagagatattatgattttatcatgagatctggtggatggtactacaaggatcggataggaagaacaaggggaccttgtgaattgatacaacttaag

SEQ ID NO: 1264 - DNA, 25 bp, Amaranthus palmeri
tttggtaatgaatgtggttgagcgt

SEQ ID NO: 1265 - DNA, 25 bp, Amaranthus palmeri
ttggtaatgaatgtggttgagcgtg

SEQ ID NO: 1266 - DNA, 25 bp, Amaranthus palmeri
ttgatttggtaatgaatgtggttga

SEQ ID NO: 1267 - DNA, 25 bp, Amaranthus palmeri
tggtaatgaatgtggttgagcgtgt

SEQ ID NO: 1268 - DNA, 25 bp, Amaranthus palmeri
tggattgaaggtgatgataagcgta

SEQ ID NO: 1269 - DNA, 25 bp, Amaranthus palmeri
tgatttggtaatgaatgtggttgag

SEQ ID NO: 1270 - DNA, 25 bp, Amaranthus palmeri
tcacacgctcaaccacattcattac

SEQ ID NO: 1271 - DNA, 25 bp, Amaranthus palmeri
tcaaccacattcattaccaaatcaa

SEQ ID NO: 1272 - DNA, 25 bp, Amaranthus palmeri
tacgcttatcatcaccttcaatcca

SEQ ID NO: 1273 - DNA, 25 bp, Amaranthus palmeri
taatgaatgtggttgagcgtgtgag

SEQ ID NO: 1274 - DNA, 25 bp, Amaranthus palmeri
gttgatttggtaatgaatgtggttg

SEQ ID NO: 1275 - DNA, 25 bp, Amaranthus palmeri
gtacgcttatcatcaccttcaatcc

SEQ ID NO: 1276 - DNA, 25 bp, Amaranthus palmeri
gtaatgaatgtggttgagcgtgtga

SEQ ID NO: 1277 - DNA, 25 bp, Amaranthus palmeri
ggtaatgaatgtggttgagcgtgtg

SEQ ID NO: 1278 - DNA, 25 bp, Amaranthus palmeri
ggtaaagttgatttggtaatgaatg

SEQ ID NO: 1279 - DNA, 25 bp, Amaranthus palmeri
ggattgaaggtgatgataagcgtac

SEQ ID NO: 1280 - DNA, 25 bp, Amaranthus palmeri
gctcaaccacattcattaccaaatc

SEQ ID NO: 1281 - DNA, 25 bp, Amaranthus palmeri
gatttggtaatgaatgtggttgagc

SEQ ID NO: 1282 - DNA, 25 bp, Amaranthus palmeri
ctcacacgctcaaccacattcatta

SEQ ID NO: 1283 - DNA, 25 bp, Amaranthus palmeri
ctcaaccacattcattaccaaatca

SEQ ID NO: 1284 - DNA, 25 bp, Amaranthus palmeri
tttccaccctcatctttgatctcct

SEQ ID NO: 1285 - DNA, 25 bp, Amaranthus palmeri
tttagcttcatcgagtttcgggtct

SEQ ID NO: 1286 - DNA, 25 bp, Amaranthus palmeri
ttctggtacggctacatgattcatg

SEQ ID NO: 1287 - DNA, 25 bp, Amaranthus palmeri
ttccaccctcatctttgatctcctc

SEQ ID NO: 1288 - DNA, 25 bp, Amaranthus palmeri
ttccacatgaatcatgtagccgtac

SEQ ID NO: 1289 - DNA, 25 bp, Amaranthus palmeri
ttcatcgagtttcgggtctgtttca

SEQ ID NO: 1290 - DNA, 25 bp, Amaranthus palmeri
ttagcttcatcgagtttcgggtctg

SEQ ID NO: 1291 - DNA, 25 bp, Amaranthus palmeri
ttacttctggtacggctacatgatt

SEQ ID NO: 1292 - DNA, 25 bp, Amaranthus palmeri
tggtacggctacatgattcatgtgg

SEQ ID NO: 1293 - DNA, 25 bp, Amaranthus palmeri
tggaagcatggcagaatgcatggtt

SEQ ID NO: 1294 - DNA, 25 bp, Amaranthus palmeri
tgatttagcttcatcgagtttcggg

SEQ ID NO: 1295 - DNA, 25 bp, Amaranthus palmeri
tgatgatttagcttcatcgagtttc

SEQ ID NO: 1296 - DNA, 25 bp, Amaranthus palmeri
tgatgatgatttagcttcatcgagt

SEQ ID NO: 1297 - DNA, 25 bp, Amaranthus palmeri
tgatgatgatgatttagcttcatcg

SEQ ID NO: 1298 - DNA, 25 bp, Amaranthus palmeri
tgatgatgatgatgatttagcttca

SEQ ID NO: 1299 - DNA, 25 bp, Amaranthus palmeri
tgaatcatgtagccgtaccagaagt

SEQ ID NO: 1300 - DNA, 25 bp, Amaranthus palmeri
tgaagctaaatcatcatcatcatca

SEQ ID NO: 1301 - DNA, 25 bp, Amaranthus palmeri
tgaaacagacccgaaactcgatgaa

SEQ ID NO: 1302 - DNA, 25 bp, Amaranthus palmeri
tctggtacggctacatgattcatgt

SEQ ID NO: 1303 - DNA, 25 bp, Amaranthus palmeri
tctgaaacagacccgaaactcgatg

SEQ ID NO: 1304 - DNA, 25 bp, Amaranthus palmeri
agcttctgaaatgcccgacgctgtt

SEQ ID NO: 1305 - DNA, 25 bp, Amaranthus palmeri
aacagcgtcgggcatttcagaagct

SEQ ID NO: 1306 - DNA, 25 bp, Amaranthus palmeri
tgtgctgctttccttacagatgctt

SEQ ID NO: 1307 - DNA, 25 bp, Amaranthus palmeri
gtgctgctttccttacagatgcttt

SEQ ID NO: 1308 - DNA, 25 bp, Amaranthus palmeri
gcttctgaaatgcccgacgctgttc

SEQ ID NO: 1309 - DNA, 25 bp, Amaranthus palmeri
gaacagcgtcgggcatttcagaagc

SEQ ID NO: 1310 - DNA, 25 bp, Amaranthus palmeri
aagcatctgtaaggaaagcagcaca

SEQ ID NO: 1311 - DNA, 25 bp, Amaranthus palmeri
aaagcatctgtaaggaaagcagcac

SEQ ID NO: 1312 - DNA, 25 bp, Amaranthus palmeri
tttgagcatattctgcaggcagccc

SEQ ID NO: 1313 - DNA, 25 bp, Amaranthus palmeri
tttctctgcctcaataaagccacgg

SEQ ID NO: 1314 - DNA, 25 bp, Amaranthus palmeri
tttcaatggcagcagccatctttga

SEQ ID NO: 1315 - DNA, 25 bp, Amaranthus palmeri
tttagacagcaggccgaggtcattt

SEQ ID NO: 1316 - DNA, 25 bp, Amaranthus palmeri
ttggttcaagccgtggctttattga

SEQ ID NO: 1317 - DNA, 25 bp, Amaranthus palmeri
ttgctgaagcttctgtcgatatatt

SEQ ID NO: 1318 - DNA, 25 bp, Amaranthus palmeri
ttgccagcaattgacatagcagctt

SEQ ID NO: 1319 - DNA, 25 bp, Amaranthus palmeri
ttctgtcgatatatttcttcatgga

SEQ ID NO: 1320 - DNA, 25 bp, Amaranthus palmeri
ttctctgcctcaataaagccacggc

SEQ ID NO: 1321 - DNA, 25 bp, Amaranthus palmeri
ttcaatggcagcagccatctttgaa

SEQ ID NO: 1322 - DNA, 25 bp, Amaranthus palmeri
ttcaagccgtggctttattgaggca

SEQ ID NO: 1323 - DNA, 25 bp, Amaranthus palmeri
ttcaaagatggctgctgccattgaa

SEQ ID NO: 1324 - DNA, 25 bp, Amaranthus palmeri
tgctgcatatatccaaattccatat

SEQ ID NO: 1325 - DNA, 25 bp, Amaranthus palmeri
tcatatggaatttggatatatgcag

SEQ ID NO: 1326 - DNA, 25 bp, Amaranthus palmeri
tatggaatttggatatatgcagcat

SEQ ID NO: 1327 - DNA, 25 bp, Amaranthus palmeri
gctgcatatatccaaattccatatg

SEQ ID NO: 1328 - DNA, 25 bp, Amaranthus palmeri
gatgctgcatatatccaaattccat

SEQ ID NO: 1329 - DNA, 25 bp, Amaranthus palmeri
ctgcatatatccaaattccatatga

SEQ ID NO: 1330 - DNA, 25 bp, Amaranthus palmeri
catatggaatttggatatatgcagc

SEQ ID NO: 1331 - DNA, 25 bp, Amaranthus palmeri
atggaatttggatatatgcagcatc

SEQ ID NO: 1332 - DNA, 25 bp, Amaranthus palmeri
atgctgcatatatccaaattccata

SEQ ID NO: 1333 - DNA, 25 bp, Amaranthus palmeri
atatggaatttggatatatgcagca

SEQ ID NO: 1334 - DNA, 25 bp, Amaranthus palmeri
tttgtgcttaccttgggatcgtgag

SEQ ID NO: 1335 - DNA, 25 bp, Amaranthus palmeri
tttgtatgcgatgctgcatatatcc

SEQ ID NO: 1336 - DNA, 25 bp, Amaranthus palmeri
tttggatatatgcagcatcgcatac

SEQ ID NO: 1337 - DNA, 25 bp, Amaranthus palmeri
tttgcaggttgttggtactgtcagt

SEQ ID NO: 1338 - DNA, 25 bp, Amaranthus palmeri
tttctcctcacgatcccaaggtaag

SEQ ID NO: 1339 - DNA, 25 bp, Amaranthus palmeri
ttgttggtactgtcagtcgttggct

SEQ ID NO: 1340 - DNA, 25 bp, Amaranthus palmeri
ttgtgcttaccttgggatcgtgagg

SEQ ID NO: 1341 - DNA, 25 bp, Amaranthus palmeri
ttgtatgcgatgctgcatatatcca

SEQ ID NO: 1342 - DNA, 25 bp, Amaranthus palmeri
ttggtactgtcagtcgttggctgcc

SEQ ID NO: 1343 - DNA, 25 bp, Amaranthus palmeri
ttgggatcgtgaggagaaaggagtg

SEQ ID NO: 1344 - DNA, 25 bp, Amaranthus palmeri
tttggaattgttgcgatcagtgaca

SEQ ID NO: 1345 - DNA, 25 bp, Amaranthus palmeri
tttgaatcttcttggtatgggctct

SEQ ID NO: 1346 - DNA, 25 bp, Amaranthus palmeri
tttcctctttggaattgttgcgatc

SEQ ID NO: 1347 - DNA, 25 bp, Amaranthus palmeri
tttattgctgttgataattgtgcag

SEQ ID NO: 1348 - DNA, 25 bp, Amaranthus palmeri
ttgttgcgatcagtgacatcaccta

SEQ ID NO: 1349 - DNA, 25 bp, Amaranthus palmeri
ttggtatgggctctgcggtcttggg

SEQ ID NO: 1350 - DNA, 25 bp, Amaranthus palmeri
ttggaattgttgcgatcagtgacat

SEQ ID NO: 1351 - DNA, 25 bp, Amaranthus palmeri
ttgcgatcagtgacatcacctagcg

SEQ ID NO: 1352 - DNA, 25 bp, Amaranthus palmeri
ttgcaatcccaagaccgcagagccc

SEQ ID NO: 1353 - DNA, 25 bp, Amaranthus palmeri
ttgaccgctaggtgatgtcactgat

SEQ ID NO: 1354 - DNA, 25 bp, Amaranthus palmeri
ttgaatcttcttggtatgggctctg

SEQ ID NO: 1355 - DNA, 25 bp, Amaranthus palmeri
ttcttggtatgggctctgcggtctt

SEQ ID NO: 1356 - DNA, 25 bp, Amaranthus palmeri
ttcggacttgtttcctctttggaat

SEQ ID NO: 1357 - DNA, 25 bp, Amaranthus palmeri
ttcctctttggaattgttgcgatca

SEQ ID NO: 1358 - DNA, 25 bp, Amaranthus palmeri
ttccaaagaggaaacaagtccgaag

SEQ ID NO: 1359 - DNA, 25 bp, Amaranthus palmeri
ttattgctgttgataattgtgcagt

SEQ ID NO: 1360 - DNA, 25 bp, Amaranthus palmeri
tgtttcctctttggaattgttgcga

SEQ ID NO: 1361 - DNA, 25 bp, Amaranthus palmeri
tgttgcgatcagtgacatcacctag

SEQ ID NO: 1362 - DNA, 25 bp, Amaranthus palmeri
tgtcactgatcgcaacaattccaaa

SEQ ID NO: 1363 - DNA, 25 bp, Amaranthus palmeri
tggtatgggctctgcggtcttggga

SEQ ID NO: 1364 - DNA, 25 bp, Amaranthus palmeri
tttgctatgcaacaaactttcaaga

SEQ ID NO: 1365 - DNA, 25 bp, Amaranthus palmeri
tttcaagactatgatgagccagatg

SEQ ID NO: 1366 - DNA, 25 bp, Amaranthus palmeri
ttgttgcatagcaaatttcttcaac

SEQ ID NO: 1367 - DNA, 25 bp, Amaranthus palmeri
ttgctatgcaacaaactttcaagac

SEQ ID NO: 1368 - DNA, 25 bp, Amaranthus palmeri
ttgcatagcaaatttcttcaaccat

SEQ ID NO: 1369 - DNA, 25 bp, Amaranthus palmeri
ttcaagactatgatgagccagatgg

SEQ ID NO: 1370 - DNA, 25 bp, Amaranthus palmeri
tgttgcatagcaaatttcttcaacc

SEQ ID NO: 1371 - DNA, 25 bp, Amaranthus palmeri
tggttgaagaaatttgctatgcaac

SEQ ID NO: 1372 - DNA, 25 bp, Amaranthus palmeri
tggctcatcatagtcttgaaagttt

SEQ ID NO: 1373 - DNA, 25 bp, Amaranthus palmeri
tgctatgcaacaaactttcaagact

SEQ ID NO: 1374 - DNA, 25 bp, Amaranthus palmeri
tgcatagcaaatttcttcaaccatg

SEQ ID NO: 1375 - DNA, 25 bp, Amaranthus palmeri
tgcaacaaactttcaagactatgat

SEQ ID NO: 1376 - DNA, 25 bp, Amaranthus palmeri
tgaagaaatttgctatgcaacaaac

SEQ ID NO: 1377 - DNA, 25 bp, Amaranthus palmeri
tcttgaaagtttgttgcatagcaaa

SEQ ID NO: 1378 - DNA, 25 bp, Amaranthus palmeri
tctggctcatcatagtcttgaaagt

SEQ ID NO: 1379 - DNA, 25 bp, Amaranthus palmeri
tcccatctggctcatcatagtcttg

SEQ ID NO: 1380 - DNA, 25 bp, Amaranthus palmeri
tcatcatagtcttgaaagtttgttg

SEQ ID NO: 1381 - DNA, 25 bp, Amaranthus palmeri
tcatagtcttgaaagtttgttgcat

SEQ ID NO: 1382 - DNA, 25 bp, Amaranthus palmeri
tcaagactatgatgagccagatggg

SEQ ID NO: 1383 - DNA, 25 bp, Amaranthus palmeri
tatgcaacaaactttcaagactatg

SEQ ID NO: 1384 - DNA, 25 bp, Amaranthus palmeri
ttaagttgaatcagctcacatggtc

SEQ ID NO: 1385 - DNA, 25 bp, Amaranthus palmeri
tcttctcggaacatattcatggctt

SEQ ID NO: 1386 - DNA, 25 bp, Amaranthus palmeri
tcttaagttgaatcagctcacatgg

SEQ ID NO: 1387 - DNA, 25 bp, Amaranthus palmeri
tcatgtccttgattacagctttact

SEQ ID NO: 1388 - DNA, 25 bp, Amaranthus palmeri
taagttgaatcagctcacatggtcc

SEQ ID NO: 1389 - DNA, 25 bp, Amaranthus palmeri
taaagctgtaatcaaggacatgagg

SEQ ID NO: 1390 - DNA, 25 bp, Amaranthus palmeri
gtcttaagttgaatcagctcacatg

SEQ ID NO: 1391 - DNA, 25 bp, Amaranthus palmeri
gtaaagctgtaatcaaggacatgag

SEQ ID NO: 1392 - DNA, 25 bp, Amaranthus palmeri
ggaccatgtgagctgattcaactta

SEQ ID NO: 1393 - DNA, 25 bp, Amaranthus palmeri
gcctcatgtccttgattacagcttt

SEQ ID NO: 1394 - DNA, 25 bp, Amaranthus palmeri
gccatgaatatgttccgagaagatg

SEQ ID NO: 1395 - DNA, 25 bp, Amaranthus palmeri
gcatcttctcggaacatattcatgg

SEQ ID NO: 1396 - DNA, 25 bp, Amaranthus palmeri
gaggaccatgtgagctgattcaact

SEQ ID NO: 1397 - DNA, 25 bp, Amaranthus palmeri
gaccatgtgagctgattcaacttaa

SEQ ID NO: 1398 - DNA, 25 bp, Amaranthus palmeri
cttaagttgaatcagctcacatggt

SEQ ID NO: 1399 - DNA, 25 bp, Amaranthus palmeri
ctcatgtccttgattacagctttac

SEQ ID NO: 1400 - DNA, 25 bp, Amaranthus palmeri
cgcctcatgtccttgattacagctt

SEQ ID NO: 1401 - DNA, 25 bp, Amaranthus palmeri
cctcatgtccttgattacagcttta

SEQ ID NO: 1402 - DNA, 25 bp, Amaranthus palmeri
ccatgtgagctgattcaacttaaga

SEQ ID NO: 1403 - DNA, 25 bp, Amaranthus palmeri
ccatgaatatgttccgagaagatgc

SEQ ID NO: 1404 - DNA, 25 bp, Amaranthus palmeri
ttggtactggtaatgatgcagcacc

SEQ ID NO: 1405 - DNA, 25 bp, Amaranthus palmeri
tggtggtgctgcatcattaccagta

SEQ ID NO: 1406 - DNA, 25 bp, Amaranthus palmeri
tggtgctgcatcattaccagtacca

SEQ ID NO: 1407 - DNA, 25 bp, Amaranthus palmeri
tggtactggtaatgatgcagcacca

SEQ ID NO: 1408 - DNA, 25 bp, Amaranthus palmeri
tggtaatgatgcagcaccaccagat

SEQ ID NO: 1409 - DNA, 25 bp, Amaranthus palmeri
tgctgcatcattaccagtaccaatg

SEQ ID NO: 1410 - DNA, 25 bp, Amaranthus palmeri
tgcagcaccaccagattcttcatca

SEQ ID NO: 1411 - DNA, 25 bp, Amaranthus palmeri
tgatgcagcaccaccagattcttca

SEQ ID NO: 1412 - DNA, 25 bp, Amaranthus palmeri
tgatgaagaatctggtggtgctgca

SEQ ID NO: 1413 - DNA, 25 bp, Amaranthus palmeri
tgaagaatctggtggtgctgcatca

SEQ ID NO: 1414 - DNA, 25 bp, Amaranthus palmeri
tctggtggtgctgcatcattaccag

SEQ ID NO: 1415 - DNA, 25 bp, Amaranthus palmeri
tactggtaatgatgcagcaccacca

SEQ ID NO: 1416 - DNA, 25 bp, Amaranthus palmeri
taatgatgcagcaccaccagattct

SEQ ID NO: 1417 - DNA, 25 bp, Amaranthus palmeri
gtggtgctgcatcattaccagtacc

SEQ ID NO: 1418 - DNA, 25 bp, Amaranthus palmeri
gtgctgcatcattaccagtaccaat

SEQ ID NO: 1419 - DNA, 25 bp, Amaranthus palmeri
gtactggtaatgatgcagcaccacc

SEQ ID NO: 1420 - DNA, 25 bp, Amaranthus palmeri
gtaatgatgcagcaccaccagattc

SEQ ID NO: 1421 - DNA, 25 bp, Amaranthus palmeri
ggtggtgctgcatcattaccagtac

SEQ ID NO: 1422 - DNA, 25 bp, Amaranthus palmeri
ggtgctgcatcattaccagtaccaa

SEQ ID NO: 1423 - DNA, 25 bp, Amaranthus palmeri
ggtactggtaatgatgcagcaccac

SEQ ID NO: 1424 - DNA, 25 bp, Amaranthus palmeri
tggacacccatggttgggaccatga

SEQ ID NO: 1425 - DNA, 25 bp, Amaranthus palmeri
tcatggtcccaaccatgggtgtcca

SEQ ID NO: 1426 - DNA, 25 bp, Amaranthus palmeri
ggctggattcacagacaagagatct

SEQ ID NO: 1427 - DNA, 25 bp, Amaranthus palmeri
gacacccatggttgggaccatgatt

SEQ ID NO: 1428 - DNA, 25 bp, Amaranthus palmeri
caatcatggtcccaaccatgggtgt

SEQ ID NO: 1429 - DNA, 25 bp, Amaranthus palmeri
agatctcttgtctgtgaatccagcc

SEQ ID NO: 1430 - DNA, 25 bp, Amaranthus palmeri
acacccatggttgggaccatgattg

SEQ ID NO: 1431 - DNA, 25 bp, Amaranthus palmeri
aatcatggtcccaaccatgggtgtc

SEQ ID NO: 1432 - DNA, 25 bp, Amaranthus palmeri
tttgtgggacagcgtagtcatatta

SEQ ID NO: 1433 - DNA, 25 bp, Amaranthus palmeri
tttggttacctgcacagttactgct

SEQ ID NO: 1434 - DNA, 25 bp, Amaranthus palmeri
tttgagcgagtagcatagcaacaat

SEQ ID NO: 1435 - DNA, 25 bp, Amaranthus palmeri
tttccttgaacatcctggttcttgg

SEQ ID NO: 1436 - DNA, 25 bp, Amaranthus palmeri
tttcctccgattgccaagtctcctc

SEQ ID NO: 1437 - DNA, 25 bp, Amaranthus palmeri
tttcccaagaaccaggatgttcaag

SEQ ID NO: 1438 - DNA, 25 bp, Amaranthus palmeri
tttatgtggataggctggattcaca

SEQ ID NO: 1439 - DNA, 25 bp, Amaranthus palmeri
tttaccttctcttcaccaaatattg

SEQ ID NO: 1440 - DNA, 25 bp, Amaranthus palmeri
ttgtgggacagcgtagtcatattat

SEQ ID NO: 1441 - DNA, 25 bp, Amaranthus palmeri
ttgtctgtgaatccagcctatccac

SEQ ID NO: 1442 - DNA, 25 bp, Amaranthus palmeri
ttgtcctcaagatgggtagatcatt

SEQ ID NO: 1443 - DNA, 25 bp, Amaranthus palmeri
ttggttacctgcacagttactgctg

SEQ ID NO: 1444 - DNA, 25 bp, Amaranthus palmeri
tttggtcaagactatcattgatgtt

SEQ ID NO: 1445 - DNA, 25 bp, Amaranthus palmeri
tttcttctggataagacaatcgatg

SEQ ID NO: 1446 - DNA, 25 bp, Amaranthus palmeri
tttcatggataccaaatttggtcaa

SEQ ID NO: 1447 - DNA, 25 bp, Amaranthus palmeri
ttgtcttatccagaagaaagccttt

SEQ ID NO: 1448 - DNA, 25 bp, Amaranthus palmeri
ttgtcaaccaagatacccttacttc

SEQ ID NO: 1449 - DNA, 25 bp, Amaranthus palmeri
ttggtcaagactatcattgatgttg

SEQ ID NO: 1450 - DNA, 25 bp, Amaranthus palmeri
ttgaccaaatttggtatccatgaaa

SEQ ID NO: 1451 - DNA, 25 bp, Amaranthus palmeri
ttcttctggataagacaatcgatgt

SEQ ID NO: 1452 - DNA, 25 bp, Amaranthus palmeri
ttctggataagacaatcgatgtatt

SEQ ID NO: 1453 - DNA, 25 bp, Amaranthus palmeri
ttcatggataccaaatttggtcaag

SEQ ID NO: 1454 - DNA, 25 bp, Amaranthus palmeri
tgtcaaccaagatacccttacttcc

SEQ ID NO: 1455 - DNA, 25 bp, Amaranthus palmeri
tggtcaagactatcattgatgttgt

SEQ ID NO: 1456 - DNA, 25 bp, Amaranthus palmeri
tggataccaaatttggtcaagacta

SEQ ID NO: 1457 - DNA, 25 bp, Amaranthus palmeri
tggataagacaatcgatgtattgct

SEQ ID NO: 1458 - DNA, 25 bp, Amaranthus palmeri
tggaagtaagggtatcttggttgac

SEQ ID NO: 1459 - DNA, 25 bp, Amaranthus palmeri
tgatggattgagttacgaagacttc

SEQ ID NO: 1460 - DNA, 25 bp, Amaranthus palmeri
tgatagtcttgaccaaatttggtat

SEQ ID NO: 1461 - DNA, 25 bp, Amaranthus palmeri
tgaccaaatttggtatccatgaaac

SEQ ID NO: 1462 - DNA, 25 bp, Amaranthus palmeri
tcttgaccaaatttggtatccatga

SEQ ID NO: 1463 - DNA, 25 bp, Amaranthus palmeri
tcttctggataagacaatcgatgta

SEQ ID NO: 1464 - DNA, 25 bp, Amaranthus palmeri
tacaggagaatgggcaagggttcgt

SEQ ID NO: 1465 - DNA, 25 bp, Amaranthus palmeri
gacgaacccttgcccattctcctgt

SEQ ID NO: 1466 - DNA, 25 bp, Amaranthus palmeri
acgaacccttgcccattctcctgta

SEQ ID NO: 1467 - DNA, 25 bp, Amaranthus palmeri
acaggagaatgggcaagggttcgtc

SEQ ID NO: 1468 - DNA, 25 bp, Amaranthus palmeri
tttgctgaacatggaaacgatcttg

SEQ ID NO: 1469 - DNA, 25 bp, Amaranthus palmeri
tttgaaatggtttctttgagacctg

SEQ ID NO: 1470 - DNA, 25 bp, Amaranthus palmeri
tttcttcaatggtggaaacggaggt

SEQ ID NO: 1471 - DNA, 25 bp, Amaranthus palmeri
tttctcaaagcttgcttgcctgctt

SEQ ID NO: 1472 - DNA, 25 bp, Amaranthus palmeri
tttcagtcatatcaggatccatctc

SEQ ID NO: 1473 - DNA, 25 bp, Amaranthus palmeri
tttcaaagaatgaatcttcagtacc

SEQ ID NO: 1474 - DNA, 25 bp, Amaranthus palmeri
tttatatttctcaaagcttgcttgc

SEQ ID NO: 1475 - DNA, 25 bp, Amaranthus palmeri
tttagttacttgtggaatgtttgag

SEQ ID NO: 1476 - DNA, 25 bp, Amaranthus palmeri
tttacaggagaatgggcaagggttc

SEQ ID NO: 1477 - DNA, 25 bp, Amaranthus palmeri
tttaatatagaagcaggcaagcaag

SEQ ID NO: 1478 - DNA, 25 bp, Amaranthus palmeri
ttgtgtgggagaccttccaagttat

SEQ ID NO: 1479 - DNA, 25 bp, Amaranthus palmeri
ttggtgcagctagaaacattcttga

SEQ ID NO: 1480 - DNA, 25 bp, Amaranthus palmeri
ttggtactgaagattcattctttga

SEQ ID NO: 1481 - DNA, 25 bp, Amaranthus palmeri
ttgcttgcctgcttctatattaaag

SEQ ID NO: 1482 - DNA, 25 bp, Amaranthus palmeri
ttgctgaacatggaaacgatcttgg

SEQ ID NO: 1483 - DNA, 25 bp, Amaranthus palmeri
ttgcccattctcctgtaaacttcag

SEQ ID NO: 1484 - DNA, 25 bp, Amaranthus palmeri
ctttcttgcctgcttcaatgttata

SEQ ID NO: 1485 - DNA, 25 bp, Amaranthus palmeri
cccagagaggttatatttctcaaag

SEQ ID NO: 1486 - DNA, 25 bp, Amaranthus palmeri
atggacttcaatgtttgaaaataat

SEQ ID NO: 1487 - DNA, 25 bp, Amaranthus palmeri
cttcattctgttcatcatgccgagt

SEQ ID NO: 1488 - DNA, 25 bp, Amaranthus palmeri
cttcattctgttcatcatgccgagt

SEQ ID NO: 1489 - DNA, 25 bp, Amaranthus palmeri
agcttaatctcaacaataattcctc

SEQ ID NO: 1490 - DNA, 25 bp, Amaranthus palmeri
agcttaatctcaacaataattcctc

SEQ ID NO: 1491 - DNA, 25 bp, Amaranthus palmeri
caatattccactctgtagttagttc

SEQ ID NO: 1492 - DNA, 25 bp, Amaranthus palmeri
caatattccactctgtagttagttc

SEQ ID NO: 1493 - DNA, 25 bp, Amaranthus palmeri
tttggacgaccatgaggcccaggaa

SEQ ID NO: 1494 - DNA, 25 bp, Amaranthus palmeri
cccacctggctgtaaagaagccagt

SEQ ID NO: 1495 - DNA, 25 bp, Amaranthus palmeri
tgtttcggtgttgaaaagagacggt

SEQ ID NO: 1496 - DNA, 25 bp, Amaranthus palmeri
tgtaatgatctattaagacctttga

SEQ ID NO: 1497 - DNA, 25 bp, Amaranthus palmeri
gtagttatcagtggttactgaacca

SEQ ID NO: 1498 - DNA, 25 bp, Amaranthus palmeri
atgcaagatcgtcctttggattaag

SEQ ID NO: 1499 - DNA, 25 bp, Amaranthus palmeri
tacggatgcacatattcaaacttga

SEQ ID NO: 1500 - DNA, 25 bp, Amaranthus palmeri
gctaggattatatacaccatcaata

SEQ ID NO: 1501 - DNA, 25 bp, Amaranthus palmeri
agcagcttgctttgaaagttcggtt

SEQ ID NO: 1502 - DNA, 25 bp, Amaranthus palmeri
acaggactcagctttctgctattga

SEQ ID NO: 1503 - DNA, 25 bp, Amaranthus palmeri
atccagtcctgggccaccggtaaac

SEQ ID NO: 1504 - DNA, 25 bp, Amaranthus palmeri
tatcaacccaaataggaggaacttc

SEQ ID NO: 1505 - DNA, 25 bp, Amaranthus palmeri
gtaatatttgctttcagaccagatc

SEQ ID NO: 1506 - DNA, 25 bp, Amaranthus palmeri
cttactctgccttgtgtaattctcg

SEQ ID NO: 1507 - DNA, 25 bp, Amaranthus palmeri
cttcacatacaagcccataagtaaa

SEQ ID NO: 1508 - DNA, 25 bp, Amaranthus palmeri
ctgctttcatcccgtgttgtaatct

SEQ ID NO: 1509 - DNA, 25 bp, Amaranthus palmeri
cctctggccagtagtggcaatatgg

SEQ ID NO: 1510 - DNA, 25 bp, Amaranthus palmeri
cactaattccaccatttggcaaaat

SEQ ID NO: 1511 - DNA, 25 bp, Amaranthus palmeri
cttaaagttgttggaggcccatcag

SEQ ID NO: 1512 - DNA, 25 bp, Amaranthus palmeri
caccatacgatcaacaccagtacca

SEQ ID NO: 1513 - DNA, 25 bp, Amaranthus palmeri
ctcttgtaatatttgcctgtgcgaa

SEQ ID NO: 1514 - DNA, 25 bp, Amaranthus palmeri
gcaccatttacaaactttgtattat

SEQ ID NO: 1515 - DNA, 25 bp, Amaranthus palmeri
aaacacatttctgtcaccaactata

SEQ ID NO: 1516 - DNA, 25 bp, Amaranthus palmeri
ctatcccaaggccttggtctacctg

SEQ ID NO: 1517 - DNA, 25 bp, Amaranthus palmeri
cggttgaaaattgggaatttagtgc

SEQ ID NO: 1518 - DNA, 25 bp, Amaranthus palmeri
gaacttggttagtgtcagttgatga

SEQ ID NO: 1519 - DNA, 25 bp, Amaranthus palmeri
cttcttcaacttccgtcagttggag

SEQ ID NO: 1520 - DNA, 25 bp, Amaranthus palmeri
actggtggtggtgattttccagcac

SEQ ID NO: 1521 - DNA, 25 bp, Amaranthus palmeri
agcatagtgaccatgtaggacaaga

SEQ ID NO: 1522 - DNA, 25 bp, Amaranthus palmeri
aacttggaaggtctcccacacaacc

SEQ ID NO: 1523 - DNA, 25 bp, Amaranthus palmeri
ggtcccccaagggtgaaagcctcat

SEQ ID NO: 1524 - DNA, 25 bp, Amaranthus palmeri
catgttgtaacccctaactgaatag

SEQ ID NO: 1525 - DNA, 25 bp, Amaranthus palmeri
tgtttctagctgcaccaagttcccc

SEQ ID NO: 1526 - DNA, 25 bp, Amaranthus palmeri
cgtaactcagcagcaagctcaagaa

SEQ ID NO: 1527 - DNA, 25 bp, Amaranthus palmeri
cacatgtgtggtcttgacaggtatc

SEQ ID NO: 1528 - DNA, 25 bp, Amaranthus palmeri
cgtttccatgttcagcaaacgcata

SEQ ID NO: 1529 - DNA, 25 bp, Amaranthus palmeri
ttcacgtctttagaggttccaagat

SEQ ID NO: 1530 - DNA, 25 bp, Amaranthus palmeri
cctgtaaacttcagtgggattaccc

SEQ ID NO: 1531 - DNA, 25 bp, Amaranthus palmeri
cataagacgaacccttgcccattct

SEQ ID NO: 1532 - DNA, 25 bp, Amaranthus palmeri
acaagaccaagcttgacaccaactc

SEQ ID NO: 1533 - DNA, 25 bp, Amaranthus palmeri
atgatcgacagcatactcggctcga

SEQ ID NO: 1534 - DNA, 25 bp, Amaranthus palmeri
aaaataatgagccggtaccagaatt

SEQ ID NO: 1535 - DNA, 54 bp, Amaranthus palmeri
gttatccctgagtcgacccactaactcaactcagtccaaaaacccttcaatttc

SEQ ID NO: 1536 - DNA, 49 bp, Amaranthus palmeri
gtccaaaaacccttcaatttccttctgtcaatccctaaattctactctc

SEQ ID NO: 1537 - DNA, 62 bp, Amaranthus palmeri
gtcaatccctaaattctactctcttacaagccaaattctcaattacccagttcattaatggc

SEQ ID NO: 1538 - DNA, 54 bp, Amaranthus palmeri
gcatcaaactccacggaaaccccgttaagtttcaatcttctccatcaccattgc

SEQ ID NO: 1539 - DNA, 48 bp, Amaranthus palmeri
gctatgctcttcaacattgtctttgaacgactcaactcagcctccagc

SEQ ID NO: 1540 - DNA, 59 bp, Amaranthus palmeri
gccggaagtggtagtgtggttgaggttagtcaatcgaaatcggcttcagtgagtcgtac

SEQ ID NO: 1541 - DNA, 94 bp, Amaranthus palmeri
gtactcgaagggaggatgaagagagagtgttgattagtgaggtgttagtgaggagtaaagatggagaagaattagagaggaaagatttggaatc

SEQ ID NO: 1542 - DNA, 53 bp, Amaranthus palmeri
ggaggcattaatggcattgaaagcttgccgggcgaattcagctttgactgtgc

SEQ ID NO: 1543 - DNA, 76 bp, Amaranthus palmeri
gagaggttcaggaggatgttcacagaattattgatagtgggtatttttcttcatgtatgccagttgcagtggatac

SEQ ID NO: 1544 - DNA, 69 bp, Amaranthus palmeri
gatactagggatggtattagattggtctttcaggtagaaccaaaccaggagtttagaggactggtgtgc

SEQ ID NO: 1545 - DNA, 48 bp, Amaranthus palmeri
gcgaaggagctaatgttctcccttccaagtttgtagaggattcatttc

SEQ ID NO: 1546 - DNA, 55 bp, Amaranthus palmeri
gtgatggatatgggaaagtggtcaatatcaggcgtttggatgaagtgattgattc

SEQ ID NO: 1547 - DNA, 50 bp, Amaranthus palmeri
gattctataaatggatggtacatggagcgtggtctttttggcatggtttc

SEQ ID NO: 1548 - DNA, 56 bp, Amaranthus palmeri
gtttctggtgttgagatactttcagggggtatactaaggttacaaatttctgaagc

SEQ ID NO: 1549 - DNA, 56 bp, Amaranthus palmeri
gctgaggtcaatgatgtttcaatccgcttccttgatcgtaagacacgtgagccaac

SEQ ID NO: 1550 - DNA, 62 bp, Amaranthus palmeri
gccaactgttgggaagacaaagccagaaacaatacttcgacaacttacaacaaaaaaaggac

SEQ ID NO: 1551 - DNA, 52 bp, Amaranthus palmeri
gacaggtatacagtttgaatcaagggaaaagggatgttgagactgttttgac

SEQ ID NO: 1552 - DNA, 54 bp, Amaranthus palmeri
gacgatgggaatcatggaagatgtaagcatttttccccagcctgctggagatac

SEQ ID NO: 1553 - DNA, 57 bp, Amaranthus palmeri
gatacaggtaaagttgatttggtaatgaatgtggttgagcgtgtgagtggtggtttc

SEQ ID NO: 1554 - DNA, 48 bp, Amaranthus palmeri
gtttctcggctggtggtggtatttcgagcgggataacgagcggaccgc

SEQ ID NO: 1555 - DNA, 59 bp, Amaranthus palmeri
gctatcaggtttaattggaagctttgcatattctcacaggaatctgtttggaaaaaatc

SEQ ID NO: 1556 - DNA, 57 bp, Amaranthus palmeri
gaaaaaatcaaaaagtaaatgtctctcttgaaagaggccaaatcgactctatcttcc

SEQ ID NO: 1557 - DNA, 55 bp, Amaranthus palmeri
ggataaattatacagtcccatggattgaaggtgatgataagcgtactcaaaggtc

SEQ ID NO: 1558 - DNA, 53 bp, Amaranthus palmeri
gtcaatcattattcagaactcaaggactccgggtactttggtccatggtaatc

SEQ ID NO: 1559 - DNA, 50 bp, Amaranthus palmeri
gtaatcaacctgaaaatagtaacttaactattggccgtgtaacagctggc

SEQ ID NO: 1560 - DNA, 51 bp, Amaranthus palmeri
gcatcgaattcagccggcccctaagacccaaatggagcggaacagctggac

SEQ ID NO: 1561 - DNA, 50 bp, Amaranthus palmeri
gacttacgtttcagcatgctggtgtccgtgatgaaaaagggaaccccgtc

SEQ ID NO: 1562 - DNA, 61 bp, Amaranthus palmeri
gtcataaaagatttctacaacagcgctcttacggcaagtgggaatactcatgataatatgc

SEQ ID NO: 1563 - DNA, 58 bp, Amaranthus palmeri
gctgcttgccaaaggcgagtgtgcctacacgggtgacttaggatcctcaatgttagtc

SEQ ID NO: 1564 - DNA, 55 bp, Amaranthus palmeri
gtcttaagcatggaacaaggtcttcctatctatcctgagtggctgtgttttaatc

SEQ ID NO: 1565 - DNA, 52 bp, Amaranthus palmeri
gttttaatcgagtcaacgctcgtgctaggtcaggggtggacattggtccagc

SEQ ID NO: 1566 - DNA, 62 bp, Amaranthus palmeri
gctaatctttttctcagtttgtctggtggtcatgtggtcggtaaatttcctcctcatgaagc

SEQ ID NO: 1567 - DNA, 55 bp, Amaranthus palmeri
gtttgcgatcggtggtacaaatagtgtgagaggatatgaagaaggtgccgttggc

SEQ ID NO: 1568 - DNA, 57 bp, Amaranthus palmeri
gctcaggcctttcatacgtagtgggctgtggagaagtttccttccctctgtatggtc

SEQ ID NO: 1569 - DNA, 55 bp, Amaranthus palmeri
gtccagtagatggcgctctttttgctgattatggaacggatctcggatcaggttc

SEQ ID NO: 1570 - DNA, 56 bp, Amaranthus palmeri
gttcattggttcctggtgatcctgctggtgcgagattaaaacccgggagtggatac

SEQ ID NO: 1571 - DNA, 59 bp, Amaranthus palmeri
ggctatggatttggtatccgtgtcgagtctccattaggtcctctacggttagagtatgc

SEQ ID NO: 1572 - DNA, 54 bp, Amaranthus palmeri
gcatttaacgacagacaagcgaggcggtttcattttggcgtaggtcatcggaac

SEQ ID NO: 1573 - DNA, 24 bp, Amaranthus palmeri
ggatatgaagaaggtgccgttggc

SEQ ID NO: 1574 - DNA, 40 bp, Amaranthus palmeri
tcaagaagtgggatgttgataaaataaaaaaatttcatga

SEQ ID NO: 1575 - DNA, 40 bp, Amaranthus palmeri
tgaaaggtgttctagaggatgacattcaaaaagtcgaaga

SEQ ID NO: 1576 - DNA, 40 bp, Amaranthus palmeri
gcaagaaagctttgagaaatataacctctctgggattatt

SEQ ID NO: 1577 - DNA, 40 bp, Amaranthus palmeri
cggagaagagggtcattaataaaaaatgttcgttcaagat

SEQ ID NO: 1578 - DNA, 41 bp, Amaranthus palmeri
atttagtcagactggcttggagaatgagacagaggcttccc

SEQ ID NO: 1579 - DNA, 41 bp, Amaranthus palmeri
attaaagacactgatgaaagagcctgtgcctatattgctgg

SEQ ID NO: 1580 - DNA, 41 bp, Amaranthus palmeri
agaaatatcccgctggtgatggcggtgatttaaagaaaaag

SEQ ID NO: 1581 - DNA, 40 bp, Amaranthus palmeri
tgacatgagtttcttgaagcaagagctactttcattagta

SEQ ID NO: 1582 - DNA, 40 bp, Amaranthus palmeri
ctgtggcatctccagaagacgtcgaagctgtaaagaaaat

SEQ ID NO: 1583 - DNA, 41 bp, Amaranthus palmeri
tcttgagcttgctgctgagttacggatacctgtcaagacca

SEQ ID NO: 1584 - DNA, 2416 bp, Amaranthus palmeri
aacaaggatggaaagccttacatccaagtcaaggttcaagacggtgagactaaggttttcagccctgaagagaaaaaaaaaattaaccttctcggagaagaaataaaactacgtcgtttggcatttcaagagaagataatggcgggagcatggaaagctcgcgtatcttcaatcgttctagggatcatattgtgcggaagtttatttgcgttcacaattgccaaagatgaagcaccaaagcttgggacagtaattggaattgatcttggtaccacctactcatgtgttggtgtgtacaaagatggaaaagttgaaatcatagctaacgatcaaggtaaccgtattaccccttcatgggtggcattcaccaatgatgagaggttgatcggagaggctgccaagaatcaggcagctgctaatccggagaggactatttttgatgtcaagaggcttattggaagaaagtttgaggacaaagaagtccagagggacatgaagcttgtaccttacaagattgtgaacaaggatggaaagccttacatccaagtcaaggttcaagacggtgagactaaggttttcagccctgaggaaatcagtgctatgattcttactaagatgaaggaaacagctgaaactttcctcggaaagacaattaaggatgcagttgttactgttcctgcttatttcaatgatgcccagaggcaagctaccaaagatgcaggaatcattgctggtttgaatgtcgctaggattattaatgaaccaacagcggcagccattgcctatgggttagacaagaggggtggtgagaagaacatccttgtctttgaccttggtggtggaacattcgatgtcagtatcttgaccattgacaacggtgtttttgaagttcttgcaaccaacggagacactcacttgggaggtgaggactttgatcagagacttatggaatacttcattaagttgatcaagaagaagcacaacaaggacatcagcaaggacaacagagctcttggaaaattgagaagagagtgtgagcgtgccaagagagcattgagtagccagcaccaagtccgtgttgagattgagtctttgtttgatggtgttgatttctctgagccactcaccagggctcgttttgaggagttgaacaatgatctcttcaggaagaccatgggccccgtcaagaaggccatggaagacgctggtttggaaaagaatcagattgatgagattgttcttgttggtggaagtactaggattcccaaggtacaacagctgttgaaggagtacttcaacggaaaggagcctaacaagggagttaaccctgatgaagccgtcgcttttggtgctgctgttcagggaagtattctcagtggagagggaggcgaagagaccaaagaaatccttcttctggatgttgcccctcttactcttggtatcgagactgttggaggagtcatgaccaaattgattccaaggaacactgtgatcccaaccaaaaagtctcaagttttcaccacttaccaggaccaacaaaccactgtgaccattcaggtatttgaaggtgaaagaagtctcactaaggactgcagacttctcggaaaattcgaccttactggcattgcaccagctccaaggggaactcctcaaattgaagtcacttttgaggtggatgccaacggtatcctcaacgttaaggcagaagacaaggcctcaggaaaatccgagaaaatcacaatcacaaatgacaagggccgtctcagccaagaagaaatcgaaagaatggttagggaagccgaggagtttgctgaggaagacaagaaggtgaaggaaagaatcgatgcccgtaacagtttggagacatacatctacaacatgaagaaccaaatcagtgattcagacaagttggccgacaagctagaatctgatgagaaagataagattgaggccgctgtcaaagaggccctcgagtggctagatgataaccagagtgccgagaaggaagactacgaggagaaactcaaggaagtcgaggctgtttgtaacccaatcatcactgctgtttaccagagatcaggtggcccaacaagcgaaagcgctgatggagatgattctgaggatgggcacgacgagctctaagatcgatctcggattcaattgttgattgttgtaggtttaggctcggtgactttgtgggggttttagaggaaagctgggatagagaactcatggatttgcagttttctcaatccctcttccgttcaatttttgagagacaatgtgttggcatatttcaactgctattattatcatcagctgaaacattggattttgttttattacaacactagtggattctagataattgcctattttactcatgtaacatcatcaacgtttactaatgtaatac

SEQ ID NO: 1585 - DNA, 4006 bp, Amaranthus palmeri
tgatgacaagattccctttacttaaagcaaaataattaaaatgcaaatcaattagtgatcattattactttgttacttttacttgtatgaccgaaaattaaaaatataaagttctatcaattttcatttaatacgatgaactaataaatatacgaaatcatgtgtttataaaatttaatttattaaaatatctataactttattagattaaccaataagatcattgaatataagtatataatatttctatgttaaaaactggttcaagtttaaagcaagtcgatctaaaatttgttcgggttaactcggttttagtcggattgagttcgatttcgagcatgattcgggtcagtctttttaggttcggctaatcttggttaatagttatgtgttagttacaaaaattggttacagtttgggttcagttttcccattttcggttgtcaacaagttcctatccggtacaacatcggttcgggtattttcggttcgataaaccttaaaaaggaacacattttcgggtcggtttactttcggtttcggttcgagctttcatatcgaatcacttttgaacagctctaatgcgatctgtcttaaaactcacacttgttgggaagagagggtaatttgtacaagatttctaattttgcaaactgagacattaagcttctcaaattttcgtatagtaaaaattgtaccaccttcaaagaatgaataagtgtgagataagcaaagggaaagccaacccttataatactccctcttattcaagttattagtccatttaacatttaaaattattcatcgattaattttaattttattttaattttaatctagaaatataatattgtctaataaaattttatttgattcgttttaatacaagactcgttagtatttactttttataatttataatcatgtgcaattaaaaatattagtaatataattattatatttgcaaatttgtccaattaaataggaatattaggtgaattgcttggagtagtaaatatagaatgaaaaaaaaaacagaacattaattaatttttattaaattttgggtaactattgaccaacaaaaaataaatgatttaggtatgatctttgattgttgtatgtgattcaaaggttctcgtaattgaaaatctagagaattcttgaaaataccgttataagatattaagtggatattttcccgcgcgttccagaatagtggtgagattccagcaactttagtgtcttcttccgtcaccctctagaaacttcttttctgaaatcccaattttggtatctggatatttctgctctaacctatacttataaatacatactccttcttcttcatgatcctgctcaacacaaaacagaatttactaacaaatcgaagctcacatagaaaagctcttataataagataagattgttgttgtaatcaaattgttgaaggaaaatgccagcagcagcagaagaaggcagagcaattggtattgatcttggcaccacgtacagttgcgtaggagtatggcaaaacgaccgcgttgagatcattgccaatgaccagggaaatcgtacaaccccatcttatgtggccttcactgaaactgagcgtttgattggagatgctgccaagaatcaggtggcaatgaacccccaaaacaccgtttttgacgctaagcgtctcattggtcgccgcttctcagaccctgctgtccaatctgatatgaagctatggccttttaaggtggttcccggccctgctgataagcccatgatccaagtcacctacaagggtgaacaaaaaacattttctgctgaacagatttcatccatggttctgactaaaatgagagaaattgcagaggcctacttgggtgagcctgtgaagaatgcggtggtgacagtaccggcctacttcaatgactctcaaaggcaggctacgaaggatgctggggcgattgctgggctgaatgtgatgaggattatcaatgagcctacagctgcagcaattgcttatgggttggacaaaaaagggtctcgttctggggagcataatgtgctcatctttgatcttggtggtggtacttttgatgtgtctttgctcactattgaagagggtatcttcgaggtgaaagctactgctggagatactcatttaggtggtgaggattttgataaccggcttgtgaatcactttgtggcggagttcaaaaggaagcacaagaaggatattagtgggaatgccagggctcttaggaggttaaggacggcttgtgaaagagctaagagaactctttcttctacaactcagactactattgagattgattctctttttgaaggaattgatttctactccactattaccagggctcgattcgaagaattgaacatggatttgttcaggaagtgtatggagcctgtggagaaatgtttaagagactctaagattgataaaactggtgttcatgaggttgtattggtgggaggatctacaagaattcctaaagtgcagcagcttttgtctgatttctttaatggaaaggagctgtgcaagagtattaacccagatgaagcagtagcatacggtgcagctgtccaagcagccattctcagcggcgacgccaatcacaaggttcaagacctattgctccttgatgttacacctctcagtctcggtatcgaaactgctggtggtgtaatgactgttctaataccaaggaacactaccattcctaccaaaaaagagcaaatcttttctacttactccgacaatcagactggggttctcatacaggtgtatgaaggagagaggaccaggactaaggacaacaaccttcttggaaagtttgagctcactggcattcctccggctcctcgtggtgttcctcagatcaatgtatgtttcgacattgatgctaatggtattctcaatgtttctgcggaagataagacggcaggggttaaaaacaagatcaccatcactaacgacaaagggagattaagtaaagaggagatcgaaaagatggtgaaggaagcggaaaagtacaaggctgaagatgaggaagtcaagaagaaggtggatgctaagaactctttggagaactatgcttacagtatgaggaatactatcaaagatcaaaacattagctcagctgataaggacaagattcaaaaggctattgaggagaccattaaatggttggatggaaatcagttggcagaggtggatgagtttcaacacaagttaaaggaattggagggaatatgcaatcctatcattgccaacatgtaccaaggcggcgctgggggacccacgcctgcttctgataccggtgccggtgctggcccaaagatcgaagaggttgattaaattggaaaattaaaagttaaaatttgtaattcaattgtcttgttgtttggttcagaattgagaatgtgtataattgaaaatacaaatccaaaatgaaaaaatgtaatgttttctataaaaagtaaataaaagtaatactacattgatccagttattgtgtgtagtgattcaattaatatttctactcttccactatggcaaaaactccctcttcacttgttgaaaatgctgcaaacttagataaacctttaatctctcttggtcttcatcatatgatcaaactcaatcctataaactgaggccataatgtactatgataaataacataaagcgaaagtaaagataggtgtttatttttattatttaatagaacctcagaattacaccctatatatacgaaattagggactaactgatatggaaataataataattctgctgatattatacctaggattatgctaattaaataatatatgagatatgcaaatatacaatgatattccaatttcctacactccccctcaagttaggccatagggtctccaatgcctaacttgcatagtgcatcttcaaaggcttcagctgtaactgcttttgtaagaatgtctgcaagttgatctttagatc

SEQ ID NO: 1586 - DNA, 2313 bp, Amaranthus palmeri
agaaactacgtcgtttggcattacaagagaagataatggcgggagcatggaaagctcgcgtatcttcaatcgttctagggatcatattgtgcggaagtttatttgcgttcacaatcgccaaagatgaagcaccaaagcttgggacagtaattggaattgatcttggtaccacctactcatgtgttggtgtgtacaaagatggaaaagttgaaatcatagctaacgatcaaggtaaccgtatcaccccttcgtgggtggcattcaccaatgatgagaggttgatcggagaggctgccaagaatcaggcagctgctaatccggagaggactatttttgatgtcaagaggcttattggaagaaagtttgaggacaaagaagtccagagggacatgaagcttgtaccttacaagattgtgaacaaggatggaaagccttacatccaagtcaaggttcaagacggtgagactaaggttttcagccctgaggaaatcagtgctatgattcttactaagatgaaggaaacagctgaaactttcctcggaaagacaattaaggatgcagttgttactgttcctgcttatttcaatgatgcccagaggcaagctaccaaagatgcaggaatcattgctggtttgaatgtcgctaggattattaatgaaccaacagcggcagccattgcctatgggttagacaagaggggtggtgagaagaacatccttgtctttgaccttggtggtggaacattcgatgtcagtatcttgaccattgacaacggtgtttttgaagttcttgcaaccaacggagacactcacttgggaggtgaggactttgatcagagacttatggaatacttcattaagttgatcaagaagaagcacaacaaggacatcagcaaggacaacagagctcttggaaaattgagaagagagtgtgagcgtgccaagagagcattgagtagccagcaccaagtccgtgttgagattgagtctttgtttgatggtgttgatttctctgagccactcaccagggctcgttttgaggagttgaacaatgatctcttcaggaagaccatgggccccgtcaagaaggccatggaagacgctggtttggaaaagaatcagattgatgagattgttcttgttggtggaagtactaggattcccaaggtacaacagctgttgaaggagtacttcaacggaaaggagcctaacaagggagttaaccctgatgaagccgtcgcttttggtgctgctgttcagggaagtattctcagtggagagggaggcgaagagaccaaagaaatccttcttctggatgttgcccctcttactcttggtatcgagactgttggaggagtcatgaccaaattgattccaaggaacactgtgatcccaaccaaaaagtctcaagttttcaccacttaccaggaccaacaaaccactgtgaccattcaggtatttgaaggtgaaagaagtctcactaaggactgcagacttctcggaaaattcgaccttactggcattgcaccagctccaaggggaactcctcaaattgaagtcacttttgaggtggatgccaacggtatcctcaacgttaaggcagaagacaaggcctcaggaaaatccgagaaaatcacaatcacaaatgacaagggccgtctcagccaagaagaaatcgaaagaatggttagggaagccgaggagtttgctgaggaagacaagaaggtgaaggaaagaatcgatgcccgtaacagtttggagacatacatctacaacatgaagaaccaaatcagtgattcagacaagttggccgacaagctagaatctgatgagaaagataagattgaggccgctgtcaaagaggccctcgagtggctagatgataaccagagtgccgagaaggaagactacgaggagaaactcaaggaagtcgaggctgtttgtaacccaatcatcactgctgtttaccagagatcaggtggcccaacaagcgaaagcgctgatggagatgattctgaggatgggcacgacgagctctaagatcgatctcggattcaattgttgattgttgtaggtttaggctcggtgactttgtgggggttttagaggaaagctgggatagagaactcatggatttgcagttttctcaatccctcttccgttcaatttttgagagacaatgtgttggcatatttcaactgctattattatcatcagctgaaacattggattttgttttattacaacactagtggattctagataattgcctattttactcatgtaacatcatcaacgtttactaatgtaatac

SEQ ID NO: 1587 - DNA, 734 bp, Amaranthus palmeri
caacaacttgttgggtaaatttgagctctctggcattcctccagcccccagaggtgtccctcagattactgtgtgctttgacatcgatgccaatggtatcttgaatgtctctgccgaggacaaaaccacagggcagaagaacaagattaccattacaaatgacaagggtagactctcaaaggaagagattgagaagatggttcaagaggcagagaagtacaagtctgaagacgaagagcacaaaaagaaggttgaggcaaagaacgctttggagaactatgcctacaacatgaggaataccgttagagatgaaaagatcagctctaagcttggagaagacgacaagaagaagattgacgaagccattgacaacgcaatccaatggctcgacagcaaccaacttgctgaagccgatgagttcgaagacaagatgaaggagctcgagagtatctgcaaccccatcattgcaaagatgtaccagggtgctggaggtgaggctggtgttcccatggatgatgatgtacccccagctgcatctggccctggtcccaagatcgaggaagtcgattaagtttttctataattattttgtggtatttttgatttttgaattttgttttgcttaagcattaagactattttctatttagaattgtgacacaatgcagtgatgtttgtttttatgatgagcattatgctgctttatttcccatggattaatatgaagacgatga

SEQ ID NO: 1588 - DNA, 13819 bp, Amaranthus palmeri
ttttttgctggcgtctttgatacgcttcaagtgttttttttttttattttagcgtaggccgaaagaaaattagatttttgtttaagactttgtttaaaaaagacggtgcttgctttaaagttcttatatttgagagttgagatttgacttcaggttaaaaaaacttatagttatattttagtatttatatcgatgagacagttttttgtttgatgtgaaaggtggtcaatttattaagaaaataaaattaggaaggacaatgtacgtgatccaagtagaactattattactcatttcaaaaactattagaagtttaatgggttaatgtataagtataaccactttatttctcctggaatcaatctcactgggactaaggaagtacttcattatagttcctataataaaatgtgacaaaatttaaatcgaaattacattaacttgacaaaatattcttcacaagaactcgagatttaaagtttctcaatacatccttacgtaaagctaaaatcacaaatttgacattatattcaagacgatacgctactagccttgatttctcacgcatccaacgacaaaaacttacatcatgaatttcattcattttcgaattctttcacatcatcagattttactacttcaaggaggacttttccatcatcatccctgttcaccattcaatctcaattatatctccatcttgttgaataaatggtttccatcttgttgaattacatctttgggttgtaacttgcttccttcgcgccttgttagccttatgatattcaacaagccaatcacaagcttccttgatataggtgtcagcatatatgaattttattattgtaaggtgactcatttctagcactctttttttgccaagataagatggaaaaagcatctattcattatatttcttgttaacatctataaataaagctctaaaatagaaggttccgatatgaattcattatctgcattatttcaaatttcatgtgcccgatagtatttactcagagcatgaattatagtttctattatccaacatctaaagcatccattcaagcccttaatactactttgtctaaatcaatacgatgaaggaaaagatcctaaaaggttctccacaaaacagtctttacttttggaggaaccatcaatttccacatagatctccggatggggtcgtgcacactagatgaagttgaagcctccttttttcttaacacaagtttataggcatttctaactttgaattacccattatcattactctctacctatatcaaaacatatcatttactagaatcgcttataggatcaagaagtatcatgtggacatcgatagataagaacatattttcaaccatgcccttgctttctcctattgcctattaataggattctccttttttgttttatcgtcacgatttttcttaggtgtgtccagttcacctaagcctaaggcatgcataattccatatctccattgtttggccatctttaattctccatcataacccttttttaaccaataatctcgaaccccatatacttttccaaacaaagttagcttaaaactccactgtaaattttcattgagaaaaggcaaaggatattaggcttttaaatagcttcaaaatagaaaggacgactaacaatgtgtacaccaaagtaggttggtaagggaggcgtggttaaattgctccaactcaagaaaccaaactttctttcttttaaggctgacacaaatcttgtgcttcccacataatacaacaactatagcttaagggaaatatcaaaaattcttaattatacgattcacacctttcacttatttgcaaaaaaaagaaggtggacgtagctcattgcgacgttagctagggatttattgaatcatagcctatatcaatattttttttctagtttttgtactctccctgagtcacttccaatgtatgctactttaattttattctcgaacttctagccttctttcgtaaaactctcaatgtattgtgcattacgttatgggatgtgacgggagtggttttaaaaaaattatgtaacattaattctccgcacattaatttatgagttacattctcttattaacttaaaaaaggcattattaatattaatacgaatttgtacagtttatgccaacgtcaattattctattacaataaaaaccaaataaaactcttcattaatattttggattgcgttagggaagatgaaggaatgagtttcaaaacagcaacttaacattgtaagcgtgacacttagcataaaatgtctcaaaatgcattgtaatagtgacacttggcacaaagtacatatgaatcagtagattatctagtgattctgattctaatcatattgggttgatagttacatagaaactagatgatatatacaaggggattgaattaggattttgatagagctagtctaagtaaataacggtcatttgtaaaattggctaatcacactcatgtggaaaaatttgatagggcaagacctttaggattttactttatcttttttttgttttgtttatttagtaagtatttgttttgtctttttatagtgatttacaaattacggttattaattagaaatttttaagttttgatatgttgtttctttatggtttgatctgagattacgttgtcatttagtattacctcttccattttaaaataattacaacgtttgactttttatagactctaatttattaattcattctctaaattctctagttccatattatatataataaaaaattataaatttgatattaataatctttacattgagacgaatcaaataagttcttacttgactatatttttaacttattgattaataataaactaataacaaattaagggcgataattgaatagtttgccatatttacaatgttacaagtaatttgaaacaaagaaaaagtatggaatatttgaattgaaaagtatgaactttgtcttatttgtttttaaaggtttgaactttcgtttattttttaaagactcgaactatatggggtgccttcgcttttaaagtttcgttttacctttaacatgttcaacaagtttcttcctttccaaaaacaagttgcttctacctcatcaatggcttctatgttttagttttaggggttacaaaatcacaatttactaatattctttgggtcaaactttaagcttcatatctctaattattcattataaaaagttataagaaatataagcctataaagtatatattagacgaatttaatgtgatctcacatgtatatattatatcttctatataatctttcaaaaatcatagttaaaattttgtctttgagtgaaatattctaattgcaaaaatcactaaagaacagaaagactagtaaattaaaaggaagagaaagggtaagaaaagagcatatttcttgtttgtttagggattaggaggaaagaaaagagaaaaaagaaagaaatatgattatttttctcccaaatcttttcattttaggagaatttgtatttttaacaaagtttatctatgttttttttttatctaaacccctccctttaaaatctctcccagcgccgtttccgatcatgggcaaagacaaagtaggcatttgcctaaggcccagggttggaataagccctaaaattagaaaatgttagtttatgaaagtacacacttaaaaaaattttgtaatttatgagtagttcttttatcatttacaaattttataatacgtctacatttttaatgctaataatattttatatgatccatttttattatttttccaaacacccatttaaattcagaatcgaccctcataaagagggcccatttctttcaatttgtctagggcccatacaataccggaaacaacactgatctctccccttttattttgttaatccaaacgacctttcacccttttaaatctctctcctttctttttctccgtattccgctatctaaacatagtgttaaatggtaaaagaaatgaattgcttgaccttgtaaagcctaaaggaataccataaaaaaaaaaaaaatcccatttttagaactacatcatcacaataagatctaaaatccaacgatcaagatttccccaacccacaaacacaatattattggtcataccatagtctcctcaaattctcattggtccacgtcatcatatatgacgctttccgtttatattttcctttccttcaaagactaagtttagtaaatgttgaatttacacagaaatagcaatactcaaatctgattggttaattccattcgcctcgcattctcattggtccacgtcattctttctgacacatcattttctctttctggtttcttcatgtttatataattacattctctcatttctcctcggaatatcaattcacgaagaagacgaaaagagaaaaaaaaaaaaagattaatcttctcggagaagaaataaaactacgtcgtttggcattacaagagaagataatggcgggagcatggaaagctcgcgtatcttcaatcgttctagggatcatattgtgcggtgagtttttaagatctttgtagttcgtagttttatgatgtatttggaactgcattttatgttgtatgattttgatttgttgttcgtttaggatttttgattcgtatattttggatcgttgatagtgagtgatcgtgactagtgagagtgaaaatgtgataaagtttttgcaagtttgaattagatctgacgttttggttttgtttagtgatttagatgagaaagttttggttgattgtaatataatgagctaaaaaggattgatctgatgtatatgtcagaactgagaagtggagtagttagtattcagtatttggatgctgatttaatgaatttttattaaatttgattggatcttaaaaaatctttagctcgatgtgaatcaatattttaacttgattaattttaagaattattgctcatatcatatcagcatatgttcaatagaatgtcactgttagattgtgtagagatcttcatggcctgggtatactattaatcaatatatagtcacagtgataggttgattctattctttgttttgttaaattggactatggattatttgattgtaacaagtttgattaccagagcttagagcataagctttgcgttaaattggagtatatgtatatctatgcctcgtctgtaatgcgttcttttgattagaaatgcattttgaatttgttaagagtttcttttgggtgtgttatgtatattgtaaaattgattgtaaatgtgttttagaattatacgatgcttacataaaagaagctacctttattaatgtaaaactgttctgttttgaaaggctactgaattaacataccgtttcgtttgttttccaataatccaggaagtttatttgcgttcacaattgccaaagatgaagcaccaaagcttgggacagtaattggaattgatcttggtaccacctactcatgtgttggtgtgtacaaagatggaaaagttgaaatcatagctaacgatcaaggtaaccgtattaccccttcatgggtggcattcaccaatgatgagaggttgatcggagaggctgccaagaatcaggcagctgctaatccggagaggactatttttgatgtcaagaggcttattggaagaaagtaagctttctctcttttcttttcatgcatgttacattgctgttcttcggagtttgtatgctaatgttgtgatactttgtttaataggtttgaggacaaagaagtccagagggacatgaagcttgtaccttacaagattgtgaacaaggatggaaagccttacatccaagtcaaggttcaagacggtgagactaaggttttcagccctgaggaaatcagtgctatgattcttactaagatgaaggaaacagctgaaactttccttggaaagacaattaaggatgcagttgttactgttcctggtaagattttgaaaaactgaacaatacatattcttttgagtagtacaattcaatgctatgagtttgttttccttggatggttatatttacactgatgtaaatgtgctgcagcttatttcaatgatgcccagaggcaagctaccaaagatgcaggaatcattgctggtttgaatgtcgctaggattattaatgaaccaacagcggcagccattgcctatgggttagacaagaggggtggtgagaagaacatccttgtctttgaccttggtggtggaacattcgatgtcagtatcttgaccattgacaacggtgtttttgaagttcttgcaaccaacggagacactcacttgggaggtaagattgcctcggttcatgatgtattttgtgcattccttctcatgaaattcctaaaatgttgtttacacattctaagtgcatcatttctcatgaagatgcgagagcttctctcaatgatgcccttacagagaaggaatatttgttatttaaatgaaaaataatcacttaatttcttttgactagcatgctaagcctgtttgtcctttgttctacaggtgaggactttgatcagagacttatggaatacttcattaagttgatcaagaagaagcacaacaaggacatcagcaaggacaacagagctcttggaaaattgagaagagagtgtgagcgtgccaagagagcattgagtagccagcaccaagtccgtgttgagattgagtctttgtttgatggtgttgatttctctgagccactcaccagggctcgttttgaggagttgaacaatgatctcttcaggaagaccatgggccccgtcaagaaggccatggaagacgctggtttggaaaagaatcaaattgacgagattgttcttgttggtggaagtactaggattcccaaggtacaacagctgttgaaggagtacttcaacggaaaggagcctaacaagggagttaaccctgatgaagccgtcgcttttggtgctgctgttcagggaagtattctcagtggagagggaggcgaagagaccaaaggtactttttcttcaaatgcttcttgtgataagtaacttgcactgagagtttcttttgaatgcatgactaactgaatgtttgtatctcttacagaaatccttcttctggatgttgcccctcttactcttggtatcgagactgttggaggagtcatgaccaaattgattccaaggaacactgtgatcccaaccaaaaagtctcaagttttcaccacttaccaggaccagcaaaccactgttaccattcaggtatttgaaggtgaaagaagtctcactaaggactgcagacttctcggaaaattcgaccttactggcattgcaccagctccaaggtttgtcaaatctctctgaatgtttattttatagactttttaatgtggtgaaggaaccatctctcgttggagttttgctgactcttttttttcattctccttaaataggggaactcctcaaattgaagtcacttttgaggtggatgccaatggtatcctcaacgttaaggcagaagacaaggcctcaggaaaatccgagaaaatcacaatcacaaatgacaagggccgtctcagccaagaagaaatcgaaagaatggttagggaagccgaggagtttgctgaggaagacaagaaggtgaaggaaagaatcgatgcccgtaacagtttggagacatacatctacaacatgaagaaccaaatcagtgattcagacaagttggccgacaagctagaatctgatgagaaagataagattgaggccgctgtcaaggaggccctcgagtggctagatgataaccagagtgccgagaaggaagactacgaggagaaactcaaggaagtcgaggctgtttgtaacccaatcatcactgctgtttaccagagatcaggtggcccaacaagcgaaagcgctgatggagatgattctgaggatgggcacgacgagctctaagatcgatctcagattcaattgttgattgttgtaggtttaggctcggtgactttgtggggcgttttagaggaaagctgggatagagaactcatggatttgcagttttctcgatccctcttccgttcaatttttgagagacaatgtgttggcatatttcaactgctattattatcatcagctgaaacattggattttgttttattacaacactagtgaattctagataattgcctattttactcatgtaacatcatcaacgtttactaatgtaatacattatttgttcactttcgaaaaacttcatttagagttttagagtaaataaagagaaggtttgagtttgtaggagtgtgggtaaataaatgttgtgtctatatctccatataagtgaaagatactaggtttgactatgacaatctcttaatataagagtttatagacgcaaatgctcaaatgagacagtcttacgatgagactgttttattaggccgattcaatgtacacttatcgaattaaagtgatcacatatagccttaaattgatcacttacagttttaaagtgattattttgtatagttttagagtgattagttaaaacctttaagtgatacaatcttaaagtaatcagttagaataatagactaattatatgagtctcaattctatcttacatttaaaatttttttaatctcgtcttaaaactttaaaaattctttataaccaattgtttacaagtcttgagagacttggctaaagttgttattaacattctttttctagaacagggtcaaatgggctgctaatgttttccctcgatcaacaattaacatgctttctttcttacatacatttcaaaatatggataataacaaatttattaataaataaagagatcaatgttttcatttttataataacaaaatgttcatggatatctttcctttcttcctgattgacacatctttcagattttataaacttctcttttactaacacaaatttattttcaataacatattttttaacatcttgcttagatgaactatgatttgttctacatgatttacaagcctactttgctatttgttactacacaaatttgtgtcattctcttaatagaagctcatatacattgctgttgttatccccatttatgcgcttcaacatttcaaagctttttcggtttcccaggaagtcgatgcgcttatacaccacgtaaccaagttcttccgttgtctcactacaatatacggatcggagcttctcagcatgcctcgagtcggtgtgaattgcaacctctatttcatggtttgacatattctcctacagagaaaaggtaatatttgatcaatggacagacaaacagagatctcaactcactatcacaattttagaacccatattttttttttgattttgggtaagctagagaatccctccagtcccagacaataaggaagaaagaattaaccttcctgtaggtggtgataattgacccctttcttattttgaagacccaaggtagccaaaaaaattacagcccgtcttgtatgagaccgtctcacggtgagacgagctcaaaacaagaagtctataagctaaaagtttctattattgggctatttaacccaagtatgagacatgtttcacggtgagacggtcttatacaataaattgtaaaaaaatatgctatgaaagatcaaatggagaacattcaggaagtggaggccaaaaatgaattttatcataggattatatgaagaaaatggccttgcggcttgcaaggagcagcaaccagtcaacaacattccatcaccccaatgccacacctaggatggggtttgaagggtcggattgtgcacaatggcacaaccttaccattgttgatgataacactaacaaagaggttgttttcattttaacccttggtagcaaatatcatgtaaaatttcacgcacatgatttaaagagtcattttacttgtctttttcaattagaaaccaaagaactataaatttgaccttttcaaacatgagataagaggccaagcaataatggattaccagattattattaataataaaatcaaaataaaacaaccaaataacttgacccatatggccatatgtataaatgatcaactatcaagctgttcttttgacattaggaataattgtcaactgatgataactaagcaataatacttacctggtagaagacataaataaattccaggatttgcaggcaagaaaatcctgtatcactaaaatatgttcttgaggaaggccccagctcagcaaatcgatcaactggatacagaattgtgaggaaatggtttttaaatacctgtgcatttttctcactgcaaatttcagcaagaacaaatgagacagctgataagagtaaataaacacaaattctgactaaaaatactacatccacaagaaaattacttcaatatgaaatgttttgttaacattcaaaaccggtatttacaactcacatacacttggtatagacctgctaaaaacattcctgcgtgtattcattgatttgactctaaggttttaaaggtaagactcacacagagagctcatgtttttgcggctgagatgtttcatgtaacgtcggtcctgcaagagaggccttgatcctacgtttgccaagtttcctccactaggtccatggttacagcttcaaatatccgtgtcaatgcgtaatccattgtagctatcaataacatcatctttatgtctctaggatgttgtctagggctagtgatctacttattgatgatatattaactaatgcttccccgtttgaccccaagattagctcgcaaaaccattgaaccagatgtatattaggcatacttatcacattgtttatagtaaaaatataagccaagacattgataatagcttgaagaatatattcttagttggaagcttggagctctttacacaggctagccttgggatcaacagtggatgccaagttacgtacaccaactcaaacatgagtacaagcttgttgagctcaaaaacttcagctcaacttggcttagctcataaaccaattcaagtccaagtctatttgagctttctacagataagaattaaaaactatagtgatatttcaatagtaaactatagcgcaaattgatcctttcggctttgataaattttaagtgacagtgtgtataacaggatattcccgatgagtccttcacacagaaggcagttcaccaatcacttcacagcattaaatactggacacagatgcgacatttggttttgtccaagaaaagccataatagcaaatcaacaagcatctagtaaacttatatattatcaatggaagatcaacatgtatcatgtatgatatgcgtatgagcatatgcatctagaaatgacaatgggttgggccgggccatgtcacagactgggctagcaggccccgttactaaatttgaaatttttaaaaaatctgcataaaaatcatgcatcctgctacgttgccgatcaggctcatgtcatgttgtgcacaaattatgatttagattccacaacccatccaaggccccttccacatacatccgctgtgcccaatgcatggcagccagcccagcccactgcaaagtagcaataaatggaagtgttcaagcagacaagttaaaagaacctttctgttagtggtcgtagtaagtttgagaatgaagcttcagattcagcacaatcccctttaacagaaaggctttgttggtcggtctcaaagtcatttctggaaatagcagagtctgcatacacagcagccctggaagttggctcagagacagaccagcagactgagtctagaaggctgctgggattaataggacgcaagggtatttgacataactgcaacaagaaaaaagatctcctcagaactcaaagtacattattggcatattaatccaagaaatttgtggaagaagcataaagattttattcgaacaatactgcaaaaagatctcttcaaattttcttattgtccataattgttttaatgtcaaataaaaatctcaaacaaatgcctggaaaagtaaaggtgcagaaaaagaaatcctagttgagacccattattcagatatagcttttctaaagaagccactcttcttaaattaggttacaggaaaccacccttcataataatcttcctttccattcactaaaaaactagccaaaatgatatagagcagatgaacaatgtactagtgcgtagaggatgaatttttcaggcataaacagaagtctacaccaggagccagaagatatcacttgatgaaactttcatgctgattttaagcacatttatgagtaaagtgagtaattaaagagaagataacagttcagagaactatcatcaatagaaggcaactatatgcaaaatctgaaatcctcggcatatccaaggttgagagttgaaaaatacagggatgcttttctgagatcgagaccatatatgaacgctttcctaataaaacaccacacaccataaaagctgcttcacaatttctccttgtagctccagatcctaaaaagcatacctgcaatagccctcatatagtaaaggagaaaagacacccatgactcctacagcaaaccaaacttcttcctccaaaggtaacaagccatgagacaatatatagcaagggagataccaaagtttttcacctaaaatagaagttttgctttacccgaaaagtttaaagtgagagatagtgtggtgagaaggtgacgagtctttatgtatcgccttaccgtgatatctaaaaatctttggacattatttatccaattaaacttcttgtaaaatgtacacttattaattaacataattgagaaacacaataatatatttgtttgattttcttttaattcttagattatgttttaagaaataatatattgtccaaattagtttagcttacagacacaatctataacaaaagaattctatcaattgtattaatgtcagtaggtatgaatgcatgtccattcttgatagagcccaacacttataggagtaattctttggtttcgagttgtaagggattatagtaaaataattcatcaaatcatgcattcttcttatttatgagaagtagctgataatattttactttaagtgtcaagccgacacaacctttttgtttttacaagggcatgatagtgtacattcaactcccaaaagcctgctaaatgggagccactaaatggtattggggtaatggagcattaaataatgttgttgggtatgtacaaatacaaatagcaaagggattaaaagtaatattttttggacaatttgttctgtcaccattctcaaaaatcttttattcctatatgccgtgtacttcatttggctaaactaaactctaatgaagtttaacattcaaaaaggtgagatgatcagacgaatgcttttgatcctagacaaatttaattagggaaagtaagcataatgtttggtttgtgctcccttgttgcatcaagtgacttcaaatttaaaaatcccacctccatctgaatagaaacaataagtaaatttaatagaatcaccccagcctatctgcttcctgaactcaaaactctaatatatgcattatgcacacatcacactatcgcaggtacaggttatgaataaacaaatgcaaacaccataagaaaaataagtttgagcaaatacatcagacaattacttcaagaaagtataaacctgcaaacgtcgggcacgacgatttctaacaccacattttgcaagattagcagtgtacagcc

SEQ ID NO: 1589 - DNA, 7528 bp, Amaranthus palmeri
gtggataaggcgccgccaactgcccctatccaaggtcaggttcctggagaggtggagttcaagcaagtcactcctaatttgttcctcccatgttctcttaggtcttccttgacctctcttgccctccactatgttgcattcgatccttcttactggtgcgtcgtgtgtcttcctctgcacatgtccaaaccatctcaacctattctcctgcatcttggcggagataggtgcaacccctaatgtcttcctgaactcctggtttcttatcctgtccatcatagtgttaccacacatccacctcaacatacgcatctccgctacttccatcctttgttcgaaaaccttcttcacgggacaatgccggcctaattgctacgaggtaaaatagacaatcttaatttggacttacatatatcatcatcatataaggaataaactaactaatttgactatttttcaactaaattctccctcatatctattatgattgaagacttttaaatttaataagtctcaattatcaataattactatgagtatatattttaatattgttgtataataaatatcttaacaaatacaaagatttaataattaagtttatttagcaaatgagttaatttataaaataatacgtcatccattcactaataaagtttccataagaaatgttcacgaaaactaaaaaatagaatattttagatagtggatatattaatttattgacaaattaatttaattggagaaatatagtgaccataagcattaaaatttttttagaagaaagttagttggaaaaaatatggggaccacaactaataaaagaaatagttcattaaagttagcgagaaatatgtgaggatcataaagaatataaaactgttaggaaaatttcacgtgaaataaccctgaggttttgggttttccacgtggtaaacaaaacttttgaaaaatccacgcggtaaccctgaggtttacgtaattgcttcacagtgaccttttgcacataaaaacgttagcaaatgttaattttgaaactctaagactgttgtacgtctaaatctgcaagactgcaactcaccatttaaatgccatcaatttcaatcttttttcccaaaatataaacctcaattctaccctttttcatccaaatcatattttttttctctccaaatccaaagatgctagagttgtgatttttattttaggagaaaatgttaaaattgatgacatttgaaatgatgagttgcataaataggcgtacaacaaccttaaagattagaaatgaatgtttgttaacattttgcttacgttttatgtgcaaaaaggtcatggcggaacaattaggtaaaccttatggtaatcgtgtggatttttttaaaagttttggttatcacgtgaaaaacccaaaacctcaggttgtcacgtggaatttcccaaaatgttaaaattggagttggttgaagatatgtgggtctataagcattataaaaatactaaagtgagtatgaataaagttatttttgtccaaaatctgtaacatcaatagaaagattcttaatgaaaagaaccaatgaaacaccttaaaatttcaaatgaaaactttaaagaacggaaggcttatcatcattcatatgaatcatatcagtaaatatttatcaggtgctcttttgagagatcgtcttttataaagatgattcttaaaagtccagaccataatctatatttagagttgtaacaatattgtatattttagaattagactaggcttttgacagccgtctttactaaagacggtttcatataagaatttgtgaatatttataatatctatactttacacaaaaatttatctagtctagtaaaaatacctcctccgttctgaaatagttgctacatttcgattatggctactattcatcattcatgcttaacttatttattgtgattattgtgtaaataaaaatatagtcattatatttagagttgtaacaatgtatattttagaattagactaggcttttgacagtcgtctttactaaagacggtttcatataagaatttgtgaatatttataaggaaaatttgccaagaataatcccaactatcacccgttggccaaaaataatctaatctatcgattattttttaataatcctaactattcgtcgaatttgctcaaaacagtcccacggtaccatttgacttttttctaatatgtgtgctcattcgcaacatatgtcccttcttcatcacttttatcataaacaaaaacattattcctgctcaaattagaagcaactacaatatcatccaattgagggtgtgggactgttttgagcaaattcaatgaatagttaagattattaaaaaataattgatagttgagattatttttggccaacggatgatagttgggactattcttggcaaattttcctatttataatatctatactttacacaaaaatttttctagtctagtaaaaatacctcctccgttctgaaatacttgctacattttgattatggctactattcatcattcaagcttaacttatacattgtgattattcgtatcacatattttcataatattaagtttttataatttttaaatgtgtataattctacatataaattaaaaaaataacacatcgtgtaaaaagtctaatattgtaaaaaaaaataactacaattgtgaatagtttttaatttttaaagttttttttttaaagaggtgattacgtagtaaaactagcgtcatatagacacctggacgatgagaaccctcttgagtaacctctagaacctcattctaattggcctttcctacaaattctcgaaccaatttgacatccaattctgccacgaatcctactacaaacccgcatgatcaaaatccaacggccaagatcatccaaccgccttacagtaattcctcaacacctcataccagaaatttctcgaactaaccagaataccctatatttctcacccttataagaaaaccgcgaaaagcaagaaaacgggaagccttcagaacacggtagattaaagatctgacggtccatattccacgaacaagaaccttctcgaaacaaatacattcttataaaaaacacctctccattctttccttcgcaattgaaacaaaattctcagcgaacgatcagaaaaacaatcttctctctctaaaattctctcgaaattttgttagtgtttagttggtggtaaagagatatggcaggaaaaggcgaaggtccggcgattggaattgatcttgggacgacatactcatgtgtaggagtatggcaacatgatagagttgaaattattgcgaatgatcaagggaacagaacgacgccttcttacgttgcttttacggatactgaacgattgattggtgatgctgctaagaatcaagtcgctatgaatcctaccaacactgtttttggtatgatttctcttcctctgttttaattagtttactcgttttgatatttgaaatttgtgcatgatcttgcttttgcatgaggttagttcttggtgttttacctagaatcgagtatgatgttgatatgagttgatggtgaatatgcgaatttctttagatcataaggatgataattgacaattgttattcagaatttgtgaattataagctgtacttcagaaagataattgattttaaattctatcgcaagatacagtcacttacgtcgagaaagattatcgattttaaattcaatcgcaagaaacagccacttttaattgttaaagttaattcgcttacaaaagttggtatttcatgtcttgttatctattttgtctgtcatcgatcaagatttatcaggatttctgaaatatgtttcagactcatgtgaggagaatagtgattctttcagaaagaattgcttttaattcgctaaataaccgtgtatttttccattggacaaatttgaatgtatcttgattttacctaaaagaaactcttaacatcttgtaatttcctggttaagttatgaaatcaaatgttattaatttttctacacgggccctaaaattgtttatattatgaattaatagttgaatattaacttataacatagtttgcattttgaaatattattttatatcttaatgtcaatggctctataacggaattttgtgaccgcaatgaatttgtgaatgtttattctaaagtaaccctaaacatcgattcaggtgtgatattttaacttaatgtacacttttttatttgatactaatctatttttttgaaaatttatgttggaaattttgagtttactctgaagctgctgagttgttgaaaattgacaacttttaactttctttacatgatttgagatatgacattttgaggacaaattactgacatgtatatgtttgctttatagatgccaagcgattgattggtaggagattcagcgatccgtccgtgcaaagtgacatgaaacactggccattcaaggtgattcctggcccaggtgacaaaccaatgattgtagttaactacaaaggagaagagaagcaattctctcctgaagaaatctcttcaatggttttgacaaaaatgaaggaaattgccgaagcttaccttggcagcaccattaagaatgctgttgtaactgttccggcttacttcaatgactctcagcgtcaagccaccaaggatgctggtgtgatctctgggctcaatgtgatgcgtatcatcaatgagcctactgctgctgcaattgcgtatgggctggacaagaaggcaagcagcagtggggagaagaatgtcttgatttttgatcttggtggtggtacttttgatgtgtcgttgttgacaattgaagagggtattttcgaggttaaggcaactgctggggatactcaccttggtggtgaagattttgacaacaggatggtgaaccactttgtgcaggagtttaagaggaagcataagaaggatattagtgggaaccctagagcattaaggaggttgaggactgcttgtgaaagagcaaagaggactttgtcttccactgctcagactaccctcgagattgattctctctttgagggaattgatttctacactaccattactcgtgctcgttttgaggagctgaacatggacttgttcaggaagtgtatggagccagttgagaagtgtttgagggatgccaagatggataagaatgctgttcatgatgtcgtgcttgttggtggatctacaaggattcccaaagttcaacagttgctgcaagatttctttaatggaaaggagctttgcaagagtatcaaccccgatgaggctgtagcttatggtgcagctgtgcaggctgccattttgtgtggagaagggaatgagaaagtgcaggacttgcttctgttggatgtcactccattatctcttggattggagactgctggtggtgttatgactgttctcatcccaaggaacaccacaattcctacaaagaaagagcaggtgttctcaacatactctgataaccaaccgggtgtgttgattcaggtttatgaaggagaaagaacaaggactcgggataacaacttgttgggcaagttcgagcttacaggcattcctcctgcaccaaggggtgtccctcagatcaatgtctgcttcgacattgatgcaaatggtattctcaatgtctcagctgaggacaagactactgggcagaagaacaagatcacaatcacaaatgacaagggtagactgtcaaaggaagagattgagagaatggtgcaggaggcagagaaatataaatcagaagatgaagagcacaagaagaaggtcgaggctaagaatgcccttgagaactatgcctacaacatgcgaaacactatcaaggatgacaagatcagtgccaagttacccgaagctgacaagaagaaaattgaggatgcaatcgatcaggctattcagtggctggatggaaaccagctcgcggaggcagatgagtttgaggacaagatgaaggaactggaaaatatttgcaatccaatcattgcaaagatgtatcaaggaggtgctgcccctgatgtagctggcatggatgaagatggtccttcagcaggtggttcaagtggtgctggtcctaagattgaggaagttgattaagcggatgtttgatactgcggatggttgatactttggttatgcaatacgttctttaagcattccttttgcttttagtaaaaatgtggaagaacatgtttcttatgtttgaagcttttgagttttcttgtttgtacacataagttgttgactatattttactgcgtgtattactcttgccaaaacatataatagtaggttttatcatttccccaaatcttttctctgtttaaatcaaattgagcatactattttctcattttggatttagtattttctagtcacgacagaatgtgaatcgatcacatagctgaccccattcattagaaaagaaaaattcactgtcaggacagttccgtatagctgatgctaaacttcattgctatttgctaagttaatacataaagggatgattttttttaataataataaggttaagttgtttatttagagaagattctaatgaacgtaatttagatacttgttcaataggtttagaagtgcaagtaagagtatatataattgtttataatattatgcttacatttaagaatgactattgttcagcattaattatagctgatctgatggtatttcatggagtagtagattaattgaatatgtgttgagtcaagcccgaaatctcattgtgatggaggtgactttgatcacctagtagcatacacgttagcttgcacgtttgagaacggggtagagagcgcaacggagtgtgagaacattcgttttggctcacttgatgaagtgagttttggagttaattggagatgccttgatgaagcaaagagtatggagtgcttcggttcgggtctcttgaccaagcattggatgatgatgaattggtgcatcttggtgaagacaaggcacatgtgaagggttggtacagcaaggctgcccacccacgaagatcagagggcactgtcgaagaccgctcgagtggtcgagtggctgggactgggtcgagcaggttgcgtgcagctggacagtagcttcagcattggggcttgacctggtcgagcataccaagctcggtcgagcggcttagactgtgccagtagcgtgtttgctgtttttgctatacagttttatgggctttagcccatttgtccctaagtcttataatacattcttagcactatataaggagtattagggagtgttttagggtttaaaagagtcccaaatacttagagtttactagggtttatgccattaagagtcttctctattgtattgggtgttttgagggagattgaaagaaagtttcaatctttggctttgtgaagtgtgttctcagagctttgtgtgttgaatcattagtgtatgttgatatattaatgataagaaacattattt

SEQ ID NO: 1590 - DNA, 2310 bp, Amaranthus palmeri
aaatacgtcgtttggcatttcaagagaagataatggcgggagcatggaaagctcgcgtatcttcaatcgttctagggatcatattgtgcggaagtttatttgcgttcacaattgccaaagatgaagcaccaaagcttgggacagtaattggaattgatcttggtaccacctactcatgtgttggtgtgtacaaagatggaaaagttgaaatcatagctaacgatcaaggtaaccgtattaccccttcatgggtggcattcaccaatgatgagaggttgatcggagaggctgccaagaatcaggcagctgctaatccggagaggactatttttgatgtcaagaggcttattggaagaaagtttgaggacaaagaagtccagagggacatgaagcttgtaccttacaagattgtgaacaaggatggaaagccttacatccaagtcaaggttcaagacggtgagactaaggttttcagccctgaggaaatcagtgctatgattcttactaagatgaaggaaacagctgaaactttcctcggaaagacaattaaggatgcagttgttactgttcctgcttatttcaatgatgcccagaggcaagctaccaaagatgcaggaatcattgctggtttgaatgtcgctaggattattaatgaaccaacagcggcagccattgcctatgggttagacaagaggggtggtgagaagaacatccttgtctttgaccttggtggtggaacattcgatgtcagtatcttgaccattgacaacggtgtttttgaagttcttgcaaccaacggagacactcacttgggaggtgaggactttgatcagagacttatggaatacttcattaagttgatcaagaagaagcacaacaaggacatcagcaaggacaacagagctcttggaaaattgagaagagagtgtgagcgtgccaagagagcattgagtagccagcaccaagtccgtgttgagattgagtctttgtttgatggtgttgatttctctgagccactcaccagggctcgttttgaggagttgaacaatgatctcttcaggaagaccatgggccccgtcaagaaggccatggaagacgctggtttggaaaagaatcagattgatgagattgttcttgttggtggaagtactaggattcccaaggtacaacagctgttgaaggagtacttcaacggaaaggagcctaacaagggagttaaccctgatgaagccgtcgcttttggtgctgctgttcagggaagtattctcagtggagagggaggcgaagagaccaaagaaatccttcttctggatgttgcccctcttactcttggtatcgagactgttggaggagtcatgaccaaattgattccaaggaacactgtgatcccaaccaaaaagtctcaagttttcaccacttaccaggaccaacaaaccactgtgaccattcaggtatttgaaggtgaaagaagtctcactaaggactgcagacttctcggaaaattcgaccttactggcattgcaccagctccaaggggaactcctcaaattgaagtcacttttgaggtggatgccaacggtatcctcaacgttaaggcagaagacaaggcctcaggaaaatccgagaaaatcacaatcacaaatgacaagggccgtctcagccaagaagaaatcgaaagaatggttagggaagccgaggagtttgctgaggaagacaagaaggtgaaggaaagaatcgatgcccgtaacagtttggagacatacatctacaacatgaagaaccaaatcagtgattcagacaagttggccgacaagctagaatctgatgagaaagataagattgaggccgctgtcaaagaggccctcgagtggctagatgataaccagagtgccgagaaggaagactacgaggagaaactcaaggaagtcgaggctgtttgtaacccaatcatcactgctgtttaccagagatcaggtggcccaacaagcgaaagcgctgatggagatgattctgaggatgggcacgacgagctctaagatcgatctcggattcaattgttgattgttgtaggtttaggctcggtgactttgtgggggttttagaggaaagctgggatagagaactcatggatttgcagttttctcaatccctcttccgttcaatttttgagagacaatgtgttggcatatttcaactgctattattatcatcagctgaaacattggattttgttttattacaacactagtggattctagataattgcctattttactcatgtaacatcatcaacgtttactaatgtaatac

SEQ ID NO: 1591 - DNA, 7990 bp, Amaranthus palmeri
attttcggcccggcccttataaagccctcctaaaaacgggccggataagggcttaaaatgggggcccggcccattgaacacctctagtcatggttgtccaacttcgattatctcattttcctcgtaaaattcattccaatgcattaccattgagataactgatattaggtggtaatgaaaatttgtaaacaaaaaaacttttttaggatcaaagtttcattaccatggtaaaaatatgaaacttttaatgaaattttacacaaggcagggttggaggttttactttttcttgaaagatgcagacaaatcatactcgtacccccaagaagggaataaagagagatgcatgcagtcaagaaacctccaattgatacctacgtctaataggggtcgaacctcaaatcttctgctctacatgcaaatgctctattcattgagcaacaagcgcttcggtacaattgatacttactctgaattttaataattggttatagtttttgtagcaattattatttatcagttgatcttatttcatataaatttctttttgtataacgtaaaatatagtcagatgatatttttatttttatttttttgccaagatgagattctatttgaattgtctttatgtatattttcataatattaactttttagaatttttatcatatgcaattaaagatattaaagattaaaaaccgtacatttaataatgtgaaaaatagaagtgtagcaactattaaaaacaaaagtttacttatttaaatgaaaaaaaaagtatcctaaaatttgattgggtgaagaataagatgattaccaattaatacgtcctatttttcttgttacatttatttttttctatatacaagtccccaacctatcacctttctcccttgagtgagcatcaaacttggaataaataatatcttgctctttttttgattggctaatcaaaatatggtgactaattccaaatttaatgttgtactaggttatacttaatgtctaaataattcaaatcataattttttaaattaataactattggaaaccaattttatcctcgttaacaaacgctttgaaaaattatatatataattagaaaaattctttttaaaaaatcataattcataactaattaccttgatgcccacaaaaattgagttgatcaataaataacgcaactcttctactccataaaaaatcatcatcatatccaatgtatcacgttcacagaaaaactatgattagggtttaggaagagatcaagaaatacgacaagttataagtataaagaaaagtgcggttaaagagtccctcagttcaaaaaaagaatacaagtattttatgtggtatctcatgtatattttcatcaaatagacaagaaataacacaatatataattatttattctacaacaaaataataatagtacataagcgcgacatacacgtaacatacaagattaaacctagccatgtaattaattataacaatagggaaacgaagtgcattgcatatatcacaagtctatatctttttccatacgtatataatattcaaataaacaaatgccctttttataaattataatgatatatctcccactatgtaatatttatgagaacgaagagaatgaaccttagttggaacttggaagtagaggtggcgggtcgaccctacaggtcaaggattaggttatattttaacaggtcattatcacgtcgggttaataacgggttcggttattaaacgggccttggtgtcgggcaggtaagataattatagattggttgcgaaattttttttttaccttttgtttttatatttttatatgattttattatattttatatacataagtgggtcaatctaacgggtcattaattagcagaataaaaaaacaatttaatgaattttttaaaaacgggtcaacgtgggttgaattcaacgggtcattaattagcagaatatttttatatgattttattatattttattattatattttataacatttgatatgccgcgccccgacaagaaaggtcattaaaggcataattgtccaaaatacctgaagacaagaaggatgacaaatgtcgcttctacttcagctttttatgtgacgagaataaacttttctacctttaatttttaggtattgaatatcgtttgtggctcttacattttcgtaaatgtgtaggggctgaagaaaagaagttgacctacataaggaaaatgtaacctaaatagctccattagccaaagtatcaagttgtttaactttgtttttaggctttctattgaatctcaatcatttttactatgttctttatatgaataaatatttgatttcaatttcaacatcggaccatgaagttttagctttgaaataaagactgatatattttttttcaatttgcaaaaatgacatttgctatggtgtaggtcgttgtttgactggccttacctattagacttagatacacaattttatcacattgatagttctaaaagactagaataaaagaaatctaatcttaactatctttggcatagttgtttgggacatgtaaatgagaaacgcgttttaaaactccataaaacggactttgactcatttgattttaaaaaatatgaaatatgtgagtcttatttgcctgggaaaatgactaatagatcactatttactagactgagtgaaagagctagcgacttgttagggttagtacatttatatgtatgtggtcctttgagcaagactagctactcgattaatatgaatatgtctactttaaatctacttttaatccggacaactttttttccatcatttatttgtaatgtttgtattttaaaggttatatatataatttttaaaaaatttatttatataaagaaggatatttgttagatcccattttaaaaatcttgaaaattttttactggttgtataattattttttaaaaaatttatttctagatgaaattacccatttattaaataaaactaattatttaagtaaatatgaatatgaggtagataagtagcaatgacatgaatttgcatgttagtataattataaagatataattattctacagttggtaaataaatcttgaaaaataatattgaaaaataatatactgatttacaaatttatcctatttcattttactatgccaaaaagttattctattttactaaggtaaatacttcggaaatataatgcttactaaatcttcttatgcatattaaattgtatgatattaggaaatgattttcattgcaaattcacctgtcacgtatataaaaattagagggaaaatttttactaggagttagacatgtgccggtcttgtttcttcattaatagtttttagggggtgtttagtataaaggaatgagacttggaagagaaagataaaatgaaaatgaaattctcaactcaaatatccgccatccccaagacatttttcttggggactttctcccattttaatcccaatccctattctcatttccattaaccaaacaaagattagacttacttttgagataaagtctcatttcctttctcaaatcccttatgcaaacaccccgttatagatagatagtttttatagattataggaaaaaggaaatattaattcaatccaattcgatccaaaaatgtataagtaaataacgtatatttaagaaagtagtaaatcacgcttaaatatcaggggaactcttttttggccgcgctctcctttatggctgtatgagttgccgtcgtccttccctcccagaccctgcctataatttttctattagcgagatacactggatatgatatatgatgatgagtttaatttaatactccctccgattcacttgtgttgtctcatttccttatttggcaaattcatattaattatctcatttccttttttgtctatcttttttttacctaaatacccccaccttttcaattcccaataccacactaccacctttacaattaatttaatcaaattaaaaccccacttttccaattcccaatacccaactaccacctttacaattaatttaatcaattaaaatacctccccattccactcttaaaaaccgtgcccaaccaaataggacaacacaagtgaattggagggagtattatatatgttatctttttgtcttttaaatctggctactagaattactaagaatgtgcgagaaaacccccgccctttctctaattcttttacacatctccattctccaccctcctctcgatccttcccttttcttcttcttcttaccgccattttccgccattataaatactcatcaacaaaaccatgaatcacaagcaaacaatcaaacaaacaaaacatcaccattacaaacaatccacaaaaactcgaatcattccgatcaattttaagtttccataaccatgtcgaaatcccaagctggaaaagccattggaatcgatttaggaacaacctacagttgtgtaggtgtttggcaaaacgaccgcgtcgagatcattccaaatgatcaaggaaacagaacaactccatcgtacgtcgcgtttaccgacaccgaacgtttaatcggcgacgccgcaaaaaatcaagtcgcgatgaatcctcaaaacaccgttttcgacgctaaacgtctcatcggtcgacggttctccgatccatccgtacaatccgatatgaaattgtggccgtttaaggttgttcccggtgaaggcgataaaccgatgattatcgtctcgtataaaggagaacaaaaaatgttcgctccggaagagatttcttcaatggttttaaccaaaatgaaggaaatcgctgaagcttatttaggacagagtattaacaatggtgttataactgttcctgcttattttaatgattcacaaaggcaagctacaaaggatgcaggatcgatttctggattgaacgttttgaggattattaatgagcctactgctgctgcaattgcttatggtttggataagaaaggttctagatcgggtgagaagaatgtgctgatattcgatcttggtggaggaactttcgatgtttcgattctcaccattgaagaggggatttttgaggttaaggctactgctggtgatactcatcttggaggggaagattttgataataggtacatacctcttgcgttgcttcattatttaatttgattttttttttaaagtatttaattttatttttttgtttggtagacactaaggttgagttaatgaattttggaattataaatattattatgattataaataaacttatgatttttaaatgtaaaaataatttgcaattttttcattcaggattaaaaatttacaaaaatatatttgaagtttttgtttaggatcgcagtttaaatttaaaaaatataaatagagaatcttagattttgttttaaaataaataatttatttaaaattattagtttgagaagtgattcttaaatttttcaactttgataactgtggaattgacttaaatataaattttatatttttatatgttatatacaaaatttgagttaaatttagattttcaaatgaaattatggttcctaatcatattaattaatgcattttaatttaagataaaatctcgttttctgattagttcatctgatttttgctcattcaattgatctttaccgattgaaattgattatagtgatttttattgattgtaatggattgaaatttattgaaactaattgtaactaatttttagttgtaaattataaacgagttgtattggctgattttaactttaactgatttttatcggttgtaattaaattttaatgcctaaaattaatttttactaattacttttgtttaagttgaactaaacagagcctttgttaatttaatggacacttagaaataataaatttgaaagtgtaatgaatttttatattgcaaaaattttaatttgtacttgtaatgcaccttttaactgaaaaacattttgatgataggttggtgaatcattttgctgctgaatttaagagaaagcacaagaaggacatagcaggaaatgccagagctttaagaaggttaagaacagcttgtgagcgagctaagcgtacactatcttcaaccgctcagacaaccatcgagatcgattccttatacgaagggatcgacttctatgcaacaatcacacgtgcaagattcgaggaactctgcatcgatttattcagaaaatgtatggatcctgtcgagtcctgtctaagggatgccaagatcgataagagtaaaatcgatgacattgtcttagtaggtggctcgacgaggattcccaaagtccaacaacttttacaagatttcttcaacggaaaggagctttgtaagagcataaatcccgatgaggctgttgcgtatggtgcagccgtgcaagctgctatactgtcaggtgaaggtgatcagaaggttcaagagcttttgttactcgatgtaacaccgttgtctttaggaatcgagactgctggtggtgttatgacagttcttataccgagaaacacaacaatcccaactaaaaaggaacagattttctccacttattcggataatcagactagtgtgatgatcaaagtgtatgaaggggaaaggcctatgactaaggacaataacatgttgggtacctttgaacttaagggtatccctccagctcctaggggtgtccctcagattaatgtatgttttgatattgatgctaatgggatattgaacgtgtcggctgaggataaaacggctggtgtgaagaacaggattacgatcacgaatgataagggaaggttgagtaaggatgagatcgagcgattggtgaaggaagccgagaagtataaggcagaagatgaggctgttaagaagaaggtggatgctaagaattcacttgagaactatgcatataacatgaggaatactattaaggatgaaaaaattggggggaagttggatagtggtgataagaataagattgagaaggcaattgatgatgttattgaatggttggataagaatcaattgggtgaagttgaggagtttgaggataagcaaaaggaattggaggatttgtgtaatcctataataagtaagatatatggtggtgggatgaatatgggcggcgatatgccgggtggtgctggtggtggtagtggtggtggtaatgctggtgctgggcctaagattgaggaggttgattaagggacattggtatgatacttggacggttttaggcgtaaaattgatgtttagacgtattcgatacttggacacatactagtatcgaatatcagtattcgagtccaagtaacatagtttgaggtgatatacttagtttcttctctgttttgtaattctgtttttttctgatgtttttttctttaagttaagtaaaataaaacttttagatatttatgtgtatggtacataaatgagtgagtagtagtatatatatattgtaataatacattatggtagttaatgttttaatgaagtaggcttttcttaagtaagttaagtgcattgggtcgctgtccttgtttggccataatttttctgaaaaatttgaaaaaagatttttttttttaaataaaaaattaggaaaaacaaagattagatttttatgaattacagccttaaagttttctcgttttatgaattacagccgcaaagttttttttatgaattacagccaccaactttttaaattgaccaccattacggccaagtgaccggttgagaccgttgaccagcctttttctgatttttccttctttttttggagttttttttttctttttcctttttttttagtttttttttgtttttccttttttttaatttaattcttcatcctctttacatctttctctctcctcttccttcttctccatcatcttcatcctcttcatcctccattaatcttcaaagtcaccattaat

SEQ ID NO: 1592 - DNA, 5699 bp, Amaranthus palmeri
tttcaattattataatcactaaaaatatctcactactgtttttccttattttgcgtgcccactacaaagtggacaaaactaatgggacggagggagtaacatcgttccacctaaacaataagtttgtttgaatgaaaaaaattgaggaaataggggaaggaaatggagggatttagatgactgaaaaaaccgttattttgaatatcaaatgagaggtgagtgatttggaggaattagatggattatttttggatttgatttcgtattaaaaaatatttaacgtgaaattttttttatttctcttctatttcctctaaaataagtgaaaattagtttttcctccatttcttctcttcctttcacacccttttgcctttccaattttcttcgtttcttttcatagaaaaattattattcaaacatagtaattaacataaattttcacatgagacaatcttatggtaaaatcatcttgattaagtcaacctattgtattattactatttcaaagtgatcatttgtaattttaaagtgattacttaccatcttaaaattatcaattagaaaagtaaagtagttatatcacttatatgacctattgtggcattgttcttgatgaaaaattgaccacatagactaggttcgtccaacggaccatgttgggtcgtgttcgggttcagataatataatacatttacatgacataaacctcttgagtgaaacccatctcgtttagttaattaagtcgaaaattacaattttgaccagacccgcaacagatcaggtcgacttaatttcacccatttaacttgtttataattatttttttcattttaaggtttataatattgacgacatctaatattttaggccttaattaatttaagaattttttagttgtttattttgtatgtaaaataagaaaatattaaagaattaagtttagattatacttaattgatttattttggaattaactcatttaattaaataagttatttaagtttgtttcttgcttaaaattttgacctgaatataaaaaatttaataaacaaataatgtaggattgacaaattgaagtaattggattaaaagtctcaatccaaactccgttatttcgggttcacaaactcttgcatgagataatctaattatgagacatgtttcatacttggattaaacagcctaataatttaaacattttgtttatgagtttcttattttggagcttttaccgtgaaaaagtctcatacaagacggcctatttcgagttaggtttagattggattacaaagttggattagggtttggtggcccgaatccaacggctaagaattccctagaacattctagagaaaatcgctccatatttttctcaagcccggcccccaagttccactctttcactcctataaatattccaaaccctaattcttcatcctcgttctctgccgctgcattcaaattcttcctcttctcttctcttctcgtttttcagttttctttcattgtttgagtttagcagaagcttaaattcgtaacaatggccggaaaaggagaaggtcctgctattggaattgatctcggtaccacttactcatgtgttggagtatggcaacatgaccgtgttgaaatcattgctaatgatcagggtaacagaactaccccttcatacgttggattcactgatagtgaacgattgattggtgatgctgccaagaatcaagttgccatgaaccctatcaacaccgtatttggtactttcttttacgtctaattttttttagatctgttttattttcagtataaatgttgttataagttgtataatggcttgtttgatttgttttcttctttaatgtttacatctctgtctctctgatgcaatttatatgtaaatagatttcatgaattggtgattcgcatgatactctgtctttctaattttgttttctattttcattttcctaaacgctggtacttccttttacaatttatacgtatacagatttcattgaaacattgatgatttctacatataaataagtcctatatttcacgctgtagtttatagatagtcggaaagatacgcaactcacagacattaaagtttctaacaaaggtgggatacgactctaaacgccgatgcatgtttggtaattgacgctaaatggtgtcaattataatggaatgtttggatatttttggtagaatgtacaattttattggccatgatattcttgttcaataattttattttctgtataaaaaaataaaatgtattttcattttaaaatgtggtattagaagtaagcaaaattttataaaaaaaacgctttttgtagattaaactaaaaattacattatgaatttaccattttgtattaattatcaaaaattaccaaatgcacgtaattgatgtttttatgtgggattcaaacatgcattgataatgtccttaatgaattttttttctcttcatttgcgatgagcaaatttgttctggtatgatttcattgatatgcagctttgcgctctatgtctactagtgatgattttgttttagctttgcatagtacgcaaattgtatttgtcctttattcgaataaagtattttagactgttgtttaagtattacttttgtatttcttgacatatataataaaatgtggttctaattagaaattgttgtgaaatttatctgcagacgccaagaggttgatcggtaggagatttaatgatgcttcagtccaagctgatattaaactctggccatttaaggttgttccaggtcccggtgacaagcccatgattgttgtcaactacaagggtgaggagaagcagtttgctgctgaggaaatctcctccatggttcttaccaagatgaaggagattgctgaggcttaccttggttctactgttaaaaacgctgtcgttactgttcctgcctacttcaatgactctcaacgtcaagctactaaagatgctggagtaatctctggtttgaatgtgatgcgtatcatcaatgagcccaccgctgctgctattgcttatggtcttgacaagaaggccacaagtgtcggtgaaaagaatgttcttatctttgatcttggtggtggtacttttgatgtttctctccttaccattgaggagggtatctttgaagtaaaggccaccgctggagacacacatcttggtggtgaggactttgacaacagaatggtaaaccacttcgttcaagaattcaagaggaagcacaagaaggatattagtggtaaccctagggctcttaggaggttgaggacagcttgtgagagggcaaagagaaccctttcatccactgctcaaaccaccattgaaattgattctctttacgaaggagttgatttctacacaacaattacacgtgcccgttttgaggagttgaacatggatttgttcagaaagtgtatggagccagttgagaagtgtttgagggatgccaagatggacaagagctctgtccatgatgtcgttcttgttggtggatccactagaattcccaaggtacaacaattgttacaagatttcttcaatggtaaggagctttgcaaaagcatcaaccctgatgaagctgttgcttatggtgctgctgtccaagccgctatcttgagtggtgaaggaaacgagaaggtccaagacctcttgcttcttgatgtcactcctctctccctcggtcttgagactgctggtggtgttatgactgtccttatcccaaggaacaccaccatccccaccaagaaggagcaagttttctcaacttactctgacaaccagcctggtgtgttgatccaagtctatgaaggagagagaaccaggacccgggacaacaacttgttgggtaaatttgagctctctggcattcctccagcccccagaggtgtccctcagattactgtgtgcttcgacattgatgccaatggtatcttgaatgtctctgccgaggacaaaaccacagggcagaagaacaagattaccattacaaatgacaagggtagactctcaaaggaagagattgagaagatggttcaagaggcagagaagtacaagtctgaagacgaagagcacaaaaagaaggttgaggcaaagaacgctttggagaactatgcctacaacatgaggaataccgtaagagatgaaaagatcagctctaagcttggagaagacgacaagaagaagattgacgaagccattgacaacgcaatccaatggctcgacagcaaccaacttgcagaagctgatgagttcgaagacaagatgaaggagctcgagagtatttgcaaccccatcattgcaaagatgtaccagggtgccggaggtgaggctggtgttcccatggatgatgatgtacccccagctgcatctggccctggtcccaagatcgaggaagtcgactaagcttttcgtataattattttgtgggatttttgattttcgatttttgttttgcttaagcatttaagactattttctatttagaattgtgacacaatgcagtgatgtttgtttttaatgatgagcattatgctgctttatttcccatggattaatatgaagacgatgatttttgtatttacttctgctatgctttcgtttttggttgtgattatggttggcaacatactatttgttcaatggaccaaatttcttgacatcatgttaggagtctttttcaaaacaaaaattatattattttgttaaatttgattttaaagttgaccgcaattccaccttgaatctggtaattaaataataatagaactcagtagaagcataagttggggttaagtgtagaaggtggccaatagaaaatcagggtaatgtatgaccaattcactattctttgagaatcaaagaacaatttgattgatttttcaaaaaaataaaaaccaatttgatttatttatcaaaaattcctaatcaataaacgtgatttgtaaattaccataaaaagataacaagaataatattaaaataaacaaaaccaaaaaagataaactaaaataacaagactctcacccgcatactaccacataagggtaattaattaacgttacaaataactgttatttatactaaaaccttcttctgtttaatttactacattaataactacaattcaatctaggtgatgttaggcgatcaactccattatgtttcagcttcaaagctggattttgattgattattgtgagaccgttaagaaaaatgagttaaatatgacatccaatacatattatgaaaatatatagttatttttggaaatcgtattaccaagaaatgatctcttacaagagtatctttttatatgaatatgggaagttaacggttagtataggtaaaattcatatttttcgatctaatgcaaaccaaattaaggctatctcaaagttcaaaccccaacgagaaggcgtcggacaaacttagacttcatgctcatcaagtacatgttgtttcgggaccatgatttcatgtatagtttctatttcgacacaataagcttcaatcttcgcatcatccggaattcgtgtaggcaatgaaaattagcccattaaattgcacgaacatgctttactaagtactaacacaagcaacgttcacaatgccaaagacaagagtatctgtattcttctatgtaactcttgccgtattaagatcag

SEQ ID NO: 1593 - DNA, 1993 bp, Amaranthus palmeri
gaatgcaaaggtaatagagaatgctgaaggagggcgaacaacaccttcagttgttgccataactcctaaaggtgacctactggtgggaacccctgcaaaaagacaagctgtgacaaacccacaaaatacctttttttggaacaaaacgtctaatcggcagacgttttgatgaccctcaaactcagaaagagagcaaaatggttccttttaagatagtcagggccccaaatggagatgcatgggtcgaaactactaccggacagcagtactctcctagtcagattggagcatatgttctaacaaagatgaaggaaactgctgaagcgtatttgggaaagagtatctctaaagctgtagttacagttcctgcttattttaatgatgctcagaggcaagcaacaaaagatgctggaaagatcgcggggctggatgtgcaacggatcattaacgaaccgactgcagctgcacttgcatatgggttaaataacaaggaaggtctcatagcggtttttgaccttggaggtggaacttttgatatatccattttagagataagtaatggcgtgtttgaggtgaaagcaaccaacggtgataccttcttgggaggagaagattttgataatgctttggttgaatttttggtgagtgagttcaagaaaactgatggcattgatctatcaaaagatcggctggctttgcaaaggctaagggaagctgcagagaaggccaagattgagttatcatctaccactcaaacagatattagcttacccttcattactgctgatgcatctggtgcaaaacatttcaacatgacattaactaggtcaaaatttgaaagtctggtggatcatttgattgttaggacgagagacccatgcaagaattgtttgaaggatgctggaatatctaccaaagaggtggatgaagtccttttggttggtggaatgactcgtgtacctaaggtgcaagaggttgttaatgaaatattcgcgaaagactccaagtaagggtgtcaatcccgatgaagcagttgcaatgggtgcagctattcaaggtggtatccttcgtggggatgttaaagagctacttctactggatgtaacccctctttcacttggtattgagacccttggtggtgtttttacaaggttgatcaacagaaacacaaccatcccgacaaagaaatctcaggtattctcaacagcagcagataatcaaactcaggtaggagtcaaagtctttcaaggcgagcgtgagatggcaacagacaacaaacttctaggagaatttgaactccagggtatcccacctgcgcctaggggtattccacaaattgaagttacattcgacattgatgccaatggcattgtcactgtttctgctaaagataagacaaccggcaaagagcagcaaattaccatccgatcatctggaggtttgtcggaagacgagattcagaaaatggttcaagaagcagaattgcatgcccagaaagacaagcagaggaaagctctaattgaaataagaaacactgctgattctactatttatagtgttgagaagagtttgtcggagtacaaggacaaggttccaacagatgttgtgaaggagatagaaagtgctgttgctgatctcagggaagctgtgcagaaagatgatgctgatttgataaaggccaagattgacgcagcaaatgccgcagtttcaaagatcggacagcatatggctgggggtagtggcggtggtgctaacggaggttccggtggatctcaaggtggtggggatcaaacccctgaagcagaatatgaagaggtgaagaagtaaacttttaaacgctgagtttagttgaatccttacatccttagtgtgtagttcatgtttattatacgcattacccagtctcgtctctttgtaataattctcgatgtagattttagaaagaaatcctgaattaaattgcaattgtggatgcaatatttcagagctgtta

SEQ ID NO: 1594 - DNA, 734 bp, Amaranthus palmeri; identical to SEQ ID NO: 1587

SEQ ID NO: 1595 - DNA, 5016 bp, Amaranthus palmeri
tgtttttttggtcttatttgcttaatgattcatggtttacctttataaattctatgtttgagtattagtttgattttatgatgaatgtttggctttgaatgattattgatcatagctttgcattctttacttttgtttttggctgttggctgttgtctgttttttttttgtaattccttcttcctgtttcatggattttaggtctttgcctgcttaagcttatattacttgcaaaatcaaattaagtacactaattaatcaattttgcaaatgtatcggctatttggcaatctgattataattataacatataacacattatttgaaagctgagttgtttttgagtaataatctcattctgttcttaacagcaattgcttgatgttgttggaatatacttgtttggctttgggcttctgttggtgtaaaggatgaaatgaaaacaaataatcaagcaaattttacttgccagtctccaagactacttttgtagtttaagatgggtcattcattgcctattttttcttatcttgggctaattaaatttagggatgagcttgtctatggataagaacataattttggtactacaaatattttttaggatttgaaagtgattgtttgggagacttattgacggtgatactcatgttgtagtagaatgtggtgaaagtgacttttgttttggttcaatttggcttcatcccctaactttggggtcttgccccaaagtcccatgatacactatatcctcgctaatcatgaatcgaaatacgcttattagggtggttttgagctattttgggccattttgagtgaatcaatcaaaaacattagttgccaagggctcttacttaaggatttctatttttgtttgaaataaggcatcatcgttacgtctgcagcttctatatatatacaactgaatcagtacttgcatctcagggaactttctataatttcggatataaagccaaaaacagctctgctaacactttaagattaccaactgtttgatcacattgattttctttttgtagaaggtttgttcaattttgcacatttgttggagcattgagagggtattgtttgcaactgtttgatgctgtaactttgttcaaactgtttttgaagtaaactttgatcaaactgttgattattattaacaataatggagcagaactttttttaagcttatttttgaaaatatttggataaataagtgcttccccaaacttactgggaaaatatgcttcaaaggaagtcgctgttagtaacagcgatttaccaccttaatgggctggggggtgggttttggacaaagagtaaatcgctgttaccttggagcatttcgggaacacataaactcgctattactaacagcgatttcccctttgtccacaactcagcccccagcccattaaggtaccagctcgctgttactaacaacgacttcaccaaaagcttgttattccaaatagtttggtgaacacttatttaaccaaatattttcaaaaaaaaaaacttaaaaaaaagtttaatggagcaggtatcgaatacaaaagacacttgtgtaatgtgtttgtgggttttaatcttacatctggtgatatatatttgtaaaaattttaaattgattaatgttatgttttatgttaacattatgagtataacttagcttatgaatctgctgtaccttatggaacaaatgtgcaaaattgaagggatcttttagtaatgcgtatctctactactagattgttgtcaatgggaaaggatcatatccatcaatactgatactaacatcctatccttttttctggtttgtgtttgttctgcttgttcacttttcttacatctaattggattacacctgtttggtagagttagaatatgttgccagatgacatagtacaatagaaaattttgtttcagccccgatgaatatttttttcttccctttcaatggccagaatggcatatttgcactattttgatattgttgatatcattgagttttcaagtcgtagatgtttcagcatttgcatcgtatctttgtttccacatgaatgcttctggccagtcacgcaatcgcctatataattcagggtttgaatcatatttgcatggaccgaagttccatcttacatttgaaactggtttgtttattgcaggaatggctcaaccagcatacacagtagcttctgacagtgaaactacaggagaggataagtcttctgcatttgctggaattgcaattggtattgatattggtacttcacaatgtagtgtggcgttttggaatggctctgaagtggagttacttaagaacactaggaaccagaaaagaatgcagtcatatgtgagcttcaaagatgaagtccctaccggtggagtcagcagtgaacttacccacgagcaagatatcctgtctggagccacaatcttcaatatgaagcggttaattggaaggattgacactgatcctgttgttcatgctaccaaaagcctaccctttttagttcagaccttggatattggtgtgaggccgttcatagctgctttggtgaataatgcttggcgatctactacacccgaggaagttttagcgatttttcttgttgaattgaagaccatggcagaattacagttgaaaaggcctatacaaaatgtagttctaactgttcctgtttcgttcagccgttttcagctgtctagaattgaacgtgcctgtgccatggcgggccttcatgttcttagattgatgcctgaaccaactgctgtagcacttttatatgcacaacagcagcaacacaccgttcacgaaaatatgggcagtggaagcgagaagatctcccttattttcaacatgggagctggctatagtgatgtagccgttagcgctacagctggtggtgtttcacagataaaagccttatcaggaatcgccattggaggggaagaccttcttcaaaacttgatgcgtcatctcttacctggatttgacacggctttctctggtcatgggctcgatgccatcaaagcaagggcttctcttcgagttgcggctcagaatgctatgcatatgctttcatctcaaacaagcgttaaagttgatgtcgaattgggaaatggtagaagagtgacaaagcttctagaaagaaaggaattcgaggatgttaacatggcattattcaacaaatgcgaacgtctaatacggcaatgcttgaatgatgctaaggtagaaatagaagatctgactgatgtcatactagttggaggatgttctgtaatccccaaggtccgagattttgtgaagagcatttgcaaaagagagaatttctatgaagggataaacccgcttgaagctgcagtatgtggagccgcactagaaggtgcagtggcgtctggtgttagcgatccattcggaaacctcgacttgctaaccatacaagctactcctctaagcatcgggatccaagcaagcggaaacaaatttgtccccatcatcatgaagaatacggctgtccctgcaagaaaggacttggtttttaccactgtccacgataaccaacccgaggtattgatagtcgtttacgaaggggatgaaacgaaagcagaggagaactatttactcgggtatttcaagatcagtgggatccctccattgccaaaaggaattccggagataaacgtgtgcatggatattgatgcttcgaacgttctgagagtgttggctggtgttgtggttccaggcagtcagcagccggttacaccaatcatggaagtgagaatgccaaccattgatgatgggcatggctggtgtgctgaagctttgagcaggatttccgactctacattgggtttaaacccaatacagaagaaaacccaggcatgatatcgacctattacttatacctcgtttatttttagatcctgtttggaatgataggctattgaaggcaatggtggaaatggtttttgtttttagtatcatcacctcctacttgaatagcttgtgcatttcattattgttgttaactttcttccaaacatggcttcttttctggtatagagtgttggtaatgtttatctgtttgggtttatcatgtaaattatagatgtggaaataaaataggctgtggctgtgcattgtgtcatgtagtaaagaagtatttggttatttacagcttcttgttgctatattaatgctaataaattttaggtagagtgagtgccttagttccttattttacctctcaatttcccaaggcaaccaaaagaacttgcgacttaatggacagagtatctgcatgttgagcacggtattagttttggaggattttttgactacacgcattctctttactcccttcttgagggaatatgtatggtttgtttgcatcttttaagaaaaaaaaactctccatccgaatcatttcttatgcgagacattgaaagtgtttttcattttttttttaaattttctaagccaatttttgtttgttctctttgacattgcacctattttttaaacttgattcaaacaagggaactcacaagtaggggtgtttaaaaatatccgaatttaaaaacccgacccggtttatccggttttaaaaaccggatttttgacccgaattttgaaaagctcacaagtgtaaatcaactttcacattccaaattgtctctcacttcaattccttttgtcttcctctcaataacggtgctttatgaagttaacaaatcacttttatgtgatagaattttatacggttagaatctttttatttttatttttatatatctttttgaggaggtttttttttatgatgatttacaaatcacagtgattacttaatttatgtttctttttcaagtttataaacaatagatgagaattgagaaggttcaatggtttataaagctattctttatttcaagcttccaacataatttcttgtttaattcaaatacctttatgattttgtccagatgattacatatcaacttaac

SEQ ID NO: 1596 - DNA, 11353 bp, Amaranthus palmeri
cttattttacatattgcgactaatgtataagtaaaaatatagtcaagtgggatcttgtttgaatcgtctaatcgcatactttcataatattagatttataaattttttagataagtgtagtttaagatattaacgatcaaaattgtgcattggattgcgtaaaaaaataaaatgtagcaagtatatggaacggaagaagtataaaatattgaccctatataatttaaaaaataattaatccactaatgataaactgaataaaatactacaattattcataatgaattttcattatttaagaagcatacaaatgcatctaagatttgctcgtcatttttcagatcaccaataaactttcatcatcatcatacccagtgttcccgcacatagatactctatggtcagggtatctatgtgctggaacactgggtatgaattgaaaatccaattttcatatggaaaactatgtaaacaaaatttagcaagttaaagaaatctatatttattattattaaataatcaagatcattcaaaattgttcaacctagacaaacatataagtttttttgtttctcttgctaattaaattttaagttcgcttaaattaataggaacattgatttaaagatgaaaatatactaatttcctagatgtcacaaattgtgcattctctgtttatatacaactgattatttaattgatcactttatatataatataagtaatcactttagaattcaaattaatcacattaacgtcgaaattgaagaccttaaaataattcatccatttaagattataaacttgtaagtgataatctcaatgttggaattaatcatttatagatcaaaattgaaatattttattttaattaatccatttaaaatttattttaagttgaatttaatcacttttatgtcaaaactaaaattgaaatattttgcaaaaatcattatttaagtatttatatgctttagctttctcttcttttctcattatagggcctataaaaatttcaaccctttaaactttgaggccctgtattatagcccacttcacatggacatcatcacatcaacgccttgcatacaagaagaagcatgtttttttttttaataatttgctcaaaatttgttaattaatccttttatgtcaaacacaaatttaattttataaattccacttccttattagcaataagctttagaagaagcatgttttttttttaataatacatgattcattgtaaaaaaagtcatacgacatctacatcagagagcaaatacataacaactttaacaaaaaataattcaaaattaacaaaactacaattgttgtgtatgagatctgaaaaatctaaatttcatcttccacatcgttgtttgatacagcctactacgagggatcttttgatctgttgtagtcttgagatagaattgaatttaatgtagttaatggtatttgcaattttggtgtgtcctgcattatcgcattaatatcgcaacaaatcaactagtgaccaaaattcataactctcgactctcacgaggcaacagattaaaacccaatatatgggtagaatcaacccaataaatggataaaacaactcttttgtagggagaagacaaaaatttattctaataatcatattgagaaggcttaaaacagagaaattagaggcttaccatcaacaaaaaggttgatgatagccctaaactaactatagatattagggttcttttagaaagagaagagtaaagaaagaaggcggctagggtttttttaaaatgttcatatacaactatacaaggtattaggagtaaaaaaaattaaaggtcttttttatgggttgtttgagggaatgagaattgtgagtattagacttgagatgagactttagacgagactttacgaaaaatatcttatctaatgtttggtaataaatgagaaaaaaatgtgaatttgttgtaaaatctcaattcaaataccaactcttttcgcagacattttattaatttgattcttcaactttcagtcgcaattttaaaattgcattctcacctataaagtttctcaaaacaaataacatttagctaatttaattaaaatcacatcaaacaaccaaaaatatcttaatccattgtataggaccacaattagaaaaatcaagaaagatgtagctagaaaccattgatgaaaaatcactattcatatccaaacaaaaatgaaaaagaaatacaagaaaatcaaagatcatagtgaacaacttgaagttgtacaagtaaatacaatatacttgcacaagcaagaagtgaagagaagctattgtaatgtcctaatatcacttgatttgctacctagatttttagcaaaaactcctaattaataaccgttatttataaatcaccataaaaggacaaaaagaataatattaaaataaaaaaaccaaaaaagataaattaaaaataacaaaattctcatactatcacatgatcacatcctactaaataagggtaatttatcaaccttggcaaaaaccgttatttactaagatcttctgtatttttggtgcttcctccttacaaaatttgatataaatattattaacattagaacgaattaaataagatgttaactgattagattttacctgattatattttaacttataaattaaaaaactaattacaaattaaaagtaatgatgaacagtgtagtatttctaatattgtaagtaatttaaaacagagagagtacgttattttggaaaataagtaaataactcatctattaccaaatttcgttcatagatttcatctttttattaatcatttataaaataaattttaaaataaaactcaaacttaaaatcttatctgataaatattatttaatttattttaaataaaatttaatttttattttaccaacataaagttttattttattatacctaaattaataaaattttattttacaaactcaaaaagacaaaaaaaagtattggtatattatagagttacatacttgtaaagttatgatatttgaagggtacatagtacacaccacctcagtaatcatagatcacattatctttaacgacccatttggtaggtggtcataaacgatggtaattgaaataaaaagttagtgtaattttacttgaaaaatctcttgtctatcttgatggtcatgattgttcaactccaatcttctcattttctttataaaattcatcacaatgcattactatcggaagagatggtattagcctattaggtagtaatgaaaatttgtataaatttttgttaagatcaaagtttcatcaccatgggaatgatatgaaacttttgataaaattttacattaaaaatcattcacattactaccattaaccaaacaggccggaaatacttcatttttattttctaccttaaggaacaacatttttttattttcattttcttctcttcctatcctcacccacctttcttcttccttctccctttctctctcctccatttttctatccttcgatctcttcaggtaaagttatctattacctctaaagttgcttatttattttccgccattttttttaattcctttcttgtttgcttcacctttttagttagggttttctatctatttttcgtgtttttgttaatgggatcttttctgggtttgcttgtataaattttgtttgacaatcatccatgtaggctgtagctattcggtgctttgattttttttttgttagctggatgcttaggattctatgcttattggggatttttaggatttgaatttgtagtttttttatttcttgattcttgaaagtaatttcctgcttttatttccctgttttttagtataacatatgccaattgtttgctcaaatctaagtcatatttgggtttttatctatggggatttttagtggaataggaattatgttatgagacattaagaaacatgtaaatgaatattaaggataaagttctagtggttaggatgacttcttgctgctgaaatcttgattgaagctaagaaatgtgacatcatttttttatcatataaggttaatggatagaattgaactttttagttttttttcaccatgatggtgctgaatgattgggtatacctgtgttttaaaatgtgataacgtggttgaagtagtaatgttatgctcctatgtccctctcagtttgctaaaaattgaatttgtggtttagttgttgggatatgacaaaaaatttgaatgtttgaattggtggatttaagaggggaaataaatgcgaaaatgagaattaacgaaaatggttgggatatctcgattatataacaaaattagtgggacaaattgagatgaaatatgtagctaactcaaagtgatgagagggtatgttaatgggagttttgatgtttgattattcatggtattatggtcctttaggtttaatacatgttacctactcttagttatgtattggtataattatctctttattcccaaaggtattgtttggcttggttaaatggctaatacatattccatttatggaatctgtgtttaatgaatctatattttgaacagtacctagagcttgaggtcttttttcctttatttatctcaaggatttatttggtagatgtaatttctttcattttgatgaaaaaattcacgtcaattatgcagtattaccggtgtgagtcatggctggagcattatttcagcccaccaacatccctgcttcatttgcttataaaataaatgggccgtgccaaaggtctgccaagagcaataacgttgtgaagatgatggccaaccttcaatttcccaaacttaggatgcgaagcttctcgggattgcgtgggggaaatgctctggatactttgggatctaccagtggatgtttttattccaaaatgagggctgtgctctctgtacgtaaagggacagccagcaggggtgtagttagagctatgtttgaacggtttactgagaaagcgattaaagttataatgcttgctcaagaagaggccagacgactgggccataattttgttggtacggaacagattttactgggtcttattggtgaaggcactggaattgctgccaaggttttgaaatccatgggaatcaatttgaaagatgcccgtgtagaagtcgagaagattattgggaggggaagcggctttgttgctgttgaaatcccatttactcctcgcgccaagcgtgttctagaactttcattggaagaagcccgtcaacttggtaagttaaatgaaaatcgtgagcctgtatttgacgtaaaatgaagatcccatttgcatgtgaatcactttatcttgttatgtattacttatttcttctttatactatcaccaaatggtttcatatccccctatttacaatgcacaataagtgcaatgaattcatttatcggcgcttggtgtaattaatcttcgttagtttggtattaatgtgaaaccagcaccatacttttagttgttgaatgttgcacttcttcctaatagctaatgactacattgttggtggcccagaatctctggatgctgcattctgaaattactttagtgtgttatttagtgtcaccttgcttgtattttaccagcaatcctcaatagtttatgtgggattctcctatttgaaaagggtaatttgaaatttataatgttaagtagcacatctatcctcaagaaagaaaaagactaaagagcatgccttctcaaataattttgtaatataagttgggtattgcaaaaagtttttcatcttagtatcagacatgtgatgttgatttttttatgatttgaaaatgctgtaggccataactacattgggtctgaacacttgcttttgggtcttcttcgtgagggtgagggggtagctgctcgtgtattggaaaacttgggtgctgatcctagtaacatccgtacacaggtgaatacaacgaatttttctgattctttttggttctgaagtttgtgctacccatactagcgcattaatatgggatattctttgcttgggatttataggttattcgtatggtgggtgaaaacacagaagctgtgggtgctggtgttggagggggtactacagggaataaaatgccaaccttggaggaatatggaacaaatctgacaaaattggcagaagaggtaggtcttgaacttttgtctttgcataccaaatctttttttgacttttgagtagaaacatgtataatgctctgtcattagttttcacttataagcattgagctgaattgatttttgtaaactccagggaaaattagatcctgttgttggccgacagccgcagatagagcgtgttacccaaattctgggtaggcgaacaaaaaataacccttgtcttattggagagcctggtgttggaaaaacagcaattgcagagggccttgctcaaagaatagtcaacggttatgttccagaaacaattgtaggaaagaaggtatgacatttttgcatcactcaaaacctatgaaagaacagtggtatgttagtacatgtttaattgtttgatgcagcttgaatcttgactcatcattgatatttagattctgttgcagaatcagtttatgtttgaagctgggttttgtttcaccaactccccccccccacacacacaaggattgaggaaaactagaagcatgctgtgatacctttgtttttaatggtacaaaattgtttttttggatgtatgaactttttgaggggaataatgtctgaatgtagtagatggaatcatggaaacttgtgaagttatataattttttgagtgattctctgaatgcaataggtgaaaagagtgatctgtatcatttgcactcacgacgtgctttgttcaattcacaattttgaccttagatctgtaggaaactagaatcttgtgaacttttttatgttgcttattgaagcagcggtacttgtttccaatttatgtcaaatttgtgagcccaactccatatgttttttatatgcatgattgaatttgacgattaagtggctggaaattagaacctttaaccatcaatatatgtaatttaaaatgcatgtctagtaaagtttgcttttattcatgatttgcattccccatattttccgctgatcatgttaaaaacggttaacttattgtttctcaaaaatgatcttaggttattactcttgatatgggtctattggttgcgggaacgaaataccgtggagaatttgaggaaagattgaagaagttaatggaggaaattaagcagagtgacgagattattttgtttattgatgaagtacatactctaattggggccggagcagcagaaggtgccatcgacgctgcaaacattttaaaaccggctcttgctaggggtgaactgcaggtatattaagacttttaattgaaaagaacgtttggttttcatattgtaattgctcacagaatctttatgcatgcacaaatatgcagaagttatggaatcataacttgttttttgtggttgcttgtagtgcattggtgccaccacccttgatgaatacagaaaacatattgagaaagatccagctcttgagagaaggtttcaacctgtcaaagtgcctgagccaaccgtagatgaaactatacaaattttgaaagggcttcgtgagcgttatgagattcatcacaaacttcgttacacagatgaagcacttgtggctgcagctcaactttcttaccagtatatcaggtttgtcttttggtgtttctactatgaacattgattatcatggtggttctgatatgtatagctgttttttcttttgagtctcgtcattaaactagccatatacacagaaggtaaagaacatatcataacgcatttcattatcccaatgccgctatattattccacttaggctcccacccaggcagggtacgatgggtcagatcatcagatgtgctcaactttgtccttgtaaaaacatgaagttgtttctgtttgaccgtttagagaataatcatgtgcaaattcacaaaattaagaattgcacatgatttaacactattatattataatttgcaaatattgaactacatatctctggcttcatcaattatgtaaataagaaggtagagttggtgaaaaattcctgcttgttttaacttcttcttttgctgaacaacatttaggttggaatttgccgaatttataatagaatggttagaaagaatttagatagaagcaagatagaaaaagagagagctaggaaggccgaaaggagttgaaaggagttgagatgataaaaaaattgaatggaacaaaaagagaattaatgtcgatgaccattaggactgatatattggttcatgtgattgacccaaattttttgagattaaggttttggcattattgtataatagaaaagtttcttcagataaaattatcttattgctttcacatgcatgcttttgtggcacaaagtatttgtttgggtctttctctattatatgaagtattgttataaatccttaaattacttcgaatatctttatgattttcatatccatcagatataaggttgaataccatttactgctttgttttgaaagttttagtactagagttgaagcttctgaaattgacaaactaatatttcaaagatgcagtgttactttcctttatttgaagaatgactgtttcctttaaaacacttaggccttatagcttcacagtgtttgggtgtattagttgtttgtgaactcatgttgctcaatatgttgcagcgatcgtttcctacccgataaagctattgatcttgttgatgaagctggctccagggttcgattgcgccatgctcaggtagaaatttttgtcataacttcgatccacctttttcatggacattcttgatatctctgcttttgttttctgcagctccctgaagaagctagagagcttgagaaagaacttaggcagctcacgaaagagaagaatgaagctgttcggggccaagattttgaaaaggtatactattttgattttcctattgataattgatgcagaaggttcatttgggtctttttggttcctttcggttgtatagaatataattagaatattacatgtctgtggaaccagtattggaagtggaaataccggaaatctcaacagtttaaacggctgagtgctgatgtgttattattataatatgtcgtggtgtatctcgtgtatactacttttttgtagtattactatattttaaatgaaaaatggagaatctgaatcaattttttcttcacaattttattccaagtaaatactgctgatgtgttattatgataatatacccttgtcctgcctaatcatatttttttctttcacaatttttttgatttaaatttttttattacaaaatttcttccatcctataacactcgagaaggtgataaaatggaaaattgtggaaaaaataatgtgatcgaggatgagagcttcattatcttgggagtgagaatacatttcttgaatattagcatttaattaattccaattaccaatatttaatactaaatggcattggggcaatgaaaccgctatgtaatactaacaaccagtcaccagaatgtcgtcaacattactatctgaatatgatgtttgctattgaaatctcaaaattctggactccattttttcctgcactaccatttatgtgtacttgttgatcatgtgcaatcgcatgtgcaggctggtgagttgcgtgacagagaaatggaccttaaggctcaaattactgctcttatagaaaagaacaaggaaatgagcaaggcagaaacagaagctggggatgtcggtcctatagtcaccgaatcagacattcagcacattgtgtcttcctggactggtattccagttgagaaagtgtctaccgatgaatctgaccgtctgcttaaaatggaggaaactcttcatactagagttattggacaagatgaagctgttaaagccattagtcgtgccatccgtagagctcgtgtaggtcttaagaatcccaaccgtccgattgctagcttcattttctcgggtcctactggtgttggaaagtcagaacttgcaaaatctctggctgcttactactttgggtctgaagaagccatgatacgacttgatatgagtgagttcatggaaaggcacactgtatctaagcttattggttcaccccccggttacgtggggtacactgagggtggccagcttaccgaggcagttagacgccgcccttacacagtggtgctttttgacgaaattgagaaagctcatcctgatgtcttcaacatgatgcttcaaattctcgaagatggaaggttgaccgacagcaagggaaggaccgttgatttcaaaaacacgctacttattatgacatcaaatgttggaagcagtgtcatcgagaaaggtggtcgtagaatcggatttgaccttgactatgacgagaaggatagcagttacaaccgtattaagagccttgtgaccgaagaactcaagcagtacttcaggcccgagttcttgaacagactggatgaaatgatcgttttcaggcagctcacaaagctcgaggtcaaggaaattgccgatattatgttgaaggaagtgttcgagaggttgaagaacaaggaaatcgagcttcaagtaaccgagaggttcagagatagggttgtggaggaagggtacaatccaagttacggtgctaggcctttaagaagagccattatgaggcttttagaagacagcatggccgagaaaatgcttgcaggggaaatcaaagacggtgattcagttatcgtggatgtcgattctgacggaaatgtcattgttctcaatggtagcagtggcgcacctccggaaactttgccagagcctatttccgtttagacgagaacacgctttgtgatggttcgatttctatagtatgtttgttgtagtttttacttcggatttactacagaattcccatatagatatggcctttgttacaaatgtagaaattatttgccgtggccattgtgacattgattgcaacttatttggaaagttgtagcattaattctctccggtaagtagggaaacttttggttttggtagcaatttttaggaatttcataatactaaaaggatgaacaaattcttatttttgttgtcttatttctttatgcttagttttgtatgtgccatgtagctttggagaagtacaagtcatggtggtggttatggttctgatgatgatgatgatggttatggttgattggttatgcttatggctaggggtgttcagg

SEQ ID NO: 1597 - DNA, 1353 bp, Amaranthus palmeri
caaagaagagattgacagagtcaatctggagatggaagctgctgaacgtgagtacaacctcagtcgtgctgcggagctcaaatatggaaccttgatgtctcttcaacgccagttggaagaggctgaaaagaacctggctgaatatcgggaatccggtaaatctttacttcgagaagaagtcacagatgtagatattgctgaagttgttagcaaatggacgggtatacccttgtctaaccttcaacaatccgagagagataagctggtgtatttggaagaggttcttcacaaacgagttatcggacaggatatggcagtcaaatcagtggctgatgcgattcggcgctcaagggctgggctgtccgaccccaatcgacctatagcaagttttatgtttatgggtccgactggtgtagggaagactgagctcgcaaaagccttggctggttacctgttcaacaccgaaaatgctcttgttcgtatagatatgagcgagtacatggaaaaacatgcagtatcaaggctggttggtgcaccccctggctatgtcgggtacgaggaaggagggcaactcacggaagtggtacgacggagaccttactctgtagtgctatttgatgaaatcgagaaagctcaccacgacgtcttcaatatattgttgcaactattggatgatgggcgtataactgactctcagggtagaaccgtcagttttactaattgtgtggtaattatgacatctaacattgggtcccatcatatcttggaaactttgaggagtacaaaggacagtaaagatgcaatttatgagacgatgaagaggcaggttgtagagtcggcaagacaaacattccgtccagaattcatgaataggattgacgaatatatcgttttccagcctcttgattccagagaaatcaccagaattgttgagttacagatgaatcgagtgaaagacaggctgaagcaaaggaagattgatcttcatttcacaaaagaagctgttagcctacttggaactctaggctttgaccccaactacggagctcgaccagtcaagcgagttatccaacagatggtcgagaacgaagtcgcaatgggagttctgaggggagactatgccgaagacgactctgtcatcgttgatgtagacacgtcatcgtctgacaaagatctaaacaagctagtcatcagaaaactcgagaatagcccagaaaatttaatggtagcaaacgactaatatagaattatccgtgatatataccactcaccatataccgaactgtaaatgaaaaaaatgttcaatttcatcgccttttgcatcgatttgaggttagttaccatattcttgta

SEQ ID NO: 1598 - DNA, 7788 bp, Amaranthus palmeri
acaaaatttcaaagtaacactattagattccttacctcatttgtattgatttcctttccctttccattacaattactataccaaacacccccttagtgttagcattttgcattatgtttaaaagcatcaccccttagagattcattgtgctttctcttgctgttcttgcccttcatttggtgtgatcttacgatgcctataagtatatcatgttatttttctggacaaccaatgtactatttttatgtagtgtaattcttggaggaggggagatatagatgtcaaacgcattgtaagttagcgatagtatgattggcgtttattattatgtttgcattgccttttcgtagctattcttcactttgattttgttccttctccctcattggtcaggctgattctagttcgtggtatctttttccaaatctgtacattaaactgtggtctagtgttatttggatctctttaatttgcttttcggtcgcagaacacttcctctaaaaagagctggttaacttatgtccaaatcttttatttaggaatttgggatggtctcatcctctaatttggttattctctaatgtttactgttgtcagatcaatcaaacagagtatactgagagggcatgggagggaattgttggggctgttgaagctgcacgactgagcaaacaacagattgttgagactgaacatctgataaaggcccttttagagcaaaaagatggtttggctcgtaaaattttaacaaaagccgggttggacaactcttcagtgttgcaagccatagaagactatatttccaagcaacccaaggtatgctaacatgaacttcatattatactattcatcaatcaatattatttcacttattcttcatgtttgagaaaaatagtcaattggaatcatgtttggtttgtcttaatgcatatttttatagtattaacttatagttttaattaactatgcgtaactacagatattgaggctcaaaataatgtatttgatagtatgaacatatgaaatgtagcaactacataaattttatgtggtcaattactttgaatatcgcaggttagtgacactagtgggcctattcttggaccaaatctcggttccctcttggacagagccaaaaaacacaagaatgaaatgcaagatgattttgtatccgtagagcatcttgtcttggcttttcattcagattcaaggcttgggaagcaattgtttcgtgattttaacctcactgagaaggatttgaaggacgccattcaagctattcgtggaagtcaaagagtaacagatcaaagtatgttttacggttatagtttgtaataggtagccattttctgtgattactattttattaatgtaagtgacctttatgttgtgcatttattatcatgtagagacatcttttagtgtgtatgtgtagaagttagggttctgtcctcattttattttttacaccccaaactcatcgatcgttagtcctagttggaacttttaatttggagcttgtcactctatgtttgtcctttttcaagttggtcaaccattgttggttgggttataaaaatacttactttagggagttttaggttcttaactttttatctgggtgatatgcactcgtaagaaatgtatggatttgtcacccacaaatgtgtaggaaaagtagcctatttgaagtgaaacgcatgtagcggtgttaaccaattaatgctaccttattcatgtgtgatttagaattttttcattcatttcctttttatgagaaaacttacgtaatcttgtgcttatgttgaactcatcgtgaagttttttatgttgtgactagagtctattggcatcgacatagtttcaacaggcttcttttgttgactttctagtctataatgaattattgttttcctatactttccctctttgcatttgaaagctatttacttttctgtactagctgtatgtggaaataaaaatgtgcttactccttcgtcccttgaatttgctaaaattttcatttttattttgttccatctaatttgcatacatttcatgatttcgaaaatgaccctacactttacttcatccacacatttaaccttgtttttttttatttcatcaacatatttcaaatattcatatcctacctaaacctatggaataacttaattagtacttgttgcatactcaatggagatagaggaatattactttggctttttgaccaccgttttctcatgtgtaaggcaatttatataattatattcattgggtgcagatccagaaggaaagtatgaagcactagaaaagtatggaagtgacctaactgaattagccaggcgtggtaaactcgatcctgttattgggagagatgacgaaattcgccgttgtatccaaattttatcaagaagaacgaaaaacaaccctgtaatcattggtgaacctggagttggtaaaactgcaatagcagaagggtaagccataaaatctttttgtgacctctatatctcttgcattatgctttcttccttttagtatagggtccttactttattttaattatgttggttttaattgtaaatttgtagttcaaggagtgagaataaaattactattaaaatgtttgattcaatggaccatgaaggctgatttttaatgaagtgtactttattccggtagcctatcttcacaaaacttggtttccttcatcatctattcaaaaccattggaacgtagttgtgattttttttgatttgttttttgattatttattgacacaaatctatgcacttcttttcttcatgttaagttgctaatgatgtttgctacgaagggtcttggtaaccacctctttgctatcaataatgaggataacattgtgtacatccgacccccaaaccccactaggtgggagccaacttaatgacattgggataatggaatgttgttgatttcaattactaacttcaatttttttttgttttcaattgtctcctttttgtgtgtcaatattataatattctttctcaatattgtaattaagaaaatttaacattagattcgtcaagtttacacgtgtggaaatctgaaagaaaattaggtctgctcaatcgaactttcgacccattttccatattttaccaatttttttactttctatcttccttgtcatcactttattcagacttctttctagttgatttttgtatgcatcaatatttctttgttgcagccttaaaaataatgtattggtttattttcatgttgaaaaaaaatataaaaacaaaagttgtttataatatatattcaggaaaatgtttagtaacgagaagaaacttttaaaatcatgagtcgttgggttgaccctaactcgatatcgagaactattcaatccgaaaagggcattttttgaactagacccaaccaacttgaatatgactcgatttgaaatccacataccctattgtttttacaagtctacttaaaatctatattgatgaaatattgctccgtgctggttgcagccagattaggccttataggatatgatgtgcgtcgattcttctcgtgaatgtttgtttgatagattggcacacttagtgattccgatgctccttcttgatccatggtaattagtcaaacgatgtgattaagcagtttgtgttatgttgcaggttagcgcagcgtattatacgtggtgatgtccccgaaccattgatgaatcgaaaggtgtgtctttaactgggagtgatattagtctaaaatttttttcttaaagggtgattaattttctagtttatgtggccaatgatttatagttctttgatttcggatatcatgaactatattaaaatgactcattaacttatgtgctcttataataatgtgccgatgatatttactgccaaggctcaatcgaagataacttctttgttataattaacaagggtacggttaatgtaaatctctatgacccatttaaccagcctaggtgggagacacttaatgacattgggatgatgacattgttgtagattgattatctagtcagtcttgttctactaatagattggcttcaaatagtgttttggtctgtgggtaactgtttgtagagaaggaaacaataattccggcagttattacttcaattttcgttttgatgctctaatgtgaattgtttccttcccttgcagctgatttcactggacatgggtgcactgcttgctggggctaaatttcgtggcgatttcgaggagaggcttaaagctgtattaaaggaagtcagtgcttctaatggccaaataattctgttcatagatgagattcatacggtggtgggagcaggtttgcttcttgtctgctcaataacataaaatgcaatgaagttgctgggttgtaaatggttttcggaaagtatgataccaatattctctattttatttttccacaacttatctgcaggggcaactggtggtgctatggatgctggcaacttactaaagccaatgcttggtcggggagagctccgttgtattggtgcgacaacattgaatgagtatagaaaatacatcgaaaaggatcctgctcttgagcggcgatttcagcaagtgttctgtgggcaaccatctgttgaggacacaatatccattcttcgtgggttgcgtgaacgctatgagttgcatcatggtgtgaagatatccgatggggctctagtatccgcggctgttctttctgatcgctacatcactggaaggtttttgcctgataagggttagtattagtacttgataagcttttgaactttatctttctgttctttagttatgatctttatctttgttttttttttcagccattgatcttgtcgatgaagctgctgcaaaattgaaaatggagatcacttctaagcctacagagctagatgagatatatagagcggtgctaaaattagagatggagaaactatcgttgaaaaatgacactgataaggcatccaaagagcggcttcaaaagttggagagtgatctcaaattactgaaagagaaacaaaaggagctgaacgagcaatgggaaagtgagaaggttctgatgaatcgtattcgctcgatcaaagaagaggtaactttgcttgtattctggatttctaaatggaaaaattgatatagtaatccaacattttacccatttgctatgaataatcccgactttggatttattttttaataaatcaatcgtttcccttagtttattatcagcatactaatagggtatgctgatagcaaactaagggtaaacgtcgaattattataaagtaaaatgttattctgatagcaaactaaggacaaaagttgaattattaacaaatagtccatatgtgggattattcacagtggatgagtgaaaggttggattattattatcaattttcctttaaaaattcagtaattattgttatcatcttgttctttgatcctgatgttgtaactcgtaaccaaattgtcccctttcagattgacagagtcaatctggagatggaagctgctgaacgtgagtacaacctcagtcgtgctgcggagctcaaatatggaaccttgatgtctcttcaacgccagttggaagaggctgaaaagaacctggctgaatatcgggaatccggtaaatctttacttcgagaagaagtcacagatgtagatattgctgaagttgttagcaaatggacgggtatacccttgtctaaccttcaacaatccgagagagataagctggtgtatttggaagaggttcttcacaaacgagttatcggacaggatatggcagtcaaatcagtggctgatgcgattcggcgctcaagggctgggctgtccgaccccaatcgacctatagcaagttttatgtttatgggtccgactggtgtagggaagactgagctcgcaaaagccttggctggttacctgttcaacaccgaaaatgctcttgttcgtatagatatgagcgagtacatggaaaaacatgcagtatcaaggctggttggtgcaccccctggctatgtcgggtacgaggaaggagggcagctcacggaagtggtacgacggagaccttactctgtagtgctttttgatgaaatcgagaaagctcaccacgacgtcttcaatatattgttgcaactattggatgatgggcgtataactgactctcagggtagaaccgtcagttttactaattgtgtggtaattatgacatctaacattgggtcccatcatatcttggaaactttgaggagtacaaaggacagtaaagatgcaatttatgagacgatgaagaggcaggttgtagagtcggcaagacaaacattccgtccagaattcatgaataggattgacgaatatatcgttttccagcctcttgattccagagaaatcaccagaattgttgagttacaggtaaacaaaagaagcttgcagccttgtgtcattgtgtgtttcaattatatcattctccaatcatctagggcaaagttgtgttttaagtttttgctgcagtgttagtcctctaggtcctaaccaatgattgttttaggctatgttatttggactcgggtattgatgtcggaaactagtacgtgcccaattttcggatacgttgaaatattcaattttacgcctaaaatgaagagtctaagtgccatacctatgtccgagcatcaaagatcggacacaggtacgtgaagcaaaatcaagagtccgagtaacataggttttaggtgtcagtagaggtgtacattcgggtgttcagtatagttttaaatctagtatgatatgctgggtcgggttaattttagttcttgtatgcatgtaaatgtcttgacaaattttattttgatttgatttttatatgcgggttattacgagtcaagtcgagtcatattcggttttggttaatcgggtcaattttggacaactctatgtgtatgctgtaatagatttcgttagacctgggttcagatgactagtgaaaactctgcatcccctaacggaactttaaattactaacaaggtttggaaggatggcataaattgattatgaatcgaccttattctggcagagcaatatgactacgctctattactacataattttgcttgatttttgccctcattgttcggaagttcctatttcttaattgacggtatatcattttgccgactttttcaaaaaattaacaacataaactccaattttgatgcagatgaatcgagtgaaagacaggctgaagcaaaggaagattgatcttcatttcacaaaagaagctgttagcctacttggaactctaggctttgaccccaactacggagctcgaccagtcaagcgagttatccaacagatggtcgagaacgaagtcgcaatgggagttctgaggggagactatgccgaagacgactctgtcatcgttgatgtagacacgtcatcgtctgacaaagatctaaacaagctagtcatcagaaaactcgagaatagcccagaaaatttaatggtagcaaacgactaacatagaagtgtccgtgaataaatatcactcaccatataccgaactgtaaattgtaaaaatgttcaatttcatcgccttttgcatcgatttgaggctatttactatattcttgtaatttccgtaggtctcccctactcaataaaggcgtgagttgaattctcagctcgtggatttgattctgtctcgcgttgaatgcaattgtaccgttgttgtcctggggtggggaatggttgcaa

SEQ ID NO: 1599 - DNA, 7491 bp, Amaranthus palmeri
cctttctttcctctactggctgcttgccttctttaaataagactcatctcaagtaaataacttattcccattttgtgccccctaactgacaagtgactgctgcaatattacttctttcagccacgtctagtatgtatgaagttattacttttgctctcaccttaagccttgatcagttcataacaaatcattcttggtgttccagtgttttatcagtgacatttgtaactcatagatgatatgcaatatgatttctctcgaaaggatttaatgctacaaaattgtcaaagggcaattgtgctttgctggctatttacaaagattataatgaattttgctattctatatgagaaaatgaaacttatccattttttatacaggtgccacaaatggtgcaatggatgccggtaatcttttgaaacctatgcttggccgtggagagttgcgatgtattggtgctactacactcgatgaatatcgtaaatacattgagaaggatccagcgttggagagacgtttccaacaggtttatgttgaccaaccaagtgttgaagatactgtctcaatacttcgtgggttacgtgagagatatgagttgcatcacggagttagaatatcggatagtgcccttgtggaggctgccatactttcagatcgctacattagtgcacgttttttacctgacaaaggtaagtagagtaacacatataattggagaagtatgatattactgaattatatatgtgatcattatgcttattgcactcgttactagctgttcattagctagtttacattttgtgatgaactttacgctgttaaggctattgaagtaacttgaagctatacattgtgcagactctttcaggtcgataacataaatctctctggattaaattgtatagtgctatgttaggcagactagacagtaacgttttccatattggtgcacatgataatgtgttcccaaagaaatttcactaggagacttaagtcgttaaactatatacacactctcctttaggatgagcaaatatgtattcgagctactgtagctgcaagggcttgtattcttcacatcagtcttgagtctcaaaattttcgagtgctcctgcattgaaataggttgatgaaaacaccattacttgtataattttgcggtattgaagattagatgatacattatagtttatagttaggattgttgctcgttgagccattaaaatcattaatttgatcgagtttttgttactaatttatggttttgccacttaagagacataactgtagtcaatagattttgaggttttagttaaaaattttcttaaatgtttttatgagaccacaaaacgatagaattaaaggcaaagcagcattgcaagccttcagaactgttattacatagcttttcacattatctatgttttcatgattgtagtatatatatgagatatcagatgactctaattaaaggcgaagatgtagtgtaagcattgaaaactacaatcactaaattcctcacattatcaaagcccatggaagtgttcctgtggcttttttgcagctctaagttttcagttatagaataatatctttaaaaggaattgatttacatattttttttcgagatattttgacactcctttcctagatttcacaagtaattaggtgctttattgccttttactttactgtacttatatgagctcttgaagctcatgtaaaaaagtaagttgagaaaaagaggtatgaaatccagttgaccttcgtgactccgtctttcttaaaacttggacatagtgatttgtactgtgaatccagtgataaattgaaaacaactttacatttgtgttgggggaagtttgaaatacggtagtggcaaaaacccagagaaacaaggatgggtatttcagtgttaagagcatgcaacatttgatggtgccagattaggttgtcctcttcaatgggtacagcagttaggtgtttcttgatgttggaataaatcatatgattggaaataaattttacaaactgtaagcgggaaaaaaaaaattaaaattgatcttatcttttatcctttctgtagcgaggatctggtaatcgttgacattcagagctgtcaattgccaaaatattgagccttgcgtgtcttggtaacatttttcttgctgagatggtgttttctactgcagccattgacttagttgatgaagctgccgctaaactaaagatggagataacatcaaaacccattgcccttgatgagattaaccggtctgtactgaagcttgagatggaaagactctcacttacaaatgatactgacaaagcatcaaaagagagacttaatcggcttgatacagagctttcccttttgaaggaaaagcaagccgaattgactgagcagtgggagcatgagaaaagtgtgatgacacgtttacagtccatcaaagaggaggtatatgatttttagcttgtgggaaattccaataatttatggttgttttctcaatatatgtttgtttattgctgtacatttgattttttttacgttgtgcagttgtgccaagtctggtacagttgcaattaccagactgatggttttgaatatattctttatgattatatcattgtctttcgtgtaatcttagttaacattccaatcaattagcttagagtaagaatttgacttgattggttttcgattcagattgacagggtgaatattgagatccagcaggcagagcgagagtacgatcttaatcgtgctgctgaacttaaatatggcagcctgaactctctgcaacgacaattggaaagtgcagaaaaagagttagatgagtacatgaaatctgggaagtctatgttacgtgaagaagtgactgggagcgatattgctgaaatagtcagcaagtggacaggaattcctgtttcgaagctacaacaatcagaaagagaaaaactattgcatttggatgaagagctacataaacgtgtagtgggccaagatcctgcagttagggctgtagctgaggctattcaacgttctagagctgggctttcggatccacatcgtcctattgctagtttcatgttcatgggccccacaggtgtgggaaagacagaactggcaaaggccttggcagcttacctgttcgacaccgaggaggcccttgttcgaattgatatgagtgaatacatggagaaatttgctgtttcaagactgataggtgctccacctggttatgtgggatatgaggagggaggccaattaacagaaatagtgagaaggaggccgtatgcagtgatcttatttgatgagatagagaaggcccataccgatgtttttaacgttttccttcaaattttagatgatggtagggtgacagactcacagggccgaacggtgagcttcaccaattctgtcatcattatgacttcaaatgtcgggtcacaatatattttaaatgctgacgatgaggctttatccaaggagaatagatatgaaattataaagcaaagagtgatggatgcagccagatcaatcttccgtcctgagttcatgaacagagttgatgaatacattgtcttccagcctcttgatcgtgaacagattagcagcatcgtgcaattacaggtttgtcttaaaatccttgtgaattctgcaaaacagcgtacagaatcagtttgatgtttgctaaacttgttaattgttttatccagctacaaagagttcagtccaggattgcagatcgtaagatgaagattcaagtgacgaatactgcagttcagcttcttggtagccttggatatgatcccaactatggtgctaggcctgttaagcgtgtaatacagcagcatcttgaaaatgagattgcaaaaggcatcttgaggggcgattataaggaagatgataccattcttgttgacacagaagtcacagcattttcaaatggccagcttccacagcagaagctggtattccgaaaactggagcctgaattcgatccggctgctggagaagacaaacaaattgtttctccgttttagatttaatttttaaaatttttcataccacatttttatctcgaatatgatgatcgatctcatgttactgtaaaccgtctataggattacgagtctggtatataatggttgtatagtagcctctctcttacactattttgaaagattttgtgcacagaaagcataatctattcataaaaagcctattgtgcttgggccttaggggattccgatccgggttcaatgaaggaggagtttgagtgaacacccatctttggttcctcaattcaagttattagagctttgaatctccatcttcaacagcaatcgaaaacgaagaactgcattatctaaataactgattattcgcaatgttgcttttgatttgactttacgttatacaaatcgatgtacccaattttgttgaaaaccatttaaaggcgaagaaagaataaacatttatccatgatgaaattgattccagggaactgagagatgagtttgatgcagaaggttgttcattgaatgccaatctggatcaacttcctagtctggattttgatactgggggtgaatggtgatattgttctaaataactgggcttatattaagactgatcaatcaacacttacaacttacaagtgacagacagattccagtacgtaagagtctagatcaacgctcagcttgatcgacggtttctttcttaagtctgcacactaccacgcagtttatgaatggaaccctgttcattccagtttctgacaaggataaagacacacggttaaaacgtgcaacatcgcttttgggtaatcatcgccaatttttgttgatcttagcttatatctaattattttttttttattattctcttatccctaatttctaataatgttggacatttgaaagatgttgcacgtcgcttttgggtactaaccactgccctagtgcgccgatataacgatgtataaactcttgtttacttatcacagctagtgctttatcactacatctagtgcatcaggtttattgactccggttccatgtcatatcattgcgataatgtttagctactctagtgagagaccatctttatattctcataattattactatttagggtaataaaactcatgtatgaagcgcttatcacagtgtgatcaactcatatcctattctttttcattactcagatttgtgattagaatttagaactaaacacgctatatttgcctctctttgccagcttaaaacattattaacttattaacatcacaaaattactactaataattaggtcatgtgttattttttaaccattccacaagattttgatacatttcttatccaaacgtcatacaatcgaggttttaaagtgtcgttagaagagcaaaaaaaatagacttttataagggaaaagaaggctgctacaacattctcaaacaacacaatccaaatttaagatcagaggatagggaaaacaccccagctcatgatggagaagccattattcatcttcaagcgatgcatgatacacataaacacatacattttgtatgatgtactataacacagtggtatcgccaatctataaagtttctgaagtcgagaaatacaattttggttcagtatgtttatgcaacccattcaatgttcaaaaatggaagtttgagcaactcactatgctttcctaaactttcagattctggctactgctgagcgtcttccacgctcttccgcattaattgaataacatgagcaggttctggggcaccgaacactgaacttccagcaacaatacagtttgcgccagctgaagcagcagcgtcaatagtagacggccccaaaccaccatcgacctgcacaaggaaaaaatgataatattcagaaagttattgtatttctcagcaaaacagaattcgatgattgatcaacaaaactagttctcaacaaacacggtgtttcacaatgactaggcccttgttagcaacagaagttttgggcaaaaaacagtttgagaattggaggattttaaaatcaacccctttaaagaaaatatttggaaatagtggattgtagagctgattgatatagtatataaaaagtataaaacctcttgaatagaaaatgttctcaactaactttctcaattggataatagtggatccaattttcaagagattactttaacaaatcaagcataattttcagagcttgtggggctactagcttaagcaaactgctagctggttgtcatgtaatggacactatcttggcaaagtaggttgcttttcttttaactgatcactattcaataaagatgtatagtttgctttgtgttgcaaagcaaaatgtgagatgggcagctgaagttttaaaataagacctccaccttaagcgcaggttcgctttgtggcttcctgtcctggctccggcagaggctgaaaagcgtgccaggttgtatccatggggtataaaccctgatgccttcagccccttctgcagaaaagctaatgaaacaatgtgcaacctctatgctttttcagcagtgaatgtcaagaggcagtactgttttggcttggaaaatccgcctttcacggttccataaagggcttactcgagatgcagacgtgatgttggctctagatgttgaaggaaagttatgttaacagctgttgctagccttatgcactggtttggcaaacgagaaatgaagcagtgtggaataacttagggagtctcaggtttgtcattagacaggtcagaaatgaggcaagggtttaggaagaatattaatataccaactattgattaatcatgaataatacaacctttaagggttttctggcatcctttgacttatcggtaactttaaattgtaggtcaactgtcaaaaaacggaaaaaaaatccctcacctccctccaccaccaaagccccacctaccctcccactgtcgggctgtcggcccattatttccagcgacccaccaccatggaatacccccaccccctacccacacccggaaacatagtcatcatactaatgctgctgttgtggaagcagctggtacggcatccactgaccatgttgtggaacattcaagtgtcgtccaacattcggatcaacattcttggcttcaagtccattcccatttccaccaccacctatgacatcaataacaaccccgacttcaaccaataattcctgcaatgtcatcttgtgtattttgcctctcataattcctcttgaatagtctcaccattttccggaataaagtacatcaagagtagacctgggaaaacggtcggtcggtcgggttacgggtcgggtcactttcggtcgggtcattttcgggtcgggtcattctcgggtcgggtcattttcggatcgggtcactctcggttccgggtcggtcggtttaacccaacgggttatgacttatgaaaattttaaaaatgatttt

SEQ ID NO: 1600 - DNA, 11313 bp, Amaranthus palmeri
aggttacaggttcgaatatcaaccacccctcatttaaagtggaaaatttagcgtcatgtatgaggagggcatgtgctgcatccacacttttagcccaaagagctatcgtgtgagggggcgtgttagagtatataacatatcctggggcctcaaccatcagcttaagcttttggttgagatggttccttatcagtagaaaagaacaaggaaatgagtaaggcaaaaactgaagttggggatgtcggcgctatcgtcacaaaatcagatattcagcacattgtgtcttcctggactggtattccagttgagaaagtatctactgatgagtctgacagacttctcaaaatggaggacactctccatacaagagttaggacaagatgaagctgttaaagccattagtcgtgccatccgtcgtgctcgtgtaggccttaagaaccccaatcgtcccattgcaagcttcattttctcaggtccaaccggtgttggaaagtctgaacttgcaaaatctttggctgcgttctacttttggatctgaagaagccgtgatacgacttgatatgagtgagttcatggaaaggcacactgtgtcaaagcttattggttcacctccaggttatgtgggttacaccgagggtggccagcttaccgagtcgcccttacacggtggtactttttgatgaaattgagaaagctcatcctgatgtcttcaacatgatgcttcaaattcttgaagatggaaggctgaccgccagcaagggaaggaccgttgatttcaaaaacacgcttcttgttatgacctcaaacgttggtagcagtgtcatcgagaaagatcgagaaaggtggtcgtagaatcgggtttgacctcgactatgacgagaaagatagcagctacaaccgaattaagagcctagtgaccgaagaactcaagcactactttaggcccgagttcttaaacagattagatgagatgatcgtgttccggcaactcacaaagctcaaggtcaaggaaattgccgatatcatgttgaaggaggtattcgagaggttgaaaaacaaagatatagaacttcaagttaccgaaaggttcagagatagggttgtcgaggaaggttacaacccaagttatggtgctaggcctttgagaagagccatcatgcggcctctcaaggacacatggccgagaaattgcttgccggggaaatcaaagacggtgattcagtaatcgttgatgtcaattctgacggaaatgttattgttctcaatggtagcagcggtgcagctcctgagagccttctcgagcctatcactgtttagaacacttgtatgcttcatgacattgaatgttcaaaagactagataggtttgctattaacaacgaatcttcgctataatcaaaagcgaacaaaacctttaacacaagcttagatgcaaagatgcttattttgaaaataagtttttcccaaatacttatttatacttggtatcaagtatcaactatcaatattggatttagagtatatacaatatcattcaacaaaaagccgattcgtttgacaaatctacaacaagggaaatactaaacatcccaaacttggtaaatagattacatcgatctcttgctcgtgttacatcaatgctcaaattggtggcgccaagtggacatgacgaccagatattcacattctcatgttacagcttcgtacatttttataaatagaaataaaaacctaaattttcccccaaataagggcatggtacaaacgttaatgcacatttgccagctagttatacaagacgcgaattgtgctaatccaacatcgaaggcgactctctctgcgttggactaacgctacctcctcggctgatcttgaaagcacttattgccttttgtatttccattgtcattgcactgtctacactacctgatgatagctttttatgagatttttgcaaatgaagtttcagtgagctactactcaatccaacattcttcccacaaatagggcaagctttcatggtcggtttcctctgttgccactccatcgaaaccttcccatgcagcgttttgtcaagatcttgtaaaattttagcaaacccgtcatttggctgggctcgacggtgaactttcttcagcatattccaagcctccaacaaagtatgcttcctgtaacaccaacagattctttatatttccccttctgataatttggatcaaattttcttgttataacccactaattttctattgaatttctggtcgggtaataagttgacaggtctagtgcagagtgtaactatcacatcgaataaacagaagaaattacatctggactacatggctcttcgataagttaagaatgtcgatccgccaaccttttcagagtcgagctcagtagggttagcactagcagtccctgacatgatctaacaacccaatccacagtaagtgagagaagtctgacctaaactgaactagagaacccgaaatctccctgattttccggctggcccacttttcaaatatttcagatatatcatattatcttaaatatattttgagcacagctcgaaattgacacatcaaatttgtttccgcttagttgtgaatcatatatctgttaattataaattatatattaataaagcgcaaggctactcgacttacttccttagcatgagataagcaagaacagttgttgcactcctacttcttccttcaaagcaatgaaccaaaactttcccacttgctctctcaacattgtcgatgaagtcacaggcttccgtgaaaatactactgatgtttgaatcttcctcgtcactaatctgtgcaataagtaatgcaacatgataaaacgagattcagaagaaaattcactgttaattcgtacagcatcaaacatggtcatacatgatttcttttttaatcaactaagcagggacttttcagaaaacatccagaacaatcatatcttttcaggttcaaaaaataatagaagtataaaaactgataactgatttcacatgtttaatcatttagctataagcttctagtagactaagacttaagaacaatgctagtcttggagagtcttgtaagtccaagactagcaatggtgaagtaaaaaaaaaatttgagttttaaagtgagtcttgaaaaatgaaggctcatcccaagacttaaagggacaatgtcatcaattattttccttcgtctaatcaataacatgctaactcacgttggaataaagttgaaagtgactttgaagctagtttgaggataatgtgtagggaaaattagagaattaatacttattttgaaagacttgtaagatacgcgcttcataaaagttattttgtttattaaagttgtaacgatagataaaaatgactttaaatatctaatcatttcctcataaaaaatatctttacaattttcatggtggaaagatatacaaataactaagtacttatttcgacttataagatacacgttttataatttagggtagtgatattccttttctgaaaattcattcaaatgtgcaaattgtttttataaattatattgatttgcttactgaatgaagaatttaaaactcatttaactgatttaacaagatatacgtattcaattaagatgattatgacgtcctctttttaaagaaaaataattacgatggatataaagacgctaaatgtgtattttttgagatctattgagggttcaagtgatatactcaatatgttgagatactttgaaaactacaaatttatttgaaatgaattctaacattgagattaactcaaaaaaaaaaattctaacattgagattactctaaaaactgatattggacttgtcaaaacaggttggtcggttgtcggtcgggtaattatcgggtgggtcatgtttcgggttaagtcggtttcgggacggccgggtttgtgttttgtcgggtcgggtcccatgttgacttcgggtcggatcaaaatttcctaggtctatcacaacattagaagaagatattaagagaaagtgatcacatcaaaaggctctacttggtgtatgaaaaacgtaaagtcatataaggcaacttaaattgttaagtgcaaaacacaaagataactctttacaaaagattagaagttgctggaaaggaggataggtcacttacagaaaagtttcgatattcaaacaattcggggaactgtgagtccgactgtccaagttcatttgagcaaaggcagagtacatgtgtgattccaagatgctgaagtgtgtagatggatcttgcagccaacgctccacttatgaacaaactattagtaactaaagatggcttctctgtgttagcagcatccgatatcagtgatatcctctcaagtatatgctccagcctcacctgaaagttcacaaaatacaaacaaatgatattgacaagggtgattgtaataagcccattagatgctctaacaaatgctagtggttcacaccttcaactcatatgcatcaaccacagtattattatcacttccctcaaagaaaccagtattaaaattgttttcctggcacaatttgactacatcattacggagtgtttcattccattgctccaattctttgctcaattcagcatcaacctaaaaattgtcatagaaaactatcaacataacatgtatacgagtactctttacagaagctctaacctaaaaaaacttgaatttcaaggaataaacttcatcaaggatttcacatgcacttagggaaaaaaaatgaatagactgaacaatgccaatgcattaatccccaatatataggatcggcgatatgaagcaaataattcaaaataagagatctctggtaaaaaagattaatacataattcagccctacctaatactaatttaaaataaagaatatcaatttttattgatcacaatttgcaataagtcggacctaaagaatgatactgaatatccatctattcttgcaatgatagcatttcaaacagtaactttcaaaagaatcatcagatccaaatctttcagctagaagttccttttgagatgtactcctataacctaaccccaacactcatattttatattagggatgcaaaattaagcaagtcgagaaactctggatttcatatattctatgttgcaattggcatctcaaagaaacttccaacatattggataactagaaacttgcaaagggtgtatgcatataattgtattaccatacaaatacaagtcattacctattcagctattatgacagaagaacactctgttcacagatgaatcgactctgtttaaacgtgaatgcctttcaagagattaaatgcctaccacttcagttatctgggtaaattaataactctcttgaactggttgctaattcttctgagccaacatgaattttactgagcagtcatcctcaacaaaaagggtggcacataccttggcatacttatggaagtcccggagctttgtagtcaaacgcaagcaacgtgcatgctccccactccatcttgaatactttccctggggggtttctcgtgcgttgggtgaaacagaatcagaacaatccttggatcctgaagatgattgcttcgatgcagttccagagtcaattgacactgtattataatcatttgccaagtgttcctttgtttgtgaagcaggagacgaccaagaaactccagtagacataggtgattcagggaccatgaaatcctctttatctaattcccctgaagaagttcggttaattatcatcataaaagatctcaaaactgaatccagtttttgatttagtgtaagaaggaacatatgaaaaccctgcaggtctctcagagcaccacgaaacccatttcggaatgactggacaatggagatcgagtcaggcgaacatgaatcatttatattatcaccttcaggataccctaattttcctccacttatatcataaagtagaactgacgaatacgtagagctattcaacagcagctccaccagtcttggataattggtctggtcgtttacacgtttcccaactggaggtcggcgaggaacaccagagtcaattgctacaatattaaaatcactatcacccatttcattcaaatctgaatcagctacgtgtagtctattggctattggtgattccatgacagcagagagatcagatttctgtgagttcattacattattctgagggtccaatctgctatcaacagaatttgcccttctctccttttgcaaagccctgaccactcttggtctgtatcgcttcattgcggaatcatatgcatcctccaataagtccctattagcagcggcatttttgtaagcaaacaataagttagcagaattgccacgccatcctagctgcttacaaggtaatctatcttcatttctgataacaaggtctagcatcaaaatccttccaagagctgatgctaccttttctgcagcatctcgatttttgaatgcattttggttctccaacaacggagaaccatgtacataactgcaaaagtgaaatttagtttctagaaaataggatctgaaggtccaaattaataaattttgaatcatataatattttctgttatatttcctcaaccgattcaagtctccaaagactacatcttgagtaaaagatatctgattacgccccaaaaatgatcggagtccaatagctaccgcctaccagcaacaatagaaaagacaagcactctctagttctctaccccctttttcttaaaagtaaattgactcgtacaaatgtcataaggagtcctttgagggattgaaatttgaaagtaggaccaaaaacctaggttactcaagtacaaatgtctagaaaaacttgcaagtaatatacttgccaagactagtatcttcaggtctgatttactcagaaacatgcaaagatgtcaggaatggctacatttccatatgtcaagactcaagacttgttaagactaatatttcaggcatgagatgctatcctgaattttagataggcttgggtactcaacattcacatccagtattcttaatttaaaagacaatttgcatgaacattccatcggataccactcatggacatttgaagttatcaaacttccaatcatacccatttgtaaaaaatttagcatttattctcttctcctttattctttctttttcatcgttttctccacaaattggtttaagatatttgaagtttctcgatgcaaattgaagtgttgggcaaggatttttatattttatatacttgatgaagtattgttgagtcttacaaggggtgttttagttataaagagctaaacacggacacatcacacacacaaacaggagacatacttcattaggaaaaggcatcgacttagttcaagagcttcaagaagttcagaacacgttatttctccaacttcatctctttctgatgcagctacacttctggctttttgagcagcctcctttatctgaagccactctgaacttgtattatgaataactctggcctagaacaaatgaaaaatatatacataaaacaaattcctacaattaccaacataatcaaatgcaactcgaaaacaacctgaggtatacgaactcctaaccactttgcaaattcatagccaaggcgttctgattgtgtggccattcttgaggatgaaaacttgatcacagcagcacattctcttagtttacaatcatcactgacaggtttgaacagcgcaaagaagacaactccaccagaattgacagtcacctataacattaaaaattaagggttgaaaaataaagacaaaaagacagaagcaggcaaagcttcatcagtatcccatttccccaatataaggatgagtttaatacaccaccatccccaaattgagctaggataaaggggaagagtaaaagcaaaaaacagagtaacaccaacccatttgatcagttaatcaaatgcagataatgcaaaagagcaagtattcacaatgagaagataaaaatttattctgcaaattattcacccaagcaaaacttatagagcaccaagtttcaaaatttggcaataattttcctaataaaaagtaggagttagaattatttacaacacatatgagagttgttataaatataagaataatttggcagtcaatttatcagatttcgcctgaataggaggcgacatggaataaatctaccccattacgtcacgtaacgccagttatgcaacatgtttgcgagttatcgcggcattaaatcccattatataacggcgcatgaattttcactttccgtgtaacgcctgatattttaccattacaacgatattttaccgttacaatgtaacttcatacctcaattgttttatacatatcctcgtcagattgttcagtgctgccactgtgctctgtgtggtgaagtgaagagaggttttcccagcaaaaagaacttgattcaatgtccaacatagcagatttaccaagtcgttcccacaaattgatcccagtagcttgttcagagggtgaagaatcttttaggtcactatctgaatcccctgtactgtgtaaccatacatagaacattacataagcaagtcatcagatcaagatgacaaaacaatacaacaatgccaaagcctttatcccaacaatattgggttgggtacatgaatcaaagacaaacctacatgggaaattgactaaactcaatattttaacaaaaagggtatttccacttgacccttgtctaataagttcagtacaaaaatgggaatatgacataggaaaaaaggaagtacctcaagggcatatcaagactaattcttgtggggcgatgagggaagccagagggccgatattgaacggttcgcttacgaaccaattctaaccattgcgtaaacctgtaagccggacctgctgtcaagtcacccagcatatatagtacctgcatttcatcaattcaaccaataatcccaatttagccattcacgtttttcatcacccaactaacagatcaaaacaattcccaaatcaataaaaaaaacaaacaaaataagaaattatagaagcaaaccctagaagtaacagtaagaggcaaaggggtttcaggctcatcagattgaggggtcaattccttgtctaaaatctgatcttccgcttctttctcctgcaatttccgcataaatacgactcaaataacaaaaacccaaacaaatccgataaaaccagaagtcttaattccatcaaattctcaaaaacacaaaccagggagaaatcattgctacttattattttatgcgaaaaaggggaaaaacaaatgaattttaatattttatagaaaaagaaacattacctggagcatcggaatgatgattggctcttgcttttgctcctcaaccgtcattttttggggttttgtatcgatggatttaaataaaattgggcaactgaaattcagacaaatgtcagtaaattctccatcaataaatttattttttgaaatgaaatcaattaaatcccgcttatgtaaagaaaaaaagatgatctagggagtagggaatactcctactagctttttgggcgggagagatggattgaatatataatagaagtatttccagatctctaacatgaacatgaatcatgatccatgattgagtatatacagggaaatgggaataagcttactattaaaaaattggcggggaacacttaatatatggaatatatagaaaactacatttcacttggattttgcactttagtcaaagaaatatcatatatcccgctcataagaaactatggtcagagtctggaagagaaggacagtggcaactcgagcatgatcaaagaatccccgactcgaaagaggataatataaggtctacatttcacttgtattttgcactttagtcaagaaatcacttacatatttattactttcgtttctttttgtctgtccattaagctttaacagttctaacggcccgtttgataggttataataaatgttagtaatgggaatgaaaaactagtgtaattttagttgaaaaattttttggttaccttgataatcatgtcagcttgtccaacttcaattatctcattttgttcataaaatttattccaatgcattacctttatgagtggtggtgttaggtggtaattaaataaaaaaaaagtttttttgtgatcaaagtttcattatcatggcccatgggaaggatataaaacttttgattaaattttacactataaatcatttcaattaccaccatttaataccattaatcaaacaggccgtaagaatttacactatagttcacatcaaaaaattataaaaattatatattaaaaaacttttacattaagacaaatctaataagagtttacatagtacattttatcttcaatatatacttcaaaaaattaaaaaaaaaaaattctaaagaggacaaaccttaaagtgatcttaatttaattaagcataaaaaaatacaaaaatctttgaaagtttatctacaatgtgtaggaatttaatttctatgtctaacatttgagctataagagttcaagaaattgattttttttatttgtttgaactaaattttttagacactcatttttaacgggctaaattcacatgtttgtcatggatcattgaagccgaagaacaccggtcaagaatctaggccatcgactatgggcattgatatttatcgtcaccatttttattgtgtagtcaagtttttaataaatattctgaatttgatacttctttctctaatccttttctatgtacatagattttctatgtgcgggatatactgggtatgatgatgatgatgatttctctaatccttttctccaacttctctctgatataaattttaactcaatttcaacacaaaaacaatatggaagagagtatttcatacgactttgaaaatcaaaaaatcaaaaaatatacgaaacgggtcccaagttatgcagttgattataaacgattcacgatcgacttgagacagtcatcggtattgtgaaacaatgttgcccaattagggtttgcatttgtagacttagtacaaagttcatgtgaatgggcgtacaatgcatcattgcacaagtattctacatagagtattgtatttgtactgcttaggaagcaagcattgtgcatatcccggaaacgcaaaagcatggtgccctgaacaccgactctttactcttgaagaaccagtcggtcgaagatctgcgatacgaagaacttgtaacaatttctattgatt

SEQ ID NO: 1601 - DNA, 711 bp, Amaranthus palmeri
gcaatgttggttcacaaaggaaaagctaggaaggctgttgtgaaggctgtatttgatagatttaccgaaaaatcaatcaaagttatcttgcttgctcaagaggaagcaaggcgattaggtcaaaatgctgttggtacggaacaaattttgttgggacttgttggtgaaggaactagcattgcagctaaggttttgaaatctgcaggcgttagcttagaaaaaagcgcgtattgaagttcaaaagatagttggaaaaggcagtggttttattcttattgaaattccgtttagtcctcgagcaaagcatgttttggagctgtcacgtgatgaggctcgtaaacttggtcaaaattatattagtgcagaacacttgttgttggcattgcttagtgaaggtgaaggtgtagctgcccgtgtcctagatagtctagatgttgatacaaaagagatccgcaagcaggttgtaaacatgatggatgaaaatgagcgtgttgctcaaactagtgggaactccagtgatagtatggccacattgcaagagtatggcacaaatttgacacagaaggcacaggagggaaaattagatcctgttattggaagggaaaagcaaatagaacgtgtcattcaaatactaagtcgtcgaacgaagaacaacccttgcctcattggagatccgggtgttggaaaaacatctattgcggaaggactggc

SEQ ID NO: 1602 - DNA, 860 bp, Amaranthus palmeri
gcagatagagcgtgttacccaaattctgggtaggcgaacaaaaaataacccttgtcttattggagagcctggtgttggaaaaacagcaattgcagagggccttgctcaaagaatagccaatggtgatgttccagaaacaattgaaggaaagaaggttattactcttgatatgggtcttttggttgcgggaacgaaataccgtggagaatttgaggaaagattgaagaagttaatggaggaaattaagcagagtgacgagattattttgtttattgatgaagtacatactctaattggggctggagcagcagaaggtgccatcgacgctgcaaacattttaaaaccggctcttgctaggggtgaactgcagtgcattggtgccaccacccttgatgaatacagaaaacatattgagaaagatccagctcttgagagaaggtttcaacctgtcaaagtgcctgagccaaccgtagatgaaactatacaaattttgaaagggcttcgtgagcgttatgagattcatcacaaacttcgttacacagatgaagcacttgtggctgcagctcaactttcttaccagtatatcagcgatcgtttcctacccgataaagctattgatcttattgatgaagctggctccagggttcgattgcgccatgctcagctccctgaagaagctagagagcttgagaaagaacttaggcagctcacaaaagagaagaatgaagctgttcggggccaagattttgaaaaggctggtgagttgcgtgacagagaaatggaccttaaggctcaaattactgctcttatagaaaagaacaaggaaatgagcaaggcagaaacagaagctggggatgtcg

SEQ ID NO: 1603 - DNA, 553 bp, Amaranthus palmeri
cttaatacttacctacgacccacctttcttgttcctcttccctttctctctcctccatttttctatccttctatctcttcagtattactggtgtgagtcatggctggagcattgattcagtccaccaacatccctgcttcatttgcttatcaaataaatgggccgtgtcaaaggtctgccaagagcaataaggttgtgaagatgatggccagccttcaagcacccgaacttaggatgcgaagcttctcggggttgcgtggtggaaatgctctggatactttgggatctaccagtggatgtttttattccaaaatgagggctgtgctctctgtacgtaaagggacagccagcaggggtgtagttagagctatgtttgaacggtttactgagaaagcgattaaagttataatgcttgctcaagaagaggccagacgactgggccataattttgttggtacggaacagattttactgggtcttattggtgaaggcactggaattgctgccaaggttcttaaatccatgggaatcaatttgaaagatgcccgtgtag

SEQ ID NO: 1604 - DNA, 711 bp, Amaranthus palmeri; identical to SEQ ID NO: 1601

SEQ ID NO: 1605 - DNA, 3409 bp, Amaranthus palmeri
  unsure (1)..(3409): unsure at all n locations
aatggtgctatcttcgtaaagagtgctgaaatgcagactgcatgctgcggcagcaaatagcaacccaaaacctcacaatcatcttctgttagatctccactgaaagcataatcacacctctcgaactcccctaaatcaatcctcaatcttatccggattttgcttatggctactgcgacgacatcgtttcctggaacctatcttcgtgttccacccaagaatggggtcagaaatgcgttgttttctcggtctgtagtgtctaatggcgttaattcaagaaaacccaaatcgctaaaatcattgaaattgagtaggaattcctctaatgtttgcttatatacgagttttgggcactataggaagagttctaagtctggttcttttattattcgatgtaatgccgcagcaggaaagattacacaacaagaattcacagaaatggcctggcaagcaattgtttcttctccagaagtggcaaaggaaaataaacaccagatagtggagaccgagcatttaatgaaagccctcttagagcagaaaagtggacttgctcgtcgcattttttctaaagccggggttgacaatacccgtttgcttgaagcaactgataagtttatacagcggcaaccaaaggttctgggtgaatctgctggttcaatgttggggcgagattttgaaggcctaattcaaaaagccagggaatacaagaaagagtacaaagactcatttgtgtctgtggagcatttggttcttgcttttgcacaagataaaagattcgggaaacagttgttcaatgattttcggctttctgagaaatcattaaaatctaccatacaagctgtaaggggacgccaatcagtcatcgaccaagaccccgagggaaaatatgaagctctggagaagtatggaaaagatttgactgctatggcaagggaaggaaaattggatcctgtaataggacgagatgatgagatacgtagatgtatccaaattctatcacgaagaacaaaaacaatcctgttcttattggtgaacctggtgtaggtaaaactgcaattgccgaagggcttgctcaaagaatcgttgagggggatgtacctcaagctttggtgaaccgaaagttattttctcttgacatgggagcattgatagctggagctaaataccgaggagaatttgaagaccgcctgaaggctgtactgaaggaagtgactgaggctgagggtcagactatcctttttattgatgagattcacacagtagttggagcaggtgccacaaatggtgcaatggatgccggtaatcttttgaaacctatgcttggccgtggagagttgcgatgtattggtgctactacactcgatgaatatcgtaaatacattgagaaggatccagcgttggagagacgtttccaacaggtttatgttgaccaaccaagtgttgaagatacagtctcaatacttcgtgggttacgtgagagatatgagttgcatcacggagttagaatatcggatagtgcccttgtggaggctgccatactttcagatcgctacattagtgcacgttttttacctgacaaagccattgacttagttgatgaagctgccgctaaactaaagatggagataacatcaaaacccattgcccttgatgagattaaccggtctgtactgaagcttgagatggaaagactctcacttacaaatgatactgacaaagcatcaaaagagagacttaatcggcttgatacagagctttcccttttgaaggaaaagcaagccgaattgactgagcagtgggagcatgagaaaagtgtgatgacacgtttacagtccatcaaagaggagattgacagggtgaatattgagatccagcaggcagagcgagagtacgatcttaatcgtgctgctgaacttaaatatggcagcctgaactctctgcaacgacaattggaaagtgcagaaaaagagctggatgagtacatgaaatctgggaagtctatgttacgtgaagaagtgactgggagcgatattgctgaaatagtcagcaagtggacaggaattcctgtttcgaagctacaacaatcagaaagagaaaaactattgcatttggatgaagagctacataaacgtgtagtgggccaagatcctgcagttagggctgtagctgaggctattcaacgttctagagctgggctttcggatccacatcgtcctattgctagtttcatgttcatgggccccacaggtgtgggaaagacagaactggcaaaggccttggcagcttacctgttcgacaccgaggaggcccttgttcgaattgatatgagtgaatacatggagaaatttgctgtttcaagactgataggtgctccacctggttatgtgggatatgaggagggaggccaattaacagaaatagtgagaaggaggccgtatgcagtgatcttatttgatgagatagagaaggcccataccgacgtttttaacgttttccttcaaattttagatgatggtagggtgacagactcacagggccgaacggtgagcttcaccaattctgtcatcattatgacttcaaatgtcgggtcacaatatattttaaatgctgacgatgaggctttatccaaggagaatagatatgagattataaagcaaagagtgatggatgcagctagatcaatcttccgtcctgagttcatgaacagagttgatgaatacattgtcttccagcctcttgatcgtgaacagattagcagcatcgtgcaattacagctccaaagagttcagtccaggattgcagatcgtaagatgaagattcaagtgacgaatactgcagttcagcttcttggtagccttggatatgatcccaactatggtgctaggcctgttaagcgtgtaatacagcagcatcttgaaaatgagattgcaaaaggcatcttgaggggcgattataaggaagaggataccattcttgttgacacagaagtcacagcattttcaaatggccagcttccacagcagaagctggtattccgaaaactggagcctgaattcgatccggctgctggagaagacaaacaaattgtttctccgttttagatttaatttttttttaatttttcataccacatttttatctcgaatatgattatcgatctcatgttactgttaaccgtctataggattacgagtctggtatataatggttgtatagtagcctctctcttacacattttgaaagattttgtgcacagaaagcataatctattcntaaaaagcctattgtgcttgggccttaggggactcactttccgatccgggttcaatgaaggaggagtttgagtgaacacccatctttggttcctcaattcaagttattagagctttgaatctccatcttcaacagt

SEQ ID NO: 1606 - DNA, 1211 bp, Amaranthus palmeri
caagaagcgtccaagattgcatcaagaattcttggacttggttcatcactgtgttaggaggatccttgactccaaatacggtgcatggatgcatgaaaatttgcagattttagcctggatcattgtgtttaatatacaatgcaatgaataatattggctgcttcttatattgttatgtctttttttttataatgcttatagtttgttaaatgtttttcttttgtaaataagggttttgttctctgttgggtgcatgcaaatttatagattttgtttcgatgattgtgctaaatcagaaaaattcatttctttatctaacttaaaatttccacgcaataaaaatgttgaagttatttgacaaaatttctgattttgggtttttgtctttgaatgcagaatttctggttttgtttaacaatcgagaatgaataatattgctcttgcttcacctcatttgctaaagataccagcctcaataaactttcaaagaagacatgggaattttcaaggttccgagagggttataacttcatcgctaagaatggtggcaccttatgatgtttcgagattaagaattcatgcttttccgagattacgagtgaataaaccttttttgggttctataggaagtcttaaagctttagggtttgattctaagatgaaggatgcaatgttggttcacaaaggaaaagctaggaaggctgttgtgaaggctgtatttgatagatttaccgaaaaatcaatcaaagttatcttgcttgctcaagaggaagcaaggcgattaggtcaaaatgctgttggtacggaacaaattttgttgggacttgttggtgaaggaactagcattgcagctaaggttttgaaatctgcaggcgttagcttgaaaaaagcgcgtattgaagttcaaaagatagttggaaaaggcagtggttttattcttattgaaattccgtttagtcctcgagcaaagcatgttttggagctgtcacgtgatgaggctcgtaaacttggtaagactttgctattgacatattatgacatgaaggacaagctcctaggatggatgccttattttgttgtatttttatggtccttagtttcataccatgcctacgattattgtattataatatctaaagccatgttacctggaatcaagttatcatttcagactctaacatttccgagtcattcgttcggggagggggggg

SEQ ID NO: 1607 - DNA, 12020 bp, Amaranthus palmeri
gtcctatttaaaagagtatcagaaccaagaatagctgaaattgtgtacgagtcaacttgacgattatctgcaagcattccatggagtataaacaatgcttcttgaatgcatcctatacaggtgtacctgaaactaatgcagaacacagaaacaacatcacccttttgcacaaaaccagaaatcatagttgtccatgaaactacattttggacaggcattctgaagaagtttttgatagcatcatccatatgtccacatttgaagtataaatcactaatatttgtccctacaaacacgtctttccctatgccatgtttgatcaccaaaccatgaattctccttcccatatcattatttttaagtgcaatacaagcacctaaagcaatagagaatgtaaaatcattgggaatcacagcacactgacgcatttcatgaaaaagctctagacccttttcatgatccccaatcttgacagccccatttattatggtattccaacaaactacattttcttcataaggccaatcacaaaacaaccgcaaagcatcttcaacacaaccctttttagaaaacaagttaatcaagccggaacgaacataggcattggaaaagaatccatctttcaaagttagtgcatacaccattttagcatacaacaaacaccctaaaccactacaagcagagatagcactgccataagtatgctgactactctcacaacccatagatttcatacggcaaaaatacttccaagcatcatcatacaataacttattattataacccgaaatcataacattccatgaaatcgaatttgggttaggcatttcatcaaacacttggactgcatcatcaactgtagagtatttcatataccaatcaactaaagaattcgaaaaatatgtattaacgtaaaaatttgctgacttaattaaatgggcatgcaaaatttgcgcttctttgattgaaaataccttagatttattcaaagaaacaaaaaactgataaagctccatatagtttatatatccatcaatacttacattagagagtgatgggtgctcgaaggtaactgcattgcaaacaaatttaactgaagttttagttaatttcggccttttacttatttggtgaaggatgaaattcatggtagctttacagttcgtacaacttctttgtgagtttgctactagactatgaaccctaaaaaaggagggaattctgaagtttcacctaggcaatttattaagcacacactgcgcatagttaatgctactcggtttagtgtaaattggtgataaaataggatgatctagattaaatttcgattatactcaaattagaggggaaaaaatctgcatgaatggaggaatttaatactacaaatgcacggggatcaagagcagtggcggagccaggacccaaattcagtaagagcacaattaataaataatttaataaaaaaccattaaatacaaaaacaataatgtttttaatttattcctacaaaaaaatactccttccgaatcattttagatatcttatttggattttcacggttcttagggtgatgtggggtccattaaaaaggtggtagttgggtatggggagttgggtattttaattcattaaattaattgtaaatgtagtagttgggtattgagagtagtaaaagtggggtatttaggtaaaaaaagatagacaaaaaaagaaatgacacaattgatatgattttgccaaataaggaaatgagacaactaaaatggttcggatggagtattttatattctatttcgacgagttttcatatcttaaaaccgacgaataatacaatcattaggaacattacaaaaatacctccttttcaataaaagttaaatagatttgataattgaaaattattaatatttaccttcgaatctggttttatttctttaatttctatatctgataattcaaaaagtttattaatattggatggtaaattatatctcactacaaaatatgaatttgaatgtggtaagagaccagagtaaaaagaaacaaaattaattaatttgtttaattatatatatataccaaagaataccagttgatatagaagtaaaaataagatcagacccccaaaatattgaatattattgatacctttgttgacgaagactttgtgattaataatgaatattgtcgatacctttattgatgaagacatttgtgattatagtagtgataggaatagtgataataatcgataaacgaccaaagacgactaaaaacacgtaaatgacctatgttcttgagaccaccttgaatttatctttcttatttaatttgcaaatttttatatgagataatctcaccgtaagacatgtttatattttaatttgactattttgtatatactaactattagtcaaatgtgataatttttaacgtattgaaatgtttatacacaaattcttgcatgaaactatttcattgtaagatatgctttatacttgtgttaaataatccaataatagagacttttagcttataagctttttgttttgaggtcgtctcaccttgagacggtctcatacaagacaagttgtttttgaagacatcaaaatttgtttttgattgactgaaaacaaaaaaaatacatgtgtgccaaaaatataacttgtgggtttaaaaagaatatcatacctattacctacccaatgaaataaaagttcacaagtgaacggctcttaaaaaataaccaaatagcccacatgtgatcctagattcaagaattagagagatggtgattaaaaatataagtttaatgatgcccctcttagagtttgtattagtaattatccactttatgagtcttgtttataagcctaataataactaatttattatagaattttttttcaaccctagatttttttataatgctttttttgttttgatgtttttattaaaatactaattatgctcaaaaaaaaaactttaaacctagtttttattcaacattagttttacaactcattctttttattcatttgattttttttttcaaggcattttcaatttatgattgatatttattgtttcttttattgttttttaatattaatttctaaatcatgtatttttattttttttacaaaatactactacgcaatacaaatcacaatttggaggaatttgtatttcccttttgttaagggctaaagcaaataaacttacacaattatactaaaataaacttaaaaattgtaatgaagacggttacccaaacttgatactagttgtaagtgtgtgctcatttttctttgtgatatttcccccacaaagatatttaggtttgaaattggaaattcacaatgaaatacaaacaactcaatatacccttaatacttgggatatataacttaataacaatatgtttgaatgaattataaacttgaaagattgacaaaaggtttataattctttttggtaatcacaagtaaatagagaaatcaaggatatatgatataattcagaatatgtgtgtcatattcttcaccgaagatcctctatttatactaatcatagcatacccaaccccaagagtcaagagacactaatgatcattgatgatcaagcttaatgaccatttatcaatatttcaatgccatatttattatggtattcattagcattattccaatccattaaacccaatgtaacatcataataagaatgaaacaagaaaggaatgctatgcatattgatcaaaggaagactaaagggcacactatgcctggcagaaccaaaagtcgtgtcgtctttggttcctccctcgggaaagagcagttagcttttcctgctgattcgattttcctgctttgtcttttgtccttccctttgatcccctctagaccttgtatcttaatacactttgcactctcttcgtttttcttagtctactttttacacagttttctaactaacctttagcctctatatgtctcaatacgcatcataaaaagttacaaaaaatgtataataaaacagctccttaaagaccgtcttaccacaaaaccgtctcatttaagaatttttaataataaaaatatatattaaaaggaataataggataaactgaacatcaggtaggacgactaagaagcagatttgtgatatgtataatggatcggcccaattaaaacattgtgttaattatatttttatacgatttaaattatatatcatgaagtatatcattagggagaaacaaaagtgaaaaatccaaagagttgcatattcggctggtccatgtagcttcgaccctgtccctgcccatacggtaacggcatattggcatatcccttaaaaaagaaaggaaaagtcaaagaaaaatcaagaaatactcgttcggccgggtttttagacttctctttatcactcaacataaacccatccactgttaattacatatttataactgaaaatcattccctccatattctcgtatcagaactccaattttaagctcacaattctcgtataatacagctcgcttctatctacataattatttcttgcttcattttctattttaatttcttttccatatttgttccaacaagttttctaaggtactttttttctctcctaatttatattcttactttgttttttttattacgtgaatttttcttgttgcattcgttatgaatgtgttttttgaatcgttttttattcttacagtagtgtgtgtatatatatatatatgtatgttttaggtagtggtcggtgttcaggttatgatcggagcgaaatttaaatgggtcgagtcggggtggattatgttaaataaaaacgaggatataaagtgttttacttttatttatgaaattgatattgataactatataaaattattttgtaaagcaaaatcatgttacattatatttactatctaataaatataagtgttttaaataattaattatcttgttaaagttataaaaaaaatactttattgttcaagctagtcttacaatttaaaataaatgcattaatttaattatttaataatttgtgtggagacttgaaccttgaatcatgtagtttggactataacaccctaaccatcaagctatccttattttttgatgcttaaattttgattttattttcatgtatatcatgcgacgttagttttgggggctttgttggatcgagtttgggactggggacattacaacacaaactattttaatggatatcagactctatagagtttaaattattcacataaaagttgcagatttgagccaaatggttaaaaattgtacatattttcggtagaactagttgaatttggtggttttggcttgtttaatttagttgaaacttgaaagtggtgctgaatgtttgaaataatggttgtttttaaaagggctattaaaaatcttctcaaagtgctcctgatacgagtccaggaagtacaactctcttaaaagcttgtcgtgcccaatcactccaaagatctcgtggtgatacctatttagctgttgatcatttaattttgggaataatggatgagaaacaaattcatttgttcctagaagctggggttgcggctgcgagaattatatctgaggtggggaaactttgtaagaaagatgggaagaaaattgagagtgcaactagagataccaatatccaagtccttaagacttatggtcgtgatttagttgagcaagcagggaaatttgaccctgttattggtcgtgatgaggagattcgaagggttgtaagaatcctttcgaggagaacaaagcataatcctgtactgattggtgagccgggtgttggtaaaactgctgtcgttgaaggtttggctcaaaggatagtgagcggtgatgtcccgagcaatcttgctgatgttaggctcattgcattggatatgggtgcattgattgcgggaaccgaatataggggtgtgtttgaggagaggttgaaagctatcttaaaagaagtggaagaatctgaagggaaagtcattttgttcattgatgaaattcacctcgtgctaggtgcaggacgaacagaaggctctaatatggatgcagctaacttgttcaagccaatgcttgctagggctgagcttcgttgtattggtgcaacgacatttgaggagtataggaagtatgtggaaaaggatgctgcttttgaacgtcgattccagcaagtgtacgttgctgagcctagtgttcccgatacaattagcatccttcgagggttgaaggagaagtatgaaggtcaccatggtgttaggatccaagacagagccctggtggttgcagcacagttatctgctagatacataacgggccgtcatcttcctgataaggccattgatttggttgatgaggcgtgtgcaaatgtcagggtccagcttgacagccagcctgaggagatagataatttggagaggaagagaatgcagctggagattgagctacatgctcttgaaaaggaaaaagataaggctagtaaggcacgacttgttgaggttaaaagggagttagatgacttgagggataagcttcagcctttgaaaatgaaatatgggaaagagaaggaaagaattgatgagctccgtcatcttaagcaaagaagggaagaactcattcttgccgcacaggaagctgaaagaagatatgatcttgcaagagctgctgatttgagatatggaggtattcaagaagtagaggcagctattgcaaggcttgaatctagttctaatgaggtggccatgttgactgaaactgtcgggccagagcacattgcagaggtggtgagccggtggactggtataccagtcacaaggctgggtgagaatgagaaagagaagctgattgggttgggtgagagattgcatcagcgtgtggtaggccaagacaatgcagttgctgccgttgcagaggctgtgctaagatcaagagccggtttaggccgacctcagcagccaactggttcattcttgttcttgggtccaacaggtgttggaaaaaccgaactggccaaagctctggctgaacagctttttgatgatgagaatctgctggtgagaattgatatgtcagagtacatggagcaacattctgttgcaagattgattggtgctcctcccgggtatgttggccacgaggaaggtgggcaactcacagaggctgtcagaaggcgcccatacagtgttgtattgttcgacgaagtggagaaggcccataatgctgtcttcaacactctcttacaggttcttgatgatggaaggttgacggatggccaaggtaggactgttgacttcaggaatacagtgatcattatgacatctaatcttggggcagagcatctcctttctggactcgtgggtaagagcacaatggaggctgctcgagagaaagtaatggaacaggtattggtacatgatctttacggcctagtgatcaacacttggaggatttcagtcgggtattggattataacattgttgaatcaattttgcaggtgaagagacacttcaagcctgaactgctaaatcgtttggatgagatcgtagtcttcgatcctttatcccatgatcagctaagggtggttgccaggctgcagatgaagaatgtggcaaaacgtctagctaaacgaggtattgcactgactgtcacagatgctgctctcgactatgtcctagcagaaagttatgatcaagtaagtattcattcttcgtatatatcatcagaattttataatctattgtttcaaaacgttgaaactaacattataatcaatattttggtaattaggtttatggtgcaaggcctataagaagacggttagaaaagaaagtagtaaccgtattatctaaaatgctaattgatgaggtaattgacgagaactcgactgtgtacatcgatgttggtttggatgggctgaccttggagataaatggcggaatggtgaacgctgcaaccaaagttgttaagatcgagaatctacgtaagatcgttaagggggtcgaaatcggaagaatcggaacgtataaacgatctttatcattttatttttcaatttttggcatattctttatcattttatttttcaatttttggcttttgagccaactcatatgaacggtctcaatatgaaaaagtcttgcaagtttttgtgaaaatttatattccaccaaacaatttttaaggaattgagttaagtcattccattaccagacccgttaaacctattctaaacatccccttaaatattaacatttgatgacatataaaaacaatgtaaagatggccgagttggtctaaggcgctaatttcaggtactagtacgaaagggcatgggtttgaatccacatttctaacatatttttcttttgacatcaacgcatttgaaaaagcagtgacaaatatggagtattttttttgaactttaaaactaaagttattacaaaggattaaaacagtttatttaaatgcatcaaacaagctaaactttgcccaaaagaaatttattaggtcaaaatttcataattacattcgctgttcaaatttaattttcatccaacaaactttaaccggtgactaaagcatcagatcagttgctaacgtggctaatcatggagcccattgctctggaacgaggacctcaaattagctttgaatgatgtgttatttacgtattcatcacgtagctgattaaaaaagaagtatattaaatgaaattacaatatataacgattgtcccaacgaacataattgataaaattaataaagatcgatctaataaacttcaattgcccaaaatttagttacatataactcaaaagtcaatggcagaaactcaaataatgcaatccaaactaaatctcttgattgcataaagaggctggctacatatgtaagccttagcttttcatatcgttaattcccaagccaaatttataataacataactcgtagaagatttttaatgttacaaaatttcaataacactaaaacacttcatatttccctcaaaaaattttatgttcaaaattagcagtcccgaatgtgatctcatatgatggtttttaccctctatccattatgagatctgatagtcatgtccatgaagagatgatcaaactagctcattcatcctccgtgttactatcaaacttgcttgttgatttaacggcccctacaacatcatcttttggctcttgttgaacgacaagcacagagaacccgaaatcaggggtagctaacaagtccccaagaattcctaactctggatactcgcgccatccatcaagagaaagtccatataagggcacacaattcggatcatggtgtcttccgacaacaaccaaatcaacaacaccgttcatagataacaaaagattagtagtatcagcaccatcgttaacaacaacctctttcaatttcattgtcgtgtcattgtcattaggcggaggcttaggagccttataactcgttatcaattcgtaattcaaagcctccatcgcctcatcgccttcatccttaatagaagacttcaaccatacaacaacaaccttaacatgaggatgagtaccaaacaaattagttaaggcaagggcatctttatcatctggccctcctaggaaaattatagccacttgataagcataagagtcccctattccttggaaaggattagctctatcaagcaagattccaaccgaacaaggtgctttttctagaaccatcttattaacttcccttattgatagagaaccatcttcaacaattttcccaactttagtccattgtacattcatatggaacggtaagataagaaggcttacgtctttttcatacgcaagggcacaaacgtcattgtgcataccttcaagggaagccaaggcaatgtagtgttttacgcgagtgtaacctttagattcgcgttcaaggtttaagaacgcttcaactacccgattcaaatatgcgagctttggccgaaagataggcaaggattttacttggtctaatggtgccatgattgggacggtgcaacgaccgaatagtggcatgagttgtagggcaatgactggaattggtcttgttctagtagggttaaaggcttcaataaggcgcaatattcctggtaaattctcttctttgtaaaggcaaactattgtttgaaatgtcccattgcttgttgactctgccacactttgtctaaaaacacttgtgtattggctcaatggttcatacaaacgtctcactagtggcattaaccctccggtaaggatcaaaaaatggaacattgctaatgtgtactcctctatatctatcaactgcaatccaatcaacaacgataatgaaaaatgttagtgttttctaaacagaactaatagagtatatgatgttagagagtataacatatcttaagccctcaaccaaaaactgatgattgaggtcccaaaatatgttatatactctgtgtgttagagcataacatattttagagcctcaaccataatcttaaacttttggttgagttggttccttgtcatggtatcagaaggtgaaacaatcaacgccaggtttgagaaagacatgtgttgcatccacacttctagcccaaaggctctcgtgtgaaggagtgtattagattatataacatattctaaagcctctaccatcagcgtaaatttgattgaattggctgataccatgtcaagctaaggaaccaagtcaaccaaatgcttaaactggttgttaaagccccgaccaagacataaaaatcacgaactgcatcaaaaaactacttacttttcgatctctccacatcccgagtgagactatatcaagcaaccctttagagcaaagaataagagcaagagccatagaattccacaaaggaaacccaaataaacaagcagaaaatgtagttcccacaaacttcccagcataacccaaaatcaaaataaactcatattgcaaagacctttgagtaagagagtacacattagtctgcaacccttgcacagcacaatacacagggaaaaacacagcagacgtaatagcatccaatttctccgaaaaaacagacgacaatggatactctggtaatgataacgcgaacaaaaaaaccgcaaacatctcatccaacacttctccaagcccagcaacaagcataactatcaaaaaaatgattataaaatgggtgctcttcatagtccctccttgtggggtataccttaaaacgaccataaccaatggcctaaaaaccaaaaaaattaaggcataataccccaaaattatagctgaatttctgatatcttttcccatactaactataggtggtaaaatcacatatttggtaaaatttgttaccataactaaaagatcaagaagcaaagaaatggttgaagctaaacgaccgatatcagagttacttattccgagatcattaaggttgttacatgtaaccatgaagaaggattgtgcattaagacacattaaacttatgattccatctgacattttgtgttcaactttggaggatttgaatatttttgttgttaaaaatgctgcaacactgaagattaatgagattatacacccagaaaagcctatgactattgatttcttttctagtcttcttatgattactgtcatgtttgtttctactcctagcatgaaaagatggaatatgaagcctatgaatgacattgtttttagtatgaatgttactgttgggggtagtaatgtgtggtactcaaatcctctgttggaaaatagtattcccattacaataacaccaccctgcaaataaaaggaaatgagataattaaaaattaattttgaaacaataaaacaatgaaatgttagttgattttgctggaaatttatatttaaatggttaattttcactttgtaaaaagagattttgtgaattgagtttcattcccttgtacatttctcaaactcactcaaaaattttcattatat

SEQ ID NO: 1608 - DNA, 4042 bp, Amaranthus palmeri
gtggtagtggaagcttggtgtatgtatggcttggtagtgcatgtcttgggctccaagactctctaaaatcagaccaaggactacaagtacaaggtggagtacaaagcgggaccaagagacactcaaaaggagcaagcagcagcctctgtactacacgctcgactggctgctttggtcgagtataggtcgagccagcctgctgccaagtttctgtttgtttgcgtgttttgtggtatcatggcatacaaagcccaaagctgctgcccccttttctctacaaaatgggccattattttagtataaatataagtgtcctaggctcttaatatttgcccaagtctcatcataccttaagctattattcttgcttaaattactacccattagctcctctcttctacacataacctaaagtttggtgtatgtatggcttggtagtgcatgtcttgggctccaagaccctctaacatgtttatgaaataaagtttcaatccgacatgagcacttgcacaaaaatgaagagtccatttaagctagctttgattttccctttttcggtactgtagtttttcctttttctagagggacatcctttagtttatcgaggggaagaataactgggataggaaaaaccaatatcagaaagtttcatagaatatcttatgcataatggaatgctcagtcaggcttgcttttaatggtcggttgcctgcttgatcctgttgtgcagtttactgtgcaagtagttgccttatttgttcccttattatagctctcctacatacagccggaaaatggaaaggactttagttttatacctcattagtatgttgctattcaatgtgtatggcatgttttgatatatgtgcatattttaattttacagtgataggtttcttcctgataaagccattgatcttattgatgaagcgggttctcgggtgcggttgtgtcatgctcaggtataaatgtatgcacaatagtttttgggcatgatacttcttccacattattatgtgtagccgttaatgattgcttccatgtttcagcatcctgaagaagtaagagagcttgagaaacagctgatgcagattgcaaaagaaaaagatgatgctgctcgcattcaagagtttgaaagggtaaggagttctgttatctgtgattcctttaaatttaatttaatgattgcaaatttgtttcttgaacttaatatttacgtacgagttttgcttgtatatgttgcttggactcttcgtttcatgtacccgggttggaaacatgacttgtgtgttagatgatacatgcttaaatgtgcactgcaggctgctgaattgcgagaccaagaactcgacctaaaggtacaactttctgcactcataagtcaaaacaaggaactgaaagaggcagacatgaacgatgttggaccagttgtaacagaagcagacataagggaaatagttttctcttggaccggtgtaccagttcagaaagtctcgcttgatgaatcaaagcgccttctcagaatggaagacaatctccatggacgagtaataggtcaagatgaagctgtcaaagccatcagtcgtgcaattcgccgtgctcgtgttggcttgaagaattctgaccgtcctattgccagcttcattttctcgggtccaactggtgtgggaaagtcagaactcgcaaaagctttagctgcttactactttggttctgaagaagccatggttcgccttgatatgagtgagttcatggagagacatacggtttcgaagttaattggatctcccccaggctatgtcggttactccgagggtggccagcttactgaggctgtgaggcgccgcccttatacgttggtactttttgatgaaatcgaaaaggctcatcctgatgtctttaatataatgcttcagattctggaagatggaaggttaaccgacagcaagggaagaactgtgaactttaagaacacccttatgattatgacgtcaaacatcggaagcagtgtaattgagaagggtggtcggtttataggatttgatctgacatataatgatgccgatagcagttataacagaataaagagcctggtaatcgaagagcttaagcagtattttagacccgagtttttgaataggctagatgatatgattgtgtttaggcagctcacaaagttggaagtcaaggatatagccgagatcatgttcaaggacgttttcaagcgacttaaaagtaagggcatcgacataaaagtaacagagcgattcagagacaaagtagtggaggatggttataatccgagttacggagcgaggcctttgaggagagctatcatgaggcttttagaagataacttggctgagaagatgcttgcaggagaaatacatgacggtgattcagttattcttgatgctgatattagtggaaacatcagtgtgctcaacaacactagttcaagcaagttttcctagatccttccatgtaaagttttgatatataaaaattagaaaaccttggttttttttttatagatatgcaattcttgatttcttttcttttttaaaatttttatcattttgttaattttttattaaataaataattttatggcaaatagaaatgtgtcaacaattttttgttaatcaaggacacttttcacctaaaacgaaaattggtttgtattgacttgacttgaagcttgaaaagcaacatgctagttaattcaatttgtcttatatctcattttagcttgtcaccataaatttgttccatttttatttcacaaattaccttcttttgtaaagacggctctcaaaagcccaattcaattctaaatatatattgttacaaatttagatatagatttgggctagacttttgagagtcgtctttacaaaagacggtctatcaagagagcacctgtctacttcaactcattatacacaactgttttaagctacgtcataaaaacaaataaggagaaatgaataagacagaaagggctcttcaatttctagcaaagtgatgctcatatgaagccgtttaatttaaaaaagtgaaacactttttattttggttacttagtttattttgaaaataatatatatgacgtattataaaataatgcctttgtatcgcggacagtatgaagaggccaaagagcaaaacaaatagaagtatgtataaataaattgtttactcgttatttataacgagtaagactttttatatttatgtctatccgcctattatgtttgtacctatgccctccaatttcggaaaaatgcattgcaatctatggaatatttttccagcctatcatctttatttctatttctttcataatgtttgtagggaacacaaaacataggttgtgaatgggctcgctcaaacaatggtgaagaaacaatcaacaaatatgatgtaaaagaaacactaaaaacagagcacaacaatggagaagcaaaacacaagaatatataaggtatatatggatacctccccctcaaacaaagtatcttgtcattaatattaatataatcaacatttacaaaatgactcaccttacaatgctctcgaacaatcatctgaagcaaagattgaacctttacttcagtctctcacacaaagccctaatacaaagaagataactctcttggtgataaaccctagtaatctctatgtatttggctctctctataccctaatacacttctaagactcctatttaaagtcctaaaatattttagaggagtataagacaaagccttgaaaggcccacaaaaaaccggattcaaaacagaagctaaactaatcgagtggctgaaacgtgctcgggtcgagcaacatagctcgcctggtcgagcgtgtgctatgagatcactagaaaccttctgccttgtggttcgatcgagccagctatgctcgatcaatcgagcagccatccacagcctcaaatcttattgtctttgcttccacaaagacaccttacatcctccttgatccatcccaccatcaacacgttccatcccttgcttta

SEQ ID NO: 1609 - DNA, 829 bp, Amaranthus palmeri
acagacatgttcatcttttcttcacaatttttcttcatctttcacaaatcatcttaatacccatctccccaattttgcttctaccttccctaattccttaaattctccaccttttgctcgaattcccccattgacacaacaaaaattaaagcaacaaaattgtgctatgtcaaatcaagctattgaggaaagattagctggggttcttgtttatgggttggttaattctaatgaagaatttgtgttgatttctgggagaaggtccaaaaaatcatttgggatgttttgtatgaagaaagaagatgctgattctttgcttgaacaaatgagattgatggaccctgaaatgcgccgtggttctagtgttgttcctgttgctttgaacaaggttttccagcttagagtaaaggaagtttctttcagattaattccggaggtatcagaggttaaaaatgctttgcaggagagggaaaaggctggatttccagatgaggacttcccgggagttccagtttttcagtctcggagcttaattttgagcagcgacaagaagagatacgtccagtttcttcagaaggaggacttggaaaagtcattattcagagcttcgaagcagcaaggaaattgaatcctattcttagacaaggcgacattgtggtagcttctcttgaagacataatcaaaggaatgaaggatgattcctctcgaaattgggatgatgttgtattcatacctccagggttcgacgtttcgactgatccctctaaacttaagtagtgattgaactgtgagtattctggtctcgatgtccttacgacgtttgttatct

SEQ ID NO: 1610 - DNA, 2710 bp, Amaranthus palmeri
tttaggtataatctacaaatcaaatcgaaaaaatcttgctattaaatttgaaaaacagttacaaaaatcaaatacgaaatccgatcaaaatgtaaaaaatccgatcaaaatgtaaaaatcaaagaattataccttcaacttcatcgcctatagaaggcttctcccaaccttcaccttcaacgataagcttctttttcattccagtcttagcgatctccttctcttcaccaaccttcaacgccggaatttcatcaatcacatcatcatcattctccatttccatatccatatcttcttcaacagcccctgagctagtaggaaactcaaaatcgtcctccatttatgaattcgctaagtaatcgaaagcaaaacagagtagcagaaatcaaggattaaaattagagttttggattgttgcaattatgacttttggacgaacaagaaattggctgattaaaggggatttataagaggaaggagaagttctagagactctagagagttcgaaaatggcaagaagatgaagattgttccagaaaatggtatggcagatttttttatgatttttgaaagttttattttatttttttttatttgagcggtttctgaataacggtatacttgaacaacgagaagactaatagacccgctaaaccattggttaccgattcggataataaggcccaatagacaatgtaaaagcccctttgccaaatttgtttattttttttaattcagatggtcttggacgagacggcctcataatgagaccgtcaatattggccggtccaattctcgcgtgtaacaacttgggcatttttatttcattttctgggcaattttcaatttagaaaaaaacgctcataagcttaaagtttctaatattggactatttaacttaagcatgaggcatgtctcacggtgagaccgtctcatacaagaattagttactatttaaacacaaattgttgcgagagacggtctctccgagagacatattagctttatgttttgaggtggtctctctaagggacggtctatcacaagactaactatttaaataatggaaaagttaaccataataaaatgttgatttaggcttaaaagcccatttctttagcttattaaaagtaaattaaatacctttacacaaattcttgctatagaccgtttataacatagacgggtaaatatgagccaatctatttgttaaatgagtaactaaatagtcatgttagtatgttacctattgaacttagctgttaagagagccgtctttgccatagacagtctctcaggagaccttttgtgtttctaccaaaaatagcccttacccaaaactaaaacaactcacacccaagttttcttgtcatcaaggcccaaaacctcccataaacccttcaacatctcacattcatcctatactattccaagaaaacctccaaacttattactttcactctaaaaccctcatcttgtccatcttacaaaacaatttattccaaattccctccttttttccactaaatttccattaaaacaaaccttcaagatgaataattcctcaatatcatcatccaaacaactttctttatcaccatcttcatcatcttcatttcatccattttcccatttccatcaagctttaacaacatgttcatcttttcttcacaatttttcttcatctttcacaaatcatcttaatacccatctccccaattttgcttctaccttccctaattccttaaattctccaccttttgctcgaattcccccattgacacaacaaaaattaaagcaacaaaattgtgctatgtcaaatcaagctattgaggaaagattagctggggttcttgtttatgggttagttaattctaatgaagaatttgtgttgatttctgggagaaggtccaaaaaatcatttgggatgttttgtatgaagaaagaagatgctgattctttgcttgaacaaatgagattgatggaccctgaaatgcgccgtggttctagtgttgttcctgttgctttgaacaaggtaatcttaattgggtttttttcttttgggtacattttatttctgaaaattttgtagcaactttacatattgtatgaatgccagctctagatcgatgatattagtataaaatgagccgaacattcacttttgtatgtgtaatgaactaaatcagctaccattcaaatttgttttctgatatatttagtttattagtcatgaatagatgcagtggcggatccagaaaaaatataagtgatgtcaataattatttaagagaattacattagacaccttttaaagtaagacaacaatattcgttgagattttacacatttaaagtggtgcattaatcatattttcaagttgataatgccaattaatctttttaacctcattatgatgatttgcatcataattttaaatttgtattaattcgatataacttataaatcttgatgcagaattttcaaaccttgaaatagatgataaatatttcctctgtttcttattacttgcaccaaattaatatttgcactaattatcattcattctatcgtaatttacatatttcggctattatatgaggaaaaacataatcatgtgggatcttattcaatttgtctcgttgcacatattcataatatcaaatatttataattttaagatatgtataactctatatataaatgatca

SEQ ID NO: 1611 - DNA, 1068 bp, Amaranthus palmeri
ctccagcaccgttaaacaatccactctcgacatttatccaccaactcggtacggaactcaccactagactcaacgacggccgtcgacttgccggaaacctgatttccaccctctctacggcggcacctcgtcggagaattaaccttcctcttcccctctctttgccatttgcttccattggacaagctaagcaaattaatggcgtcgctttgagcaccgataatgtcgctaaaaccctagctggaacttctgtatacacagttagcaatactaataatgaattcgtgttgatttctgatcctattaatggcactaagtctattggtttgttgtgtttccgtaaagaggatgctgaggcctttcttgctcaggctcagtcgaggaggaaggagttgcggagtcaggctaaagttgttccaatcagtctagaccaagtgtacatgttaaaggttgaaggaattgcttttcgcttcttacctgatccggttcaaattaagaatgctttagatttgaaagcatcagagacaaaacgtgggtttgatggcgttcctgtgtttcagtcagaacttttagtggtgaagaggaaaaataagcgttattgtccgatatatttccggaaggaagatatagagaaagaactgtctttgaaggcatcgcgaggccggggttctcataacatagtggtcgggagtttagaagatgttttgaagaaaatggagataagtgaaaagaattctggctgggatgatttcatatttattccaccaggtaaaagccatactcaacatattcaagaggtgaccaaggcgtgatgtatcgtgtacattttttctgcttgtcttgtttgagaagcaaaggaagcgggcgtaactcgatcccttatttttctttcctatggaatgtccgtttttgattattagagttcactcgaggactcgaggttttgctagtttggattagagacatatgaataatctttaattatgtccataattaacaatcacatttactcatttaggactattgtgcatgatgtcttggagaatttacatttttaatagtgatacc

SEQ ID NO: 1612 - DNA, 9655 bp, Amaranthus palmeri
tcgctaaaaccctagctggaacttctgtatacacagttagcaatactaataatgaattcgtgttgatttctgatcctattaatggcactaagtctattggtttgttgtgtttccgtaaagaggatgccgaggcctttcttgctcaggtttttgtttaccttttgtttgttttcagattgttgttgtgaaattgaattttttggaattaattttgggatttcaggctcagtcgaggaggaaggagttgcggagtcaggctaaagttgttccaatcagtctagaccaagtcagtaatgctaattatttgataattctattgcattttgttgatttctttgtgaattttgtagaagtttctcgttgcttccattgcaaattacttagttgcgtgaactaataaaattgttcaatattttttcgaattggcaaaaaattgttccatggattggtcactactcattaggtggtttattcatagttttgattgagaattgagagttttgatagattttttacacggttggaggtaggtgttggtgagattgaggtttattcagtcgcttgaaatactaaaaaaaaatagaatttcctctaatgttacaaaatatttttgaattggtgaataattgttcaatggattggtcattagatggtttacttatggttttgctggagtttggaatttggatataatttttacatgatcatggttggagatagctttagattagatgatagaggtcatttgattataattctaggtaggttgtgttggttcttgggaaccttacaatgcagcaaaacattttaccaactagggcacacaatgtaatgacaaaatcttgaagatacttaagaccatcaatgatgatcacaaagcagaacatgagaagattaatcatttgaattttgatacaacataaaactctcgcaagtacgctttttgtatatggtaattctcctaaagttcccggtgaaggctttgaattacgtacaaatgtaatacaaaacattcttgtcaagagaaactttaagataaactttgtgttttcatgaacaaaaatgataattaaagcgtttgctaaaaagagtattattgtttgcttgagaatgctaaaaatgtgtttttctgctcttaatgttattgataatatttttaaggaaattttccttatattcatgcaagttagagtaaattccttaaataggagtacaaaggatataactttgcataggtagtttttccacgattaataacatcctcgtttttgtgctctagttttacaagttaggtcattactaatctggtatctagtctcaactcttcaggagatgttttgtctcgatttccatttaacaaattaatccaagatatgtccaaaaccaccgacgaccctttggtggtcaccagtgacccttcattatgatcctttttaatcatttgattgataatatttaaattgctcttgattttttgatttctaattttgacaaagatggatggataggactataagataattggtgtgtttttcggaatggaaaaggagtatttgacattctgaccaagacattttgcgaaaatttaattgttgtttctataacatgagtagctggaacttggaaggcgaaaacatcctagtcgtacaaacttttagttttacaaaaggatatataaaattgagctacttttaaaacatgggtaaacaaaagtatagaaacatttcttgcggtctttaatagtttttttttttttttgtgttactatttatataattattctctccttttttttcattcaacattgatgatgttgcaggtgtacatgttaaaggttgaaggaattgcttttcgcttcttacctgatccggttcaaattaagaatgctttagatgtaagctttctgttttatcaattatctatagcaattgctttttgttgtattggaccctttggtggtatcttacaaatttttcaacacaatctaaacaaatttttatcaattatatatatagtgatcatatctatcacatatgatatccttacatcgctatttagatatcgagcaaaaataaagaaaatgggtacaatgaagatgtggcattaagatttagaaattcatgtgagtcggttatgaaaaggatgtgtaaacacaatccaaacaagtaaaaatggaaagtgtgtaactaaattcggaccaagggaatctgatgtatctatgtcatgcccctggtacacatattttgcattaaatagcttaatactgaatccatgattatttttggtcccaagtcaccccgtgcataaaacaatattcacatttaatactactcctacatgcaagaaacttagatgttaaatgtcgaatccttgttttcctctgttaagttttctatcaatgttatgcttgaggagggacttagaacactgattaaattgaaagagtaacctaaaagaaagatgggttgctaacctatcttaattcttgtggtcatttattaaagtccgtttgaatcatttctgctgcagttgaaagcatcagagacaaaacgtgggtttgatggcgttcctgtgtttcaggtttgcaaccttcgttattttaatgtccgatataagtctaattttcatatgtttaagatgtttttattgtgaagatgctgatttccctttcatcgtttcccttgtcttgggaatttctttttggttagactgcttaaatggacgtgctgataaactgtattctaacaagaaactgagcatgtaaaagcagcatgtttggaaatttaaattgcaaatagattataaataaaattgaaaatggcgttttaatttctgatagtaaattttggggttcttagaatttgaggttgttacctccatgatccaaatgtataaattgcaagtttgcaactaacccatttgcaatcatgaataacttgaaattttatcctcccgttagtttttgaactcctcttatggtagcaccaaacatccacctttgcaacatttttttcatgtaacaagtgtgcatgtgacttttttcctttttcgattatcgctttgataagatttgtttacccctgcagtcagaacttttagtggtgaagaggaaaaataagcgttattgtccaatatatttccggaaggtcagttattaatctgtctttttgactccacgtcaatgacctttgatgaaggcttatgttgtgcttctttgctgcaggaagatatagagaaagaactgtctttgaaggcatcgcgaggccggggttctcataacatagtggtatgttgtttttatatatctgcaatctgcatattctgaaacttctcgaaacaataattttgtaattgtttttgcttgtcacgtcaaagaaatcctgtgcttgatgcctcctctacataaaatacaatttttttaataggaagtattggtattaataatctaaccgctcattcacttatatcaaagcatattactgattgactcaataatataatccaaactgttgaaggaaccaatttagtttccttcatctgtcttcggatgcttgtcgtgacatctttcccttaatagttttttgttcttattcaaacggggtgcttttcgaggtgcttctaaaaaaaatggcatctacaaggtccgcaaccatttcccttgtgttttgggatgcttgccattgaaaatggcatatatatactcatgtcaactactttctcgtgatttttaccccattgaaaatggcatatgaagaaaatttagaactgtgattacagatatagagaatgggatgtaaaatacagtagcgtttaactaattgtatcaaaactgcagtctctctagcctaaatcataagagttaactatgtcttgattcattattcaagtttattacttgaatcactgaaattcaaaggtctagtacaaatcatatctagaatagatactcaacgtaaccttttttcactagatgatttagaggttaacagattttttctatgtttagtacttgaaactgcatctacttttgtaataaaatatcggtatgaatatttttctcttttttatcatttctttggccaactcttgaaagctaatactaacatttaatattttttaattaactctaaaaacaaagaaggaaatgaaaacaccaaggagaaaaaggagggcaattgtagatttgttaggaagttttcaaccaggaaagtttgtgtgcgttgaatgcttgtcctccggctcaaaaccaactagcatatcgactactttatgctacgacttccagtttcaagtttatgactgttaagtagtaaaactttctattctttgttgtggttacaggtcgggagtttagaagatgttttgaagaaaatggaggtaaaattggtgcttttctggtctcttaattttggaaatgtttgtgtttctccctttacttcccgactgagttgcgatgtatcagcgtagctacaatgttttttggatgttaattttccttcggtttagtgcttcatatatattgtatacagacagcagaatgcataagtctgagttaattttatgaatatggatgcagataagtgaaaagaattctggctgggatgatttcatatttattccaccaggtaaaagccatactcaacatattcaagaggtgaccaagtcgtgatgtatcgtgtacattttttctgcttgtcttgtttgagaagcaaaggaagcgggcgttactcgatcccttatttttctttcctatggaatgtccgtttttgattattagagttcactctaggactcgaggttttgctagtttggattagagacatatgaataatctttaattatgtccataattaacaatcacatttactcatttaggactattgtgcatgatgtcttggagaatttacatttttaatagtgataccaatcaaaaacctcattgttaccggtatcacgaacaaggataagattgtgcaaatttgacttctttgaatcctgtatcatttaatgatatcggggtaataatataatgttgaaacagtgatgagtatgtctgaattgacatctatttcactgccaagtgattggaaacagatagcagtaattaaatgccatatcattaggaaatgaatttcttccaataatgacagttagcccatgtaggaaaataatacttcgtcttaaaagatggaaccggcctcggcaggcatgtaggctgatgcctgataagtaggggtgaaagttcggtctatggtttggactttcatcgaaatcaaatcaaactatattttattcagtctctatattttcagaccaaatcgaaccaaattagtttctacaccgaaccaaatcgaactgtattttttatttgtagaccaaaccaaaccgcccagaccgaattttctaggccgaatttttaacctcaaaaagcatctcaaaattttaacctcaaaaactgtcacaatattttaaactaaaaagtgtcacaaaattttctaaaaattaaagtgtcacaatatttttatcttaaaagcgtcacaaaatttttaacctcaaaaaactgtctcaaaattttaaccttaaaaagtgtcacaatattttaaactaaaaggtgtcacaatattttttttttttgaagatgtgtcacaatatttttataaccttaaaagtgtcacaaaattttaacattaaaagtatcataaaattttaaccttcaaaacgtcataaaatttcaacctcaaaaagtatcacaatatttaaaactaaaaattatcacaaaattttaaacaaaaaagtgtcacgaaatttatttatattttattgtatcacaaattttaaccttaaaagtgtcacaaactttttatctaaaaagcgtcacaaatctttaacttcaaaaagcgtttcaaaattttaacctcaaaaagtgccacaaaattttaaactaaaaagtctcacaatattttaaactaaaaagtgtcacaaaattttctaaaatttaaaagtgtcaaaaaattttaaccttaaaagtgtcataaaatttttattttaaaagtgtcaaaaaattttaacgttaaaagcgtctcaaaattttaaccttaaaaagtgtcacaatattttaaaccaaaaagtatcacaaagttttgtaaaatttaaaaaagtcacaatattttaaccttaaaagtgtcataaaattttaacattaaaagtgtcactaaatttttatcttaaaagcgtcacaaaattttaacctaaaaagcgtcgcaaatttttaaccacaaaaagtgtcacaatatttaaagctaaaaagtgtcacgaaattttaaactcaaaagtgtcacaaaattttaaactaaaatgtgtcacaaaattttaaactaaaaaatgtcacaatattttaaccttaaaaacgtctcaaaattttaacctcaaaaagtctcacaatattttaaactaaagtgtcacaatattttaaaatacaaagtgtcacaaaatttttcaaaattttaaaagtgtcacaaaattttaaccttaaaagtgtcacaaaatttaactttaaaagtgtcactatatttttatcttaaaagcgtcacaaaattttgatcttaaaatcgtcacaaaattttaacctcaaaaagtataacaatattttaaattaaaaagtgtcacaatattttaaactaaaaagtatcacaaaattttgtaaaatttaaaagtgacacataattttaaccttaaaagtgccaaaaaattttaaccttcaaagcgtcacaaaaatttaatctcaaaaagtgtcactatatttaaaactaaaaagtgtcacgaaatttttaaatatttaaagtgtcacaaaattttaacctcaaatgtgtcacaaacttttaatctaaaaagcgttacaaaatttttacctcacaaagcgtctcaaaattttaacctcaaaaagtgcctcaaaatcttaaactaaagagtcacaatatttttaattaaaaagtgtcacaaaattttctaaaatttaaaagtgtaactaaattttaaccttaaaagtgtcacaaattttttatcttaaaggtgtcacaaaaattttatcttaaaagtgtcaaaaaattttaaccttagaagcgtctcaaaattttaaccttaaaaagtgtaacaatattttaaactaaaaagtgtcacaatattttaaactaaaaagtatcacaaaattttgtaaaatttaaaaatgtcacaatgtcttaaccttaaaagtgacataaaattttaacattaaaagggtcacaaattttttatcttaaaagcgtcacaaaaatttaaccttaaaagcgtcacaaaattttaaccacaaaaagattcattagatattaaaagtttcacaaaattttaaccttaaaagtgttacaaaatttaacattaaaattgtcacaatattattatattaaaagcatcacaaaatttttatcttaaaagcgttacaaaattttaacctcaaaaagtgtcacaatatttaaaattaaaaagtatcacaaaattttctaaaatttaaaagtgtcacaaaaatttaaccttcaaagcgtcacaaaattttaacatcaaatagtgtcacaatatttaaaactaaaaagtgtcacaaaatttttaaatatttaaagtgtcacaaaattttatccttagaactgtcacaaactttttatctaaaaagcgtctcaaaattttaacctcaaaaagtgccaaaaaattttaaactaaaaagagtcactatattttaaactaaaaagtttcacaaaattttctaaaatttaaaagtgtcacaaatctttaacttaaatgtgtcacaaaatttttatcttaaaagtatcaaaaaaattttatcttaaaagtgtcaaaaaattttaactttaaaagcgtctcaaaattttaatcttaaaaagtgtcacaatatttaaaactaaaaagtgtcataatattttaaactaaaaagtatcccaaaattttgtaaaatttaaaaatgtcacaatattttaacctaaaagcgtcataaaattttaacattaaaaatgtcacaattttttaacctcaaaagcgtcacaaaattttaacttcaaaaagtgtcacaatatttaaagctaaaaagtgtcacaatatttaaagctaaaaagtgtcacaatatttaaagctaaaaagtgtcacaaaattttaaactaaaaagtgtcacaaaattttatactaaaaagtatcacaaaattttaattttaaagtgtcacaatagtgtcacaaaattttaaccttaaaagtttcacaatatttttatcttaaaagtgtcacaaaattttaacatcaacatgtattaaaatatttaaagttaaaaagggtcacaaaattttaacatcaacatgtattaaaatatttaaagttaaaaagtgtcacaaaatttgttaaaatttaaaagtgtcacaaaattttaatcttaaaagcgtcacaaaattttaaccctaaaagcgtcccaaaattttaacctcaataagtgtcacaatattttaaaataaaaagtgtcacaaaattttaattttaaaagtggcacaaatttttagctttaaaagtgttcacaaaattttaacattaaaagtgtcacaaatttttagccttaaaagtgtcacaaaattttaacctcaaaaagacaaaaagtgtcacaaaattttaaactaaaaagtgtcacaaaattttaaattaaaaattgtaataaaattttaaactaaaaagtgtcgcaaaatttgttaaaattaaagcgtcacaaaattttaaccttaaaagcgtcacaaaattttaaccttaaaaacgtctcaaaattttagccttaaaaagtgtcacaatattttaaactaaaaagtgtcacaatattttaaactaaaaagtgtcacaaaattttaaccttatttgtacattatttttttaatgtgcaacatactaacatagataaagctacttaagcgttgcccaatatgctacattgaagtagtgttttgaaaatctggttgattagtaacagacctaacccaagcccacttatgatccttagtatccaccacattcctagcctcagccacgtccttcaccggaatatacgcataatttccgttcactttccctgcaacaaatcctgtataacctgccattactccatgaatcgcggaataagctaacaatgtgcagtacaaattatcagttgcatttgcaggaactgcccgtatcatatacgttggatcgatgtacttcacagtaaacaactcgttttcgtgttctctcttccaccatttatttagctccgttttcaaccacgaccctacatctaagaacatggggttccccgactcgtcgtgttgctgctgctcatcgtttctcggtatcaagtcttgtcctgcaccttcagctacaaccactacagcgtgtccgttttcccgtaaacgtcgctctaaaaactcgaatagccccccttttccttcaaggtaaaaatcgttttccgggattaggcagcagtccacatcacgactgcttaaggttgcatgcagcgcgatgtggcctgtgctgcgtcccattagctttactaatccaattccattcactgcactttcggcttccacatgagctgcattgatcgctt

SEQ ID NO: 1613 - DNA, 764 bp, Amaranthus palmeri
agatggggcagccaggaataccattgagtgtcatttcaaaggctgcagaaatgcagcttttatatgctgttgacaaaatgcttctcggaaatagatggttgaggaaagccactgggattcagccgaaattcccatacacggtggactcattcgagagtaggagtgctgtttctcagtcaagagcatttaagatagctacctcttctggaaactcagaaacggaaagcctaaatgaattgccggagcagaatgtttctgcacaggcaggaccagaaaccaaagagcaagatattttgcagccagctaatctcggtgctccatggagagattggctgagaccaccttggttaaaaccccaatgcaagaccgacaaagcggatgattcaagttttcaagacccatcgagaggttatttgaacgaagagcttcaaaatagtccgcttctcccaaggattacgatggttggtattgctacaactgagccaggacaaatgaataaagccactataaagaagaccatggaagatttaagcaaggaattggagcaggaaggccatgacaactctgcctctaagagctcgggaaaacatttccatgaagatcgagatcctcttttcgtagcaaatgtaggggattattattcaaatatgggaacaacaagttcacctcgatggctacgcggcatacacagataaagatttaaaaaggtaccgtaattgattgttttgcgttgtttacatcgtgtagtttggttggtatgactc

SEQ ID NO: 1614 - DNA, 1533 bp, Amaranthus palmeri
atacacaattacagatattaacgatcgaataagtgcattggatagagtgcaaaaagcaaatgggacacttgtgctgaataggagggagtaatattttcctaattgtaaaattaatttatacaaataactattaaaattgagtgttattgcataatatctctaactttattttttcaatatcatgtttatatacattgatgctaaaaaatcgtgcaatggacgggtttttacactagtttgttatatacgtttagaacctcggggcttgagtgagatcctctccatcacccagagtgtaatagatagtctatcagccaatctaatgattataattgcttgatggaggaaaataaaaaaaattttaaaattttattttttattctaaaataggtgtcgacatctcattatgggcacgtgagaaaagtaatagaccttcccaagcccctacaacaatataagtagaacaacacccaaccaaaacttgtctaaactttgtaatgccctgctttgttttaatggcaccaacaacagaaccccataacttcaacaatttcatcaccaaatgtatccaatcaacatcctcaaatttgtcttctttcattccccacacacccaattcatccctttcaatacccatcatgtctccttccaacatctttctcccatttcctcttcctttctctgagtcaactcagaatgattctctttcgcccaattccaatagttctgctcaccttgctgggcaacctgaacccgggtcgggtttcccttcaactgttcgaattggaagtgggagtaggagtggtgggcccgcttttgttggtcaagtattcagtatgtgtgagtgtgaccttaatgggactagtcttatggctgtcactactcactttgatattccctttatttctaaaaggtagtttttcttctaagtaattgcttgagttatgacttttagtgtttctttattgtttgttaacaattgagaaacaaatgatgtgcaagaatcaatcaagaacactaaactgcacaatcttgaatgaagaacatgaactgttcttacctatacatatatacacctatgattagggtttagggagggaaggaaaatgggttgctacatgtttgtggggtggtttttaatttttgaagtttataatatattgtttttaatagttatttgcttaattattaatgaaggttattctagtttgctggttaatcatttatattgaattgagaattgattgatagagtataaaagataccctagggctaaaaagataacttaggctacacgatcagcttaagcttttggttgagttggtaacaaacacgtaagaatgaactgaaaactataatttccactattcatgtgtgttgttatctttttgcaaatcaatttctattatgaaattgatttttccaagtttggtagttgctaaatgatactccaaccttcttgtggttgtataaatattgggcatctaaatgcattggtgagtaatttttgagggtgttgagataaggatttat

SEQ ID NO: 1615 - DNA, 9811 bp, Amaranthus palmeri
ttatttctggatgttgattgtttaatgtgagagcttcttttgccaaggacatactgtgttcaaactaagttgctttccacgtataaggagtgtttggactttggctctcaagtgagtaaggaaaggaattatggatggacaagataaagaacattaagtaacttactttgttttgtttcattggttggtaaagcttcatttccttacaatgattttgttctaattaaaagaaatagaaatattttataaactatgggaaccctcccccacgcaatagtgcaaaaatgaggtaactgaagtgacggggttacttggggtttaaacattttataggtacttgggcttgatatcttccattcaaaataacttactcatatctaaataaacatcaaaccatttgttttagatattaaatattaacttctatcaaatatttaaagtagaaaaaatgtgtgtccaaatctcaaaccatcaagtatcactcaatccaacatgacaatattacacgtgttggacattgacacactagaatgtgtgtcctggtgtcctagattaccgacaacatcaaccttttcgcctttcccacgcaggacccagtgtcttcaacatagcactcactattatgtagtctttttctcctttggtgtcctagacaacagtggcagacctagaactcaaactcagtgagagcataattattataataatttaataaaaaatcttaaatacaataaaaataatgttttcttttgaattgtataaaagaatattttataatgtatttcgacgagtatatcttaagaccgacgaataataagatcattgggaacaatagaaaataccaccttatcaatatacgttacaaaatacctatcaaacaattatatatcactaatcaataattattaattgaaatttctattaaaaacattctatttttctaaaatttgcaatttaaatagaaaaagttacaagcatcaattaatcaagaaaatacttgaataaataaccgaacaattaatcaagaacatatatacaacttgttttaaaaactaattgtaattaattttatcaagaacatatatacaatttattcgaaaaatcaattttattatcataaaattgcatataatttgcaaaattagaaaaataaaaagaatcacacctttaaataagttcactataatcacttacagatcatggttggtggtgtttaagttatttagtcaaccacatactatcaaataagtggtataaggagtctgtaattttatcaaaataattgtatctcagctggtcagcggctgcataacaatactcaaaggtcaatgggtttgataccaagcaactgcagagctgccattttcaatatttttgtttataaaaaagtcaatgagatcacatgtgggcgtaggagccttctaggtccgcccatggacacaaggatgtgtttgtcgttgcgcaatatttatttatgaagattgaggtgtaagggttggtgtttgtatttttatcatagaatatgggagaaatgcagtggtttagtggtgccgatttggggttgctgtagctgtattggatggttgtgaattgtgattaattaaactaaaacagtaaaatagaaataaaacaataaaaggacaaaagtaagattatattataaattcgatgctatagaatgattacaatcttaaaaatgtaaaagaaagataaatccagcacttcgaaaagctaaaaatctcctaaaatgagtataaactcacccactaaatgtgtaacaattttcatgatattctattactctctaagccccactatttacaataaaaccccttttaatactaatttatctcccaacttaccaataacattttatttatctaaattacccctccgtaaactaattatctaaaatactaggtcataacctgtgatgtttttagcatggtgagtggttgtgttattcattgaggtagctggtagggacaatgtgaaagttggtatctagtctttgctatcattaatcacatgtcatttgttataatagtgaactttcacttgcatctttgtggttaaacgtgtgataaatgataatcttttttactatctatatagagcaccagagtggatgaggaagatatttacagctgtaataaagaatgaatcaggtcctgtcttccggtttttcgtggacctaggtgatgcaggtacgttatacatgtatctaacattgggttgcatcttattctagggcatcgtgcatgctacttccatcaaatctctatttgttggttatttggaaaacctcttaaattcattgttgttcaaacgatttgatgaaagttatttataccattgcggaactcttactgtttactaccgctactctcaatgatgtttttgttcttaccaaaactggatattttgtcgatattatagtcatagttataaagtgtattgtttacttgttggcctggcattttttgtatgtttaatgtaattgctgaataaagtaccaatgcttattgctttcattttttatagtttcctacgtcaagaggctaaacattcccagtggcatcgtgggtgcttgtcgacttgatttagcctatgagcatttcaaggtatgttgatcacgtgccaatagtttatgcttagttaagaaaaaagtaatttaagatcttaatatttgatggttcttttttcttccagaggtttatatgattctgagtttcatatatgagcactggagataatttgttttgaattatgatgcttaagcatcttcttatgcaagcatgcatttcatgtctattcgtgtacgtagttatctcttcttggtcctaattgactggtgggcatctttaagtgcaggaaaaaccccatcttttccagtttgttccaaattcgaagcaggttattctttatagtcaacttaatttagtaatagtttgattaatccattcaggaattcagagaagatgtatgaggaccaacgtagataatttttcttcttgcaggtgaaagcagctaacaaccttctaaaaagaaacaaaaaagtaggtgggggaaggattgatggtgttcctgttttctcagctcaaaatttagatattgcaatagcaactcctgaaggaattaagtggtaatttctcatattatatatgtacagacccgtactgaatttctatccgtattttgattgtaatccggcaattaaacaaataggttatacaagtcaatttatccgaaccgccctaaaaaattgatatccaaaccaaaagataatccgacaattaatggaataggttattatgcgcacgcacacacacatcaagacatatcacttatttagatggggtgaaaactttatagttcttcggtttcaaaatataatgaactatactacagtggctcattagtttacgtgcactttttatttatgtaaagttgcacatgatgtttgctaccaagggttattgaaaacagcctctgtgtttgtgttatcactaataagggtcaagttgcttacatccgacccctcaaacttcaccctaggtcggagccatggaatgacattaggtaaaaaaaggttttttatatatatatcaaggcgtgtttaacgacttatattttaacttttttctttttaataaatacttgttatttttccagcatttaaccaaattagtagttaactgtttattacataaagcaaatccaactattgttggaaaatagaaaaaactacaattacaaaaattcaaggaaaaattaccgtgtcaaccttttcgttaattttccgacaataataccaacttttgattaaccatgaataaaaccaacttatgcgggttttttttcctagaattgtaccaactttagtttaaagactaatttaccaagttttttgtcataaaatctcctatagtttgatttttaccatgtaagggatattctaggaaaacaccccttaacttcatattattgcggggaaataagcaaaagttttcttaaatttaatgaataactatttgctaaatttcatgtaataatatcttttcttatttattgaaaattagttaggactctctattataaaataaaaatagaggtccatgaatatagatttaaggtaagtcaatgaatatgatggttaatgaagtgttgaagtggtattaaggatagattaattggctacttgtatattaaatgttctaaaatttacgtaggttttttttaagcgtatatgtctaatatttttatttgcatagatattggacaaccaagaaataaaaacaaacaacaataacattccctcaatgccatcaagtggctcttagggtggggtatgggagggtcggatgtacgtaaccttacccttgatgataaaactaacaaagaggctgtcgctgtttgacccttggtagcaaaggtcatgtgaaacttcacataaataagtagtgcacatgatttaataagtcattttactttagtccattataattcgaaaccaaaaaattataaatctttggtaccattgaaataatggacatacaaccagaaaacaataaaataaattaatatgaatagtgcagtaaagagaataacagtgtagcctttcttggaatgaggtaacatagttcttatagccacgatgggataatgtgttacaccccttggtagggtgcacatgagtattgtagtacttcgtgtatccttatgagaaagcacatgtgactcttatatgagtgctttttatgtgatatgatgctttctcatatggacatagctcacttacatatcttgatatactgaaggggttagttaacaatagatctggagaggtagtaaatgacatttgggtccttggatatgtggtagatttctgtccacattcctcatcctcgcctttccttttatgtttatgtggacatattttggtagggaggtgaatgtttgggaaccatgccttagatgacatgttttgtaattgtgtgttgggcttctttttgaatggcttttcaagcatcctttaaattacgaactccttttgcttgtgaagaaaaattcatgtggaccatcacaaaattattattattggttcatgtagccaactccagttttttggattaaaacttagacattattgtacacttaatggtgatattgtaaattggattttgttaatgtaaattcacaaatcttttttttccaggtacacaccttatttttttgataaaaacattttggacaacatattagaggaatcaattgatcagcatttccagtctatgattcaaagccgtcgtgtgcaacggcggcgtgatgttattgatgacaactttgcagcagatatcaccgaagagagtgcagacagcatatgggagcctgcagaggtgagctgataaatacctttttgtttggtttgtatcagacataattgttgcaacgctcgcctcctccccatccccaccatagttttcaaaatcccgattctgatctacgattctacgattttacgatttaaaatcaggcgaacgatccggattgtcaggtaggatcttaatgtggtagaatcgtgcaatcccactaagcttaagaatttaggtggtaggatcataacacgattctacgatccaacgatccaatcttatatgggtcatttcaatcgtaaaatatattcatataatacaaatttcaaatacatttagtcatacatatatttaaaatagctgtatcaatacaactataaaatttaagtttttcttgcttcctagtttaaagataattattaaaaagtattttttttcaaaactcaatagatgaagtcaaataagttttatttacaccctaaaacttcaaaagagaacaaatataattgataataagtaattcaaagcactttaatgcatatctgtagccattgtaggatcacacgatcctacgatccgatttcaccgatttctatcctaccccttcaatgatcctaggtagaatcccgatcctaataatcttgctccccacccttcaaatataaaggaaagggaacatatgttgactcgcggacaccgaccatacttaaatttgtaaaacgagtcagaattgtatcctacatttactccactaaacttcttaatagaatgctataaatgataagtgaatttgcaactttgtgatagcaaacgcctttatctataaggattaaggtgtaatatactatctcctttactgatacactcgatatataattcgttatatgtggttccctgttggattcttttgagtaattttattatatcaacatgtaatgatgtttctaaatgcataattaatgggtatattttgctagggtcaagcaactcaactctgaataatatgcttacttgattgttcaattctcatttaggttcaggaaataatggatgagatgggacacccaggaataccattgagtgtcatatcaaaggctgcagaaatgcagcttttatatgctgttgacaaaatgcttctcggaaatagatggttgaggaaagccactgggattcagccgaaattcccatacacggtggactcattcgagagtaggtattactttgagactcagattgaatacttcatttcccatatcatgtgtacttgataggaggggaagggagggaatcaaatgttgagcgacgagataaagtggttttgtatctcccgttgcttcgctttgggagttggctttattggcattgatgtttccaagttccgacttaacaaactcctttaatggcttggtaaatgtacggctgtcggtaaaatggcaaagggatatcatgcgatcaaagcattttcttcgtttatgccgcctaactcttccagtgcataactacaattcgaattttctttgcaggagtgctgtttctcggtcaagagcatttaagatagctacatcttctgcaaactcagaaacggaaagcttaaatgaattgccagagcagaatgtttctgcacaggcaggacccgaaatgaaagagcaagatattttgcagccagctaatctcggtgctccatggaaagattggctaagaccaccttggttaaaaccccaatgcaagaccgacaaagtggatgattcaaggttttacctctatcttctgctgtgaaaatttcccaagaacaaccgaaagggttgtttttgttgatcattttcagattatgtaaacaacggaagtcacttcgtttctgacagtcatgattttttcagttttcaagacccatcgagaggttatttgaacgaagagcttcaaaatagtccgcttctcccaaggattacgatggttggtattgctacaactgaaccaggacaaatgaataaagccactataaagaagaccatggaagatttaagcaaagaattggagcaggaaggccatgacaactctgcctctaagagctcgggaaaacatttccatgaagatcgagatcctcttttcgtagcaaatgtaggggattattattcaaatatgggaacaacaagttcacctcgatggctacgcggcatacacagataaagatctaaaaaggtaccatatttgattgttctgcgttgtttacatcgtgtagtttggttggtatgactcataacacgcaaagcaaccatagtaatcgctcttgcgctgctacgaattgttgcggtagttaaagtcaagaacgaaggtttgaggtagtatacttaaaggcagttgtatataatcttaccgaatcagaatttttatttcgttcctcagatcgtttaagagatgcaagcttagggtgttagcttgttagggatcatgtactataatttatatctacttgtggactcattgttgtacaagaaattaaggatattgtactagatattgtaagagaaagttttatcattttccatattttcttgggttttttaagtgtatggtttgtcccgtcacgtccatttatatgagagctttttgggagaaatagttcattaaaataaaccaagtatttgtttgaagttgacaatataatgtacttttttttagcaaatatcatcgtatgatcatctgtcctttttccctttgtttcttttaagaaggttcatctcatcccttgggcgttggggcggtgcgagtaaaattatgtagttaatctcaaatcggaaataatcttgtattaatctgttggtaaaaattatttaagaaatatggtgtgaatttgaattatagtttttttagtgatttttattactctttttattctgcccatttgttttattttctttttggttactattgaaatttcacttttaatttgtattttattgttaatataaaactcaaaatatagtcaagtaagatattgtttgattcatcttaaatgtcaatgtaaagttgtaaactatccaaacattaaaagttaaaatatagccgagagactctttagctgtactgggtatgagctgccgtttctcttgccttccaaaccctgatcataattaagtctataaacagaatacactgtacgatgttgaagaagataattattaagaaaggtttttataaatggtattgaatccaagccgacccacatacccaccaccttcctgggacaaatatgccaaactgaaaaaggtagtgggataatgttaatcatttgataaacctcttttagcttacttctattggtaaaaagggaagaaagtcttctttgttagaaattattggtatgataagctcaaaattgatcggattttggatacttgttgctttgtaggaaaaatgtagttttcataatatttattgttttgtcacttcaaattaacattaaagagaaaataaaataagttaagcaaaacataactatttagtaatcaatataaagagatactgaatagtgcgaattaagttaaaatgtatggattagatcaaaagattgtgatagacaggtgtgtcactatccatagatagaaatgagagaaataattatttccttgatcgaaatataaaagtatttatttccttgtacccatgagtttgtcacactaactgagagaaataattaaaaataacaaataatgagagaaataatctttttaaaaatgagagaaataatgttaaatgagagaaataattaaaaataacaaataatgctaaatgattgaaatataaaagtatttatttccttgtacccatgagtttgtcacactaacaacaatagttgttttattggaattaaaagaatattagaaaaaaaacaaatagattgtaaaaatatatgaataaaaaaaatgtgtgatcataaactaaaataaaaaaatggtttaaaatctaaagtattaaaataaaaattgtgtcaaatccattgctacaagcaagtatttggtgaccccatttttataaaagttgaatttaatgggaaaacatgtcactcgttttcttgccaaacccaacatgtttaatttctaacacttagaaggaagtatattatatccctttcgtcaataaatcttgtcatagcttgtgtaggattagacttgcccatctaatatccatcaacttcataatgccttgctaaacgctcattaacttgacactcaatataaagaagtcttagtaaataggaaaatttgccaagaataatcccaactatcacccgttggccagaaataatttcaactattgattattttttaataatcctaactagtgataacgtttgctgaaaacagtcccatttgattttcaaccggctgtagcaggttaagttaaataattttctgatttgatgaaggaaacttacaaaa

SEQ ID NO: 1616 - DNA, 503 bp, Amaranthus palmeri
caattcatccattaattgtaattcatccattaattgtctctaaaaaagcttcatactttcaaacactcaccaaactaaacctagcaggagctcaattcttagtatctcccaaaacccattacatgcaaaacccaattcatattcatattcaaattcatattcatccagaaaacatattgaagcaattgcatcagatgtgacagcagttggatcatctgaagaagaagaagaaggagagagtgatgaggtggtagcatatgattggacagaggaatggtatcctctgtacttgacaaagaatataccagaagatgcacctttgggtcttactgtttttgacaaacagatagtattatatcttgatgctgctggtcaacttaggtgttatgaagatcgttgtcctcacaggttagctaaactttctgaggggcaattagttgatgggagattggaatgcttataccatggttggcaattcgaaggtgaaggcaaatgtgtgaaga

SEQ ID NO: 1617 - DNA, 1478 bp, Amaranthus palmeri
gcttataccatggttggcaattcgaaggtgaaggcaaatgtgtgaagatacctcagctgccagcaggagcaaaaattccaaaacaagcatgtgtgaggacttatgaagtgagagatagccaaggagtcgtgtgggtgtggatgtctcaaaaaactccacctaaccccgataaaattccttggtttgaaaactttgctaggccagggttccaagatatctcgactgtacacgagcttccatatgaccattctatcctccttgaaaatctcatggacccggctcacattccaatctctcatgatcgtactgattggactgcaaaacgagaagatgctcaagctttacgttttcaagtcactgagagaacagaccgtggatttgctggttggtggggaaaagaaagcgaggaatctatgctcaactttctgaggttcgaggcaccatgtgtgctttccaataaccgagagttaattgatgagaaaggtgagaagcaatacttctctgggctgttcctgtgcaggccatcaggacaaggaaaatccatgctcatagtgaggttcggaaccacaaaaagatcgcctcttgcaaaactctttcccacatggtacttccaccagaatgcttgtaaggtgtttgaacaagacatgggtttcctgtctctcaaaacgaggtcttaatcaaagagaaagtcccaaccaagcaactctacctgaacctaaagtcttccgacacttgggttgcggaatacagaaaatggatggataaagttgggcatggaatgccttactatttcgggcatagtaccatttcaccaccaaaaatcccagcagtagtcgagcatgcaccagcaggcctggttgctggattgtctgcccagtctcctgctaaaggtggacttgggacaatgtataccccaaattggaataacaggtattttcgacatgtgatccattgcaaggaatgcagtaatgtcgttaaatcttttgaaacatggaaaaagacactttctatcatcgccctattgtcaactggattcgcaatactagtttcaggaaggcagtggaaagctctatttttgttgactacaacattgtgtttggctggagcgtatgcttgctccgctgccattgctttgaacacaacaaattttattaggactcaccggagggtttaaaaattccatttattgcgctgagagagcatcgggtgagatcgaaattcaacaaaagctcaattaattaagatggaatcccaagacattatattccagacatgcattcctgttggactgaacttcaagaatcagatttccatattgtacagaaattacatagcatagctgaaactgcagtcagtgaggtattatatactattctctatttttcgtcgcaattcatacataatgtgtgcaaactacaagaaatgagatgattgatgttgaaaagaagccaaaacaaattagatattgatgttagatg

SEQ ID NO: 1618 - DNA, 1334 bp, Amaranthus palmeri
ggaacagaattaaaacaagtaggaaagaagttcctattgaatgtgtggccaagacttatttccaaaaagtatactttctctttgttttgttctctttctctgtccaaatagaatagaatagaatagaatagcctacccgaaaatgggaatgatacaagcaattcatccattaattgtaattcatccattaattgtctctaaaaaaagcttcatactttcaaacactcaccaaactaaacctagcaggagctcaattcttagtatctcccaaaacccattacatgcaaaacccaattcatattcatattcaaattcatattcatccagaaaacttattgaagcaattgcatcagatgtgacagcagttggatcatctgaagaagaagaagaagaagagaatgatgaggtggtagcatatgattggacagaggaatggtatcctctgtacttgacaaagaatgtaccagaagatgcagctttgggtcttactgtttttgacaaacagatagtattatatcttgatgctgctggtcaacttaggtgttatgaagatcgttgtcctcacaggtaccacttaccactatgttttttctttgtttcttccaccaattaaacaacctgtgtactattattcatcaaactttcacaaacatctaccattaaaactaaatctaaatgcctatttatataatctttaatctttatttactgcattcttaatgtctactcataatatcaatgtctatttacattaattttaatgtctacctacttagaatatttcaaaaattacataatagtccggctcaattaaagatagtctctcaaatagattgtatctcataagaatttgtgataattcatagaaacaccggcgtctataagttaaaatatagttatgtggcatcttgtttgattcgtctcaatataaagattatttaagatattaagggttaaaatgttgtctcgacaaatgtgaaaactaaatgcgacaacttggatgaattgcagagggagtaatttgctagttagtttttgaatttgtggtttccttaaaatagtttttaaataacctataattgactaaattccttttttaatttttttgcgattttgaaggctagtgaatcatgtgacattgagtttggtgggtttgataataggatcatctataattctttatccgttgattttcctacatttatgtaggtttttattcttatatatagctttttttatgtgaacatgattgtttagatgagggacaataaaaaatttatgcatgggtgaggtcattggaggagggaaggagagaaaaatgattggcagtggtg

SEQ ID NO: 1619 - DNA, 4103 bp, Amaranthus palmeri
ataattaaaataatacccattatcaccaaagattccatttttcttaatcttggtgaaaaacccaaataggaacatcaaaaaggaacggagggagtacaacctcatatttgcactactatactccgagctttttattcaagcttgattagagatacaccgatcattatcggtacttgaaatatactcgatgaaaacgtgtttatatgatgtttttatgtggtgtttgattcaggttagctaaactttctgaggggcaattagttgatgggagattggaatgcttataccatggttggcaattcgaaggtgaaggcaaatgtgtgaagatacctcaggtcaatactaatcccaccttttctttctattttcttaaactccagaattcactataatgtctgctaacaatgaatgcatttcttgaatttgcaccaacagctgccagcaggagcaaaaattccaaaacaagcatgtgtgaggacttatgaagtgagagatagccaaggagtcgtgtgggtgtggatgtctcaaaaaactccacctaaccccgataaaattccttggtttgaaaactttgctaggccagggttccaagatatctcgactgtacacgagcttccatatgaccattctatcctccttgaaaatctcatggacccggctcacattccaatctctcatgatcgtactgattggactgcaaaacgagaagatgctcaagctttacgttttcaagtcactgagagaacagaccgtggatttgctggttggtggggaaaagaaagcgaggaatctatgctcaactttctgaggttcgaggcaccatgtgtgctttccaataaccgagagttaattgatgagaaaggtgagaagcaatacttctctgggctgttcctgtgcaggccatcaggacaaggaaaatccatgctcatagtgaggttcggaaccacaaaaagatcgcctcttgcaaaactctttcccacatggtacttccaccagaatgcttgtaaggtgtttgaacaagacatgggtttcctgtcatctcaaaacgaggtcttaatcaaagagaaagtcccaaccaagcaactctacctgaacctaaagtcttccgacacttgggttgcggaatacagaaaatggatggataaagttgggcatggaatgccttactatttcgggcatagtaccatttcaccaccaaaaatcccagcagtagtcgagcatgcaccagcaggcctggttgctggattgtctgcccagtctcctgctaaaggtggacttgggacaatgtataccccaaattggaataacaggtattttcgacatgtgatccattgcaaagaatgcagtaatgtcgtcaaatcttttgaaacatggaaaaagaccctttctatcatcgccctattgtctactggattcgcaatactagtttcaggaaggcagtggaaagctctatttttggtgactacaacattgtgtttggctggagcttatgcttgctcagctgccattgctttgaacacaacaaattttattaggactcaccggaggttttaaaaattccatttattgtgctgagggagcatcgggtgagatcagaaattcaacaaaagctcaattaaattaagatggaatcccaagacattatattccagacatgcattcctgctggactgaacttcaagaatcagatttccatattgtacagaaattacatagcatagctgaaacagcagtcagtgaggtattatacactattctctgttttttgttgcaattcatacataatgtgtgcaaactacaagaaatgagatgattgatgttgaaaagaagccaaaacaaattaaattgatgttagatgaacagcagtattatatttctattcctttgtatgataacaaatgcaggataattaagtattaagatagtcttttccatttaaagtgttaattaccctgcatccacggcattttgttcctattgaatgcgcaattccagagcacaggtgcagcaaaacagtatgttttaaggacatatctaataatatgtcagacgcatttcttttatcttgtacgagaatgaaagatggtgcaaatatgttagttttaatgagataagggagaaataaagggtgaaagagttagataatgaatgatggaaactaaaaaatggcattaggagctgaaatgttttgtcataggctcaaattcggaagagaatatagttgcaattcacagagtaatgatattcaaggctttaatccttcatagttgatgttgtaggcaaacatacacaagatgagtaatttttgttcagtatttcagaaaacaaaaatacttttctggctgttcataagatataataacttgccataaatcttggaaaggcaatcgaattgttatgcaaaagttgaatcatactcaacacaggaatcacagaattgaggattatcaaacatagaggcctctataattcttagatgacgatctacttgtatacttatttctgctggttgattgcgtctgatagctgatatatgggttcaatgatgaaacattgaattcaaactctccaagtgtctgcagaaaaatttttaaaaaaatagttttgaatcttttatcaagcattatgcatatatgataattagagctcatcaatatattacccacctgaacagccttctgcaacacctggtacatttcacttgtacgctttcgtttcttcataacctgagagttctcctgtaataactcttcaaaaagttcctccctatccatgaagcaccccgtgttacagagaagcagaacatttaaaaacttcaaataaggcagagaagtaacgtgaagcgaatgaggttctgattacccatttgtttgaagtataatatgaagaaaaagaatatgatctaagaaagtgtagaaatgtggcaatgaaatctttcaaatatagtttttattaatttttagttggtaacatttgactgaagtcaactcgattcatgcaatgtggaatactgcttggaacatgggttctggtagactgtagagtagttgtgtcttttatcaggtgtcagtctaagataaattcaaccaaatctccagctaaataaggtaatgtacctgtaaaatgtccgaattaaagtagagtggagttccctttttagatgattaacctgtatgtaatacaaactcagaaatataatctaaggaagataacaacaaacgagataaaggaattgtagtgtaccaaaaagtgcataatagcttttggaatatcatcttccactttctttcgaactatatcaaagtaagatttgagcagcattctggttacaagcacttctgtttgctcatcttctgttggttcgtctgttggttttatgctcgcagctggctgcggtcccaacaaacaaatgtaatcatatccgaataagaaaaaaaacgagaaagaaacaaagagtagaactttgtacaagaaaatgaatcttcctagataccagctttacctcttttagttgaattgatattggtgcttgaaaagtattagatgtttcgccatcattagacgatgttccattccagaatttgagaggcatgctccatagctttgatgaagggtctaacatggcatagaatgacatataagttgcaatctacaaacatgtttcttttcacaaggctacagtattgccttatcaattgctataacaagatcacttgtaaaatgaaatatctttcactccaaagtccaaatattgtcttttgtaaagtgacctagacattgacacactcggtttcttagttggttagttctaaaagttgagcctgcagtaccatctccactcagtaagatgaagtaagataaatccaccattatgcagtaccatcgtaaattttatggtcatttctagaagctaaaaagcagtaactgacgattctaacttgacttgttcacaaagtgcaggtttgagtttcttggtttctagtgtttgcttcaggctatcatcactaaaaatatcgagattgtagcaattgtgtgaacccctatggcatcgccttttattcttgacgtgatggacatagaaatactaaacatggacttacgaa

SEQ ID NO: 1620 - DNA, 1868 bp, Amaranthus palmeri
gattctatcaataaacttgttcatgcttacaataaacagtgtaatttgtaaacttttcagcagccattagagattacattaacagcttacagcccaccatggctaatctcaccatgctatcaacaagaataccaaaattgaaacccacaatttcagaaaaactaccatttacaaccaaaatcaacactgtttatcccttttcatctaatcatcaatacaacaatgtaatcattacccataaacctaatacaactaacaatttcacccccaaatctgttgtttcttccattgaagaaagcattggaacaacaaacgaatcagaagatgaaatgggtggtgagaaatttgattggtataaacagtggtatccggtgatgccattgtgtgatttagataaaagaaagccgactgggaaaagggttattgggattgatattgtggtttggtgggatgtgaatgattctgaatggaaagtgtttgatgatatgtgtcctcatcgtttggctcctttgtctgagggtaggattgatcaatggggaaggcttcaatgtatttatcatgggtggtgttttaatggttctggtcagtgtaaacttattcctcaagctcctcctgatggccctccggtgcacacatcaaagaaagcttgtgtatcagtatatccaagtactgtgcagaatggtattctttggttttgggctaattcagaccctgaattcaaggatattcttcagaagaaaaaacctcccttcattcctgaacttgatgatccatcatactctgctctagtttccagtagagaaatcaattatggctatgaagctcttgttgagaatcttatggacccagctcatgtaggttatgctcactatggtatactaactaaaaaaactcccaaaaacaagccagtcaaaggtgttgatagagaaggtggaaggcctcttaacttgagaatacaaggtatggacatcaatggattttctacaatgcaagagtggggttccggaaagttctacgcaccttgtgtctactatgtttacccacaaacttcagccatcgacagcgcaaatgacactggcgatgataatggcaatggatcggtctcatcagttgacagtaaggcacaagctgctactcggaaattacctgttttggtattcatctgtattccagtgagtccaggaaaaagcagattaatatggtcttttcccagaaattttgctgtttggttagacaaaatcattcccaaatgggtgttccatctcaatcagaatttggttcttgattctgatctttatcttcttcatgttcaggaacggaacataatcgaggccgggccaactaattggcataaggtttgttatgtgcctacaaagtcggatgttattctttcgggatacagaaggtggttgaacaaatactcgaatggcggagtaaactggggttccaagttcaatggaggtgctcttccccctacccctccacgcgaagagctcctggataggtactggactcatacagtgaactgttccagctgcaatgctgcttataaaggacttaacataactgagatcacgcttcaagtgatttcttttggtttgatcggggtgcttgctctaaccaagcaaggaacgatgaacactatccaacggtctgccttattctcagtggccatactctgctttttagcctcaaaatggttgaataaattcatttacaaaaatttccattttcatgattatagccatgcgctaatataggcctaaataaaccgatacatgcgactatacgagttgtaactagtaagaaaatggtgaaaattcatatataagtttgcccttgtctctgtcgaaagatgatctgatacc

SEQ ID NO: 1621 - DNA, 2150 bp, Amaranthus palmeri
ggaataatagaagttctaaatacacatattttatgtgggtcatattcaatcggtcactcccaatttagtccagtgtcgactaagcattgttggcttcatttctgtctctctttgagaattttgttctctttggtgtatttaacggagaaacacttcctttatctttttaattttttacatatttcatttgtgttgtttatttgattttgctatattttttatctcacattctctttcataatctcaatacaaactcgttctttttgtctcatcaacgtatttctttcgtgtacttaattttttatcttgttcttttactacaaactagaaagtaatggattcaatcattaagctagtcgtcagaatggggcctgggcaatgactatatcaatatgttttgtcacttactttttttagccacatggtgtgcctctatccacaaatactatcatctgtcatcagataaggtatgacgcttcgtaaaatcttgggaatttgcagctgtaatctcctagaacaattaactagcaatgtctcagataacaacattatcagccagaataccaacattcaactctgcaacctatgaaaacatctcatttactaggattagtgcttgtaatcagttatttccatcagtagctgattctacctgtaaatacaacagggttattactactaccattaagtctaaatctcttattagtcctactgcagcaatttctgctacttcttccttaccatctaccgaagaaagcattgattcatcggatcaaccacaagttgagaatgcccgggagaagtttgattggtatgctcaatggtatccggtgatgccagtttgtgatttagataaaaggaaaccaactggtaaaagggttatcggacttgatgtggtcgtctggtgggataggactgaatctcagtggaaagtttttaatgatttatgccctcaccgattggctcctctctcagaaggccgaattgatcaatgggggaggcttcagtgtgtttaccatggctggtgttttaatggatctggtcaatgtaaactcattcctcaagctcctcctgatggccctccggtattcttctctcactttcaactctttgattgactagcaaaatacttcgttgatgcctattggctaatgctaatgcagcctaattaaagtgaaatgtatgtgcatcaggttcatacctcaaagaaagcgtgcgtagctgtatatccgagtgttgtccagaatggcattgtctggttttggccgaatacagatcctcaatttaaggatattcttcagaagaaaaaacctccattcttgcctgaacttgatgatccttcttacttcagctcatttactaacagagacttaaattatgggtatgaaacaattttggttacagctctactgtcctaatgttaatgctgtttgtgcctttatgattgttgatttattttaatttgctatattaatctttatacttgccttgtcttgctatttgtcttgcctattgcgtgtccttggtcttttgctttcatttgtatctcttttgtgaacctaggtgtctcactggccccaacctctatctcctttgataagggtatgatttgctgtctccaatccctccccagaccttgatcgtagaactattagctggatatactgggcatgatgattttatgtcctaataattatgttgtcatttgccaaataacatgcccttgttttgagatgtgcaagttccaattgggaatttgctcaactatcacattaaggaaatatgaattatgagattgagctttactataagaaattcttgtgaataaatcctctttttagtgaggataacagacataagtttgagaaattatccaccaactggcaatagattttgtatggaacttcacctggccttatatgtggtgtcaaatggtcatttgatttaggtttgcaatcagccaggtggagcataaacaatagaagtcgtaaatttgttattacagggtaaagttgcataaatcggacccctcgaaccccacctaggcggaagtcatgacattgaggcaatgacatgttgtaaacttacatgttattcacattcttgacccgattgttaatttgttttacttgcagttatgaggcactcat

SEQ ID NO: 1622 - DNA, 3262 bp, Amaranthus palmeri
tcatgacattgaggcaatgacatgttgtaaacttacatgttattcacattcttgacccgattgttaatttgttttacttgcagttatgaggcactcatggaaaaccttatggacccagctcatcttccttatgcacactacggtatagtgaaatcaccacctccaaaaataaaggttgatcgagaaggtgggatgcctctgaacatgagtgttaagcatatggacatcaatggcttctctacaaagcgagagtggggtgccggtgccttctttgcaccttgcgtctactatgcgtttcccagtccatatccatctccagaaaatggcaatggatcagtctcaaaacagaaaagacttgttttcatattcatttgtattccagtaagtcccggaaaaagcagagtaatatggtcattcccaagaaacttcgctgtttggttcaaccgaatcataccaagatgggtgtcccatatgaccgaaaacttggttattgattccgatctttatcttcttcattatctggtatacctcacttctttgcattaaacttcatttcgatattatgctttatgtacatctatcaatggttgcttttcgttttctttaatcatcgatcaggaacgaaaagttctagagtttggtccagccaactggcataaagtctgttatttgccaacaaaatcagatgctgctctttctgggtacagaagatggttgatcaaatattcacaaggccaagtggaatggaattccaggttcagtggtactgctcttcccccaactccttctcgcgatatactaatggacaggtacgtatacttaactactcgccttcaaacatctatgatatttggactcggattaagtgaatataacaatgtttcaggtattggactcatgtggtgaactgtactagctgtaatgctgcatacaaaggacttaacatagctgagatagcacttcaggtctcggcttttggtttgcttggcgtggttgcgttaactaagcagggaaccctgaccataatccaacggaccgccattttttcgatggctatcctcttctttgtagcctcaaaatggttatctcggttcatttacaagaattttcattttcatgattataaccatgctctaaaataagcctcgtctgataaaactcgaaacgataagggcgtactctttctctcccagaatctcatctacgcatttttccacaatccgttttgtacatgtaccaatttctttgggtcagagggagtactttattctcgcaatttaaaactaaatgtgtaaatataatatatcatttcaatttgaaggtcactttttgtgtataaacagaatgtgtttaaagagtagagtacaaagtttaagttgaggaattgaagcattatacttttgtaatgatcactggaacaattgtgtacttttgtgttatcactttaaacttggaatgaaaatctctctccccttaactttttgtcccctagtaaaacttgtttatatgaagtggtttactaaattatgtaattttaaaatttaaataacatgttatacattttgtataagtataaagaagtttcagtgagaaccatccttatatgagaaccgtaaaaaccattttgccttacaaaaaagttactttttacttttaggcaaaaaatactaatgttttttatgatattattaggcaaaaaaatattactttaagaaaaaattttaaaaaaaactcgtaaaaaggtaatacttttcgaaaaaacatattactttgtaatatggttgtttttttgggatttttttttctgaaactaacattttttttatggtgagaccacgctcattgaactagccctatttatacttacaattttaaaatagtcacctataaacttacatttattattattaccataaaattatcatttactaaccttaaataaaataaccatttataaaatatagtgattatataaattcgtctcattgtaaaatggtatagattgtatcgtattcgcttcatgatgagaaggtatcatacaagattaaataaaccgattgaattgatccatgaaatgaattgaaaatctatggcaacgaagtctactaatgacaagatcaacaacttattattgttaatcacataagattacattacaagttatttcaaccaaaacatcaagtctagacaaaacgcaattatttaatttgtactccaaaaaatataaacattaaaccattgaaccggcaaaacgcgaaactatacccggcccgtatcaaaacatttccaaaactcagattagatgaactcaacccattaaaaacccgcttgacccgacccgtcaaacaactctactttcactagatacttgatttaaattggattccaaagacgggccaaagttgagcaatttcttggactgaacccaaggtttaacaaccaccacagcatcaaaaaccctagtatgatcaccttcttgggctttaaccgttagatagtatttaagcccggcaactacttgtctttgggccttaattacttcaacaaaagtcaatttagatccaccatcaagcccgatactccgaatcgggcttgatggttgtaaattatcccttatttccttgttatattcctctattgagaattttcctaagtcttgaacttctttgtttgttttaacattatctatatcttgtcttgctcccaccattcttcccctttgtagtgattttaccttagttgttaaaaggaagaatagtactataagtaaaagagagtaaggaagagttggtttatgcattttgtttaggtgttttttatgggtatatttgctttggtttattttgagttttttgtatttgagtaagtgagaaagtgagatagttttgaggtgagaagggtgtattaataggtggaagagaaatgcattttgtcttgtctctgttagactatataacatattttgcagtctcaaccattagcttaagtttttgattgagttggttttttaatatggtatcagagccaaacatatactctaacagtctcggctcctacgtgttttgaaatatttgcatctgattgtaacatattgtgtaaaagtatcactgtcactaataagtacgtaaaagataatattatatattattagtagcaagtataatagaacgaagaatataataaaataaaatgtgggagaaagagatgggtggaaaaatcgagagaagaaagagaagagaatgggatggagaaggtggaagca

SEQ ID NO: 1623 - DNA, 9492 bp, Amaranthus palmeri
aaactgtctagattatatatttttagaactatctacttctttaatcattactcaacactctacattttcagaactgttagattatatattttcttagatttttctagagatgttatactaaaattttttagattaattaaattttattttgacaaatatatgtggtagagaacattttaatgctttcattttaaatcttttattaagccaaacaacaacaaatgagaaaaacaaattttagaaaaacattcttcccttcaaccaaacacttttttaatacttatctatctttttaacacaacttaaaaacatactacatttttgtatgtacccctcttttcatctatattataattatcttatgaaatttgcaagactctatttaaaagtaattgtcttatcaaattcacaaccctatcattttgggaccatttttctctttatatatcatatatgtgcctcctcttcacttgcttcatcttcatgaaatacaaatatttcctatatcctttttaattgacactaattttcattttattttgttttataatttcacacttttttcatttttcagacaataattttactctttttcttttaatctaatcctaaaatttaattaatctttttatcttgacactcatttttatctttcatttagtttttttaatcttattttctaatttgattatctttttctaataaaaaaaatgagatttttcatgtggtaaccctgagatattgggtgtttcacgtggtaacaaaaactttttaaaaatccacgcagtaaccctgaagtttattaaatttgttcttcaaatttgttcttcatgacctttttacttagaaaatgttaactacaaagcttaaaccttgttgtatgtctatttattcgtttcatcagattaaattgcagtagtgtcataatttgataggagaagagaactggggaactagggtttgaatttgggggatagatgaagatttagggttcatgttttgggaaaaatttatgaaactaatgcaatttgatctagtgaaacgaatacataggtgtagagcaaagtataaatcttgtaattaacgttttctgtgtaaaaaggtcagagattggtaaaactcaagttactatgtaaatttttaaaaagttttggttaccacgtcaaaaataccatatgtcagagttaccatgtgaaaattctcagaaccgattatattaattgggtaggagagagagaatactcaaaagaatcttatttgacaaaaatcaaactcaagcagagtgaaaatcctatgaaaagtagaggacttatgggtagaaaacaaagaaaaaaaagataaaataagcttgcaaaagctctcattttcgacctcaaaaggatgtgaactttgtttgttcctatacttccttcatttcccaaaaattcaatttcaaagttctttcattcccaaaggaaccccatatactcttcacttctttttggtcctttctctctcctcatgacaaatttgggtaattttgacctcaaaactagtactatcttcttcttcgtcactctctcaccataatttctttcactgttactcaaaaatgttggcaaattgtcttgatcagctcaacaatgggacactttttaaggaatataaaggtaatatgttcaaatttggttccttttcctttacaagtgcttcaatggttctgtttttatgtgtatatatcttgttgggtttcagtatttgtgggttttgtgatgaactggctatggtttcagtaccattaggttttgaggtttctgggtttaataaaacaaccacttgggtgtcccaaaatggggtttttgcatttgggtttttagagggtggttatatgagaagcatttatgatgaaaatagtgatggggtttttgttggaattaggtataatttaggtaataaagttgcaaatttgcctgtttggactgttggtgggggtcttagggtatctgaaaattctacatttaggctttctgaggatggtaggctgattttgtttgagaacatcaatggtttaatactttggagcagtaatacctccaaattgggtgttcaaaaagctagtcttttggataatggtaacctagtcttgctagacagtgaagaggaggtagtttggcagagttttaatagcccaacaagtagtctacttcctggccaatcctttcatttccctcaaactcttagagctccttcgacaaagtcgatttcgagctactacaatttcgttattcgcccttccggtgagcttgctttggtgtgggaaagcaatgttacttactggaaaagtagtggtgctttgagctctcctagccatgctctcactaaagaagcaagatttgattcagatggtagtttgggagtctttgataatttaactaacaaaagtgtttggtctgtgtcaagcaaggatttccaagactcttcagtgggtctaaggcatctaaggattgatactgatggtaacttgcggatatactcgtggtatgacgagcttaagatgtggatggtaggatggcaagcagtcgaaaatcaatgcaatgtgtttggatcttgtgggttatatagcttatgtggtttcaattctagtggacctgtttgtagttgtctaaatgagggtaccattgatgggggttctggttctattgggagtgatttaggtctttctgggtgcaaaaagttagtagatatagataactgtaaaacgcgcacgagcatgatggatctgaaacaaactgtgctttatggtctttatcctcctcatgactttgatctcatgttgaatatggatgattgcaaggcttattgctctaatgatacatcctgcgttgctgcgacctcgaaaaatgatggttcgggcatctgcactatcaaaagaaccgggtttattagtgggtacagtgatccctcgttacctgcaatctcatacttaaagatctgtttggttcctcaggcagtttcagctcgaaagaccattcctcaaggcggagcgacagaaacatctcttccatctcgaagctttatttttgatggaaattcaagtaaaattgtgacaactctcgtaatgatcgggttggtgactgctttggtgacccttacagtagagattattgttatttggagtgtgtaccggagacggaaaactactatgactgtgaggatcccttttgacaaggatgctctgaaggaccctcattacagtgctttggtacggttatccttcgaggagataaaggaactgacctcggactttgcaactcagctaggcccatctattttcaaaggcatactaccgaaccaaactcccattattgttaaggttttgaataatgttgtatccgagaaggattttcgtatagcagttacaatcttgggtggtactcatcatcggaatcttgttgctgtgaagggtttttgttgtgagcagaagtacaaatttcttatctatgaatttgtaccaggcggttctgcggataagtggctatttgatttgggtcgtagatcgaatgagccacattggcaggaaaggatcgacattgctcttggtgtggcacgagctcttgcgtatctccatttggagtgtcaaagctgtgttgctcatggaaatttgaagctcgagaacgttatgcttgaccaaaacttggttccaaagctgatggactttggactcgagggccttcttcagggtgattctgcctcttcttcggagtccgcatctgagagggatatatacaacttcggacaaatgctacttcagattgcaaggctcaaaagggatcctccacaagacgatgatgttaaccatttgatcaatgaaatactagaagcacagagattggatggtcatgaggagtacgagagagtatcaagagtagtaagaatagctctttggtgtgtgcaaaatcaaccgtttctgaggccttcgattggtgaagttgtgaaggtactagaaggtacactttccgtggatagacctccctcgagttttgccttcacgtcagggcgacaagtagaagttgaggagcaaaccgaaattcaagaacatccatagttatgtaagaaattgactgttgtttaggagttctctctttaaatgggatttcaattggtctagaaggtgtggtgtctttggagtttgacaaggtttttgatttagtatgagaacttcaattacacccattgtatgatctaccaataccattgatttagcatgattgaagatccattattttttttatctaacactatttaacaacgtagattttatctccatccaacattttctgtgaactgttaacatctgcagctgtgaagagctgttgatttctggttaggtggggtcggtttgaaatctagttttgtgttcatattgttttttacataattgttaatcgttaacaaggtttggtaaattttgggtcatcgggtttgttttaaacacctctagactctagttacttgtcatgatttccgcagtagcagattctgcatgtttccttcagtgcaagtgtttgcatgctgttagtaacagcatacaaactctttgatttttgactttaatccttttttcgctgttattaacaacgaacaactccaaatcacaactttaagaaaaaactgcttactttaggtattatttccaaaaatttatcattattcgattttttaaaatttttttgcttattcatttcatattttcacattcttatacgatcgtagacatatgttagtaccaaccaatgagtataaggggaaattgtactaggttgagtctccttaaaccaaaccaagttagtgcttggtcattttcctactgttcacatctgaaataagatcctacatcaataaaatagtgggttatggacttgtatatattctgggtgagctaatactcctactatcatatgattttgggaaacaatgaacctcaccaagtgtatatgcaagtcaatgctcattcccgtgggtttgtgggcccgtgcccaagggtgtctcgtgtccacacgagcgggccacagtgaaattatgtgacgaattgtcacgacttaatacttaccacaccaacctaattacttgacgaaccaattcaccagtaatcctaacaagaattttatggatctaatattcaagtttccaagattaataaaaacagatatttttatcaatgattaggtctttactatgagttgtataatgtatgctgtcaataaaagtctttatctaagaacagtgagcagtatctatcaatcacatatatttctaacagtgaaatactcactcataaaacacatgtgcaattgtcttcagatattctttggtgtaaattttcagccacaaacccatgaataaataatgttacaataagttgtgcttaagaaatcaaaagtccataagctattcttgaagaataatcatggctactttcacagtgttcccagctagaataccaaatttgagtacaccaatctatgaaaaacttacattttcaagtagtagaagtacccgtcagatctctatgatatcgggtgctattaactcgaacatgaatgtgatcgcgaaaacagcttctgcttattctgctgtatccactgacgagaaaacagattcattcagtcgacaagaattagagcttgaaaatgaagctgcatcaggcgagaagtttaactggtacgatcagtggtgtccggtgatgccagtgtgtgatttggataacaggaagcctcatgctaaaagggttttgggtcttgatgttgtcgtttggtgggataggattgaatctcaatggaaggtttttaacgatcaatgtcctcatcgtttagctcctctttctgagggtcgtattgatcaatggggaaggcttcaatgtgtgtatcatggatggtgtttcaatggctctggtcaatgtaagcttatcccacaagctcctactgatggccccccggtaacttatagtagtttcattcttattatgtcgatctttgttgctacgatttcttcactgaagtgatatatgcaggtgcatacgtctaagaaagcctgcgtaactgtatatccaagcacggtgcagaatggtattgtttggttttggccgaaccctgatccagaattcaaggacattctacagaagaaaaaaccccccttcttcccggagcttgatgatccctcgtattcccatttaatctcgaatagagatatcaattacgggtaaggaaccttgtttaccaacttactccctctgttcgaatttgattgctatataacttataattgatctatgggtatggtttgccgcctttcttcccttccctgacatatcatagtttgctatagacgggatacactgagtacgaacaacgatgatgatgataacttataattaatagagtatataacatatagctttgcgcaaactccaatcgattttcttacttgcaggtacgagtttcttatcgaaaaccttatggacccggctcatcttccttacgctcactacagtatactaaaagcaaagcctcctgagaacagataagtatcagaaatctgccttttaccttaaagtaatgttcttgtatattcttactaaaatcggtttgttgtgtaaattttggtgaacaatgtcgatagagaaggcgggaaacctcttaacatgggtgtaaaacatttggatatcaatggtttctttacaaggctagactgggggggtaccagcacgttctatgcgccttacgtttactatgtttatccgaatccctctcctttcagcggcaaaggaccattgtcatccgtagtagtgccaaatgaggtagcatttgtagtgtcgaaagattcacatgttagccttgcttattgtttgacattaaaacacatgaaaatgttggtttttcaggactcctcgaagccatggccaacttcacagagatatatacttatatttctttgcattcctatcagccctggcaaaagtcgactgatatggtcattcccgagaaactttgatgtgtggaaggaccgaatcatcccaagatggttcttccatctgcaggaaaacttggttctcgattctgatctctatcttcttcacttggaggtatgaattgatgcactttctttacagttctattaagattttctgttggttctcttaaattagcctttctcatctaggagcgaaaaataaagaagcttggcccaatcaactggcataaattttgttatcttcccgcgaaatcagatgctcttgttgtggctttcagaaggtggtttaatgactattcagacggtaaagttgactggggttccacgttcactgaagacgctcttcccccaactcctaaacgcgaagaactgctggataggtttgttcatatttgtgctcaagcacaaatgctagcctttttccatcgtcgaatgttaagattagtgtatgctaagtaaatgcaatgtttcaggtactggactcatgtcgtcaactgttccagctgcaacgctgcatataagggactcaatttaggtgtcacggtgcttcaggtgatggcttttggcttagtcggggtggttgggctgatcaagcagggaacaatgaccacagttcaacgtactgcagtcttcttcatggccatcctttgctttgctgcctcgaaatggttgtctcatttcattcacaaaaactttcacttgcacgactattgccatgcatttgaatgaaagcctctaactcgatactgatcgagtatttaaccaactcaaccaacatcttaatctggtggtggaagccctaggatatgttatatactcgattagacaccatgtagagtatctagttatcactgatgttgtggcatagtatcttcagggaatgtattagtatctgtcaacaataataatgtaacagatcggccggatctgttaccgaaagtgatagtttggacaattcgagtctgcccaataactcccaaaagaactaattcttattattcactattcaaaaactaatgaattattacaagggtgaccctatatatagcctaagcccctaaaagacaattaaaagaaaactactattctaagtacaaaatatcaagactaattaatatgaaaagacgataatgcccgtggacccttagacccgagtcatgacaatacccaccgcctgaaattccaccttgtcctcaaggtggatgaaaattaaccttgtatgtctaggagtttgtcttcgaatgtgttccacccattattaccgtgtagaattccaactttggtctttgcaaattgaaggttttgaagagatggttagaagaagtgaatgggctgagaaaatatggagtgatgatatcttttaatgggctgaaaacccaaaaaaatgaaatttaagtgtgtaaaatggcccaaattctgatcctgcaggaagtcatcaactttgatgacgtcatcagtgacatcatcctcaagaaacactatgtgccccctcatatcttgctgaaattaccatgtgctttccctcgcagatacccctgaaaaatcaagaaaccctatgcgccccgtcatcagtgacatcatcctcaagaaaccaattgtgaagattcgggggtgagtgaagaaattaaagacaaattagatatgaagtttaaagaagaaatcaagggtacaagtgaggaacacataacagttcatgaagaaaaataccaagaagaatactccaatgtgtgggaaaaggacgaggtgaagtggagcaaaatgggaaagaagcatattgtcagtaacaaaaagaccaacaaaaagtaccagatgaaatatgaagaactacagaaaaaatgggaaacagaaaaagaccgaaaaagaagggaaaaaagaaagaaggtacgaaacagaacacgaaaagaaagtttgtacaaccgccgcatgtggtggcacgtgtagtggcgcctgtggaggttcgtggggaaggccggagaaaggtgggagtaaatggttaccttggaagaaacgcaagaaaaaagagagaaaattagaggagaggaggaaatatcggaaagggcagccgaaaaaagacagagggctcatcggcactgtgagaactgcaaaagtggtcagcaaaagtgggcggttcaccggcgagaggaaggaggagagaaggactgatattttcagagtttcagaaaaggcacatgggcgcctcaaacttcagaccaccggaaatcgaaggtttttcgccggagaattatgggggctaatcggcggcttgagaacctcggagaataccgacaaataccggcaggtagatgtgaatcggcggcatgggatcaacgtcaagaaaaattgtaaaaggaagactaatgttgcttggggttctaaaatggagggtgaggtagggaacttgaagaagactcaaaaaaatcagccaaggaagttaaaggaggcaatcgcgaaacgtggcagtttcgcaggcgacgggaaaacgtc

SEQ ID NO: 1624 - DNA, 2281 bp, Amaranthus palmeri
ctgtaaccactctaccgtcatctatactttatagaagcaaattgttcaaaagatcgcacttttatggccaatttatcaaattctccgggtctgagaaatacccatttgctagaactttccaaaagtttcatattagggctcaattatcttctggcgctacaaaagctagctcttcaactgttgaggcaactaccgagaatgttaattctaaagatcataatgttgtctttgttgctggtgctactggtaaagttggctcacgaactgtaagggagctcttgaagctaggatgccaagttagagctggtgtgaggagtgcacagcgagctgaaagtctggtgcaaagtgttaaacagatgaaggtggacacagatggcacaggtggacgtaaacctatagagatgcttgaaatcgtggaatgtgatctagaaaagcctggtcagattgttccagcgttgggtaatgcttcggtggtcatatgttgtattggagccagtgaaaaggagatttctgacgtgactggaccctatcgtattgattttctggctaccaagaacctcgttgatgcagcaactgccgctaaagttaaccattttatcctggttacttcccttggaacaaacaaatttggatttcctgcagccatccttaatttgttttggggagtcctgtgttggaagaggaaagcggaagaagcattgttagccagtggtctaccctacacaatagtgagaccgggaggtatggaaaggcctacggatagtttcaaggaaactcataacatgactcttgcacaggaggatactttgtttgggggccaagtctctaatctgcaggtggcagaacttttggcgttcatggcacagaatcagaacctttcttactgcaaaacagtggaagtggttgctgaaactactgcacctttaactcctatggctgagctccttgtgaaaatcccttcgaagcgggagaaaccaaaggatcagataccaaaagcccctatgacgtctaaagcctcggttgaaacgagcgcggttattgaaaaaccgtctgaagaaaaattagtggaacaagatgctccatctaagccgattgacgctgaaccagtcaaaagtttcatctccgaggtaccaactgatataactgaaaaggaatcggttcaagataaaagaactattctgggactttatctccgtacacaatgtacgaggacttaaagccaccttcctcaccgtgtccaactgcgcctagtgggccagaaaagaaaattgaatccgatagtacatttcccagtacagcagatatttccgctactgtatcagaaacagaagtcgatactactgagacagttactgtaggagtgcagaaattgcagcctctttctccttataccgcgtatgatgacttaaagccaccttcatcaccgtgtccaactgcccctagtgggcccaaaaagaaagtcgaatctgacggtacagttcccattacggcagatacttccgttactgtttcagaaacagaagctgagactgctacttttgagttgccgaaatttcagccactttctccttacactgcctatgaggatctaaagcctcccagctcgccatgcccatcacctcctggtagttccaataaagaatttccgaagacctcaaatactgataatggtgtaccgaaggtcattgatgaaaccttggaacaagatattcagccacaagaaattcagaagaaatcaatattttaccattcaccattccctgtatatgaagatttcaagcccccgacttcaccaacaccagcagcacctagttcatcagtcactctcaccacctccaatgctgagtctcagatggttagcatgtcaaacaatggcgcacctgaacctgcggaagcacagaatactgtttatgagcaaatttctatacaaccaaagccgagaccacaatctccatatactatgtatgaggacatgaagccaccaacgagtcccacgccatcagctgggaatcagtaaatcttcaagtgtggattatgtcttgcttaacgaaggatcgctaacacccgagtgaaattcagtcatcatttccatcgtgatgaaacgaatttgcttgcgacttcaatttctattggaatttgccattgaatttttggaattgcaatttgtagtttgagcagttcattcggtatctgttcatgagagcatgtcaaattttagtggagcttcttcttattatgaagttttgtattgtgtactcaagcttcaataataaatgatctc

SEQ ID NO: 1625 - DNA, 8605 bp, Amaranthus palmeri
acatctatcatatccaaaaccctaacatatactatatataccggcgcatccaagaagcaaaaggagcgagaaaccctaaaagcaagcagcagtcgagaagcgagaacagcaatgggtaaattaatctttctttttcttgttgtaagaacatttgtttgcttttgaattacttaaaattcgattattttgtggttgaataagttgtgatgattatgaatatgtaggtaaggttcatggatcattggctcgtgccggaaaggtgagagggcaaaccccaaaagtggctaagcaagacaagaagaagaagccccgtggtcgcgctcacaagcgtatgcaatacaaccgccgtttcgttactgccggtaattcaatcggatttttttgttcatttggttcaaattttcgattaactagcattgagatccatttataaatggaattgaatgattgagattagcagagtaattctatcagtaagtgggtatttattttttgttgtatcatattcatggggttttttttggttctgctgaaatttacaagagaagaatttgtcgtattttttttgctgggtggtcgtttttcacccgttgggaatctaattcattgagtatagaattagaatgatgtagccgctagttggctttgatttaactatgggtccttgaaattgatcatactaattagaaaaaaaaaataaaaattggaggagccataaaaatttttcaattaatttatatatctaatgttttttcttaaaacaatttttactaaaaaaaattcacttcaatttatagtttacgatggagcttaggcactcttaagccccaatgtgcgtccgccaatggatatagccttgcattcaagattggaaatgttaatcatagagctgttttctttattttccactttatgcttgtttgatcgtgccctcgaacatattgcaatgttacgaatccgttgatattaactttgcaaggtcatgggatattattagcttgagttttactcaaatacacactcaaaatgattaattgcttggtgatttttgttgctgctatgactttaactacattatgtatttaaaatttcacacttttttctctatatggaaaaagatatgtatgtgtatgatgtccttgtatatgtttatttatccttaacaacaaactttactattgggcgttttgtaaattttactttttgcgactttttgggttcgaattcaaattgatggttggactctgcacatggctatctcattctttaggatgactttgtatatcttaggcaatgccagtgatagacctcttcttggagcatacttaacatgaattattatatttcctattaacataggttgtttttatattaatttatgctaataattaataaatcacaatatccatagaaatgaataatttgtgcaagtttaaataatatagtttcagaaatttatgctcttaatttataagggtaatgaatttatcattcattctagtagatagttaaggttgccacaacccggacctgttccaccatacatggctcttgatcggcctgatctaaggattgggttagatatctagcctgggcagattcacgctgcgggctggcagcctggccttgtcaatttttctctttttcatttaaaaaaaaattaacataaataaagaaacaaaaacttaaaaaaaatcctaattctcagtttttctacccctccccctcggcactatctctattgttcgtcagttgatcttcactgtcctccttgaatccttaccagttacaatctctctttctctccttggtcctcctcatcactcacccgcgctcacacccttgatccataaaatactcacctttacccttcttacggtgtatgatactgtcgttgttcccaaaaagacaccttacaaatcattcttgaccttcctttagctatagcgctgtttttaggagaaaacattctagttagcagcccatttgatggtatatcgatgaactagagaatttggatcgaccttgattggatggaggtggaagaaccatttggttaatttgaagaaccttagcacttgagataaaagaagccttttttctcagatttattttaggttttctaatttttgtttcaattttgttcgagttcatttttgtttttagtttttgtaatttgatttatgtatgtttgtttcgctaatatttttgtaatttttgtttttgggctcctcagatattttttttgtagtttttgccttcacaatggttatgtggctatgtaactaggaacgtaaaatgagagtctatatttgaatttcgcacttgtatatgatttgttagttaatttgtggtttaaaacgatagtcatttagtgacttctaatactagcgtaaatgaaatccaaattgattactttttacaatgataaattgcgaaaaagttccaacatgggggaatgaagaggtgaaggtaatcgtaaagaaaaagaaaggatactaatttgcattaggaaaatgcaagaatgtggaaaaccaagggaaatgtagtagatcacatgaccaaattaagtactttgaaagacttgttgacaaactaaattctaaagaaggaaaaatcaaagaggagacgagcaaagactagggttggtgatccaacgtaagaaatcaatccgattatgtttcccaattaggtcttcaaaacactatgaagtcattatataccccttttggtttagagaaaggtcctctagcattcaagtatgttaagaacatttgcatctgtattgttgttggaagcatctattgatatgatagttttccatatagagtctatggatataagatgtaaaagactccatttctcaatgattggcggcgataagcgataaggtttctcaattgggttcctagtattctttataacggtttgtgagtcaatgggtagtagactcggttacatcttatatccaccgacttcgtatatgtttggtaaacttcttatactcaaattctgaatgctgacttataatgatgcattaattttcagttgttggattcggcaagaagagaggaccaaactcatcggagaagtaaggataagtgctgcggcaactatgtcacttgctgggatacccttcttgcagctctttttttagaatcgttttagtaatgaacctttttgtatgcttaaaccactcttctttttggtgtttacgagctcgtctagtatttgtttcttatctttgaattatgtagtctgaatgaaatatggagatgatcttagtattgttttatttagagtgataattttgcagccattctggtgagctgcaaataaacactatgtcttatgtttcaccaagggatagctatctaaagcttttgtgctgatgattctaatctaacttgtgaaaatggtgctcgctctttctccctttcaagtcatcaatggccgaaagctcgtagccgcttacagttctgtttgttactcggccatggaacatagcattatgatcatgggcgctaacaatgggctaatcaaatcaaatcggaaaatttaggacctgtgtcttatgcttattacgccaaatttttccgttttgatatgatgggtgacgttttaaacttgtaacgttggctctaataccaattaactcctctaaaagcacaattgacaagtaaatagttaaagttcgagaatatatactcttatcatttggccttgtgttcttgcgcaaggcaagatctaggactttttttttcctctcatagagtgcataactgagttttttttaatttaggactaatgtttgaaatctgtaggaacagtaataggcttttggtgttctgagctcttaaaatcatatagaaagaatgaggaaaggagactggtaagggagaaggataacgagaatcaaattcaagaccttacgtggagaaaatggtatatatttcaactgaaacaagatctgattcataggaaacacatttaagaggggtaaattccatggtaacaattgtgatagaaggaaggtggtggctttcatttgtagaacaaacaaatattgtgtggaagtgagaataaaatagtgacgccaaatggggaataaggcttcattccaaaggaatataggattcacaaacaagcaactaaggctctagttatgtcatatacagggtgtctgatcacatagagccgaattcgtttattagttgcaaaaagaatataggattgacaaaccaactaccatggctctatgtataacatatataaagtgttcgttcgcgtagaaaacctaaaattacgtagctttaaatattagttgacattagtttaactacttgtttttaggccttaaaattagatgaaaaaaatactccaaagtaaacatgacttgggtattttactctgcccttttacttgaatgaaggtatgcaaataaatttgtattcaactatagctacaaagtatggtttatacaaagacaaccaacccttttagtgttggtagtgtatactgtatacatacattcatcttgtaaattattttgtttcaagggccaattctggcttcacaatcaacccaatatgaagggatctcatggtcctttacagtcggtctctcaagagaacacctgtttttttattgcttgatgtaaaattataaattatcaggaataaaaaacgtttgtgcatagctcatagcccacactctaggaataaccggggatgatttttaaacttcaaatcagaagatcaaatcaaagtattcatgaaaataatctttttttgttttcaattgatcatgaaaaacattagccataatatataaaataagtttgaacgataaatattgtcaataactgtaataaagcaagtgttttaaaacggagaaagtatcatatataattgagatttttataaaaaaggattagaaatgaaaagggtgaataaagaaaagagggaaattatcatttaatctaaaaaattcttctatttatttaaaaaaaaattttgttttcttatggcaattaacatagtgggagcttcattcgggtcatcgagttgatttcgggttaggtgttttgggtcggtttaaaatcggattttatgttcacattggtttttacataattaattaattatagattcatttttaagtcgggtcaaatcgaattcgtttataaagtcgggtgtctatcgaatcattgggtatgttttgaacaactctagtgggagccttaagttaagtggcccaaatagaattggggtagttggtctcatccacaaatctaaagatttaatttatccgccaatcatcttgaatcttgatcaattttttatgctttgaaattatcagtgtatattttatgtgactcaaaacagcgggaaacccaacaatatgcaaattcctcttccattttctggtaatatggagcttcattctttacaatgttcatcttctcctgtaaccactctaccgtcatctatactttatagaagcaaattgttcaaaagatcgcatttttatggccagtttatcaaattctccgggtctgagaaatacccatttgctagaactttccaaaagtttcatattagggctcaattatcttctggtatggttttattttgttttatttcttttattgaaatgtgggtttttgtcccttaaaatcgaaataagggttttgctttttatttttatttttttaaaattgattgcttaaagtcctgctctttaatattgttatttgggttgggttttatggaattttatggtgaaaattagatacattgggtattgttttgagttttaagattaagatgcctttgagtattttgcatttatattgagtgatttaattgagattagagtaatttgtacgatcattaagattagagaagatttgatttagtggaaaaaaatgttgaacagatagttgagaatggggattattggcccgtttggtaggtggtaataaagggtggtaatggaaatgaaaaaacagtgtaattttggttgaaatatctcttgactaccttgatggtcatgcttgtccaacttaaatcatcttattttcttcataaaattcattctaatgcattatcatttgagaggtggtataaggtggtaatggaaatttataaacagaaaaacaatttttataatcaaagtttcattaccatgagaatgatatggaactttgatgaaattttaccctataaatcattctcattaccaccatttagtactactaatcaaacatgccgtatatccttttgggtttgggaagtagggtttattgttggggagtggggaattgtgcaaattatgtgatcaaggatgaattttttttaggaaaatgattcaatggaatgaggccatatgataattggagttaggttgccttcatttagggcttgttttcttgacttattagaatgggctttgtaagtagtgattgtgagaaaatggtggcctccattgaaccagaactggactctatagaaatgagtatcatcatcatcatcataataggtatataccgctcgtagaagctatgatcggggtgtggagagatggaggacgtctgaccatacccttttcaaactatacaaaagtgaatatagttgaaccaaatcggacttaaaaatccttattagagtcacagtaatagaatgtgtctaatccacacccgatattgttccatttccaagtattggatcaaatctcctagtgatagtctttgtctggatttgtctaattttcttactaggattaataatatgccgatgaattttcattgtgagctccaagattcctgtttatagaagttgaggcaaagctttaatcggaatcaaatcctgatgtgttcgaactcacatattcatgtttaatccatcttcgcggaagattttcttattgttataaatcaaatgtgcaattgtatgttttttaggcgctacaaaagctagctcttcaactgttgaggcaactaccgagaatgttaattctaaagatcataatgttgtctttgttgctggtgctactggtaaagttggctcacgaactgtaaggtcagaaactataagtcaatgtcataagactcggtttagatatttattttgaatataactttgtgaatatgtggtctgagtgtctaaagagttggtcactttctccagggagctcttgaagctaggatgccaagttagagctggtgtgaggagtgcacagcgagctgaaagtctggtgcaagtacgttttcctcttttccgagagatactttttagatcctagtggagtgtccgtcttttcctcccctttttatgggtgatgctacaacaaatataaaagtaattaattccttgtttggttattggtattaactgttgggaataaaaatgtaaatataatgttatttaggttggaaaattaatcaataaggtttctgttcatacttgtcaaacattttggagaagatattttacaattataggggtttagcttgatgaagtttagcagttttcttctttatatcgtgccttaactctacaacggttgcttttatgattgtttccagagtgttaaacagatgaaggtggacacagatggcacaggtggacgtaaacgtaagtgaaatataatttttgctataataacagattaccaggcctgcaataataacagattccttttggtgtttagcccagctatagagatgcttgaaatcgtggaatgtgatctagaaaagcctggtcagattgttccagcgttgggtaatgcttcggtggtcatatgttgtattggagccagtgaaaaggaaatttctgacgtgactggaccctatcgtattgattttctggctaccaagaacctcgttgatgcaggcaagtcagcaattgagttgatgaactttgggtttaactttgtcatttctcatgcacgtgaatcgtgataatttcttaatgaacctcttgctgcttatacattcgtaaatttttgagaattgaacgtatggaacttataaacttacggtagccaattccagtgagtgtctagtatacgcttgaataagtacctgtaatatcgtattgaccatttgtacctacaatgtgaaatcagtgccgaccctgacaatttttgggttctaggtgaaaaattaaaaaaaggcccttgtataagtgaaattttcggtttttttctccaactatgcattatataatttcttttttccattacatcaatgtcaaacaaatatatgaatttaagatcacataatgataaggtacaaaaatataattaaaaaattgatttttaataataaggattaacttaatttgggcctcttcataagctaggccctgggcaattgcacctcaaaactacccctatgaaaggccttgcatgaaatccatgcagcacgcgatcaaagagcgaatgtttttttagaaattgagagatttttctttatgtcaaagttaggttgaagctatttctgttcttgtcgatattctaaaagacatgattcactgtacgaaactttagttgatgatacacttttatcttatctgacgtgcagcaaccgccgctaaagtta

SEQ ID NO: 1626 - DNA, 12347 bp, Amaranthus palmeri
ttcatataataattaattacatatataatattaataattgtttatttaaataattaataaaccgtgtttatcacgggaatctatctagttgatactaacccatcacttatcagtacaaaaatcatccctttttcacattttccataaatgcttgttataagttccaaaagacatgcccttgtttcacaaatcagtaagctattaaatttgaaaaacaaaaaaaaaatcgctggttttaattttaatactccttaaaatctagacccctaataactccaaccatctaaatcgattgaagaataatgaacaaacaaaaatatccaccaaaaaaatacatgaaatcaaaaaaactcaaaaattaacagttgcgcagctgcctcaacaatcaataactaaacctaaatattccaatcaaaagaaaaaaaagagagaacagactacctttcacaggcaaaatcgatattggccgagaaaaccctaattcaataaatcaaaaattaatgaagcttattcggctgcaacgaattaaatattgtacaggaggaatagaagagaaaaacggatatttggtgagaaattggattcaaattgaaggaaaaacagttgagatttaggatcgaatgaaaaggtgaaattgaagggttagttaaaagtctaagaacaaggaggagaaagttgctttttcggctacggaaaacacaaagacacaacaaattaggaccaatttgttcgcgttttagattttgccacgtttcattttattttatttaatcccaagatttaatattttaattacaattattacaaatcttcaaaaaaaaaattacaattacaaatacaaaaaaaagttacagtgaaaatcgaattcataacttgctatgattgattcgaatgatgatttttacttacacaaatttttgtaatagacaatctatttgatagatcatctttagttacgctgacctaatatatatttttgtttgaaatattataactaaacattaaaaatgatgtaagtagacatgtaagatattgtgaataagtattaaggatacattaatcaggcatcaaaaataatgtatggcattaagtttttaatggtttgggtttgagagacgtttctcaaataaaaataaaagagaagatcttagtaaataatggttaattgcgaagtttgcaaatttgtcttatgttgtcggatttaatagggtgagagttttgttatttttggtttaccttttttcgttttttattttgttattatttttttgtattttatggttatttacaaatcacgatgattgattagggatttttaaaattttaaacattatcaaataattgcatgcgcacaagaagctgaaataaaatcaccgcaagaaatcataccaaaaacctttttaccgtttgagcatcctgcaacaagctaaaaatcaacgcaataaaacaaggttaccaaacaagatatttttatactactaaaaaaatagttgtactagatagtctttgagtcaaacacatataaattataaaaatataaacttattattttgaaaccgtttcactaaaaaagaatttctcacaaacaactaatttttatatttattaggaaaaattatcaaaaagtatccaatagaaaaatttttcaaaaagtacctaataaaaaagtgttgtcaaaaaatacctaacaattttttttcttttccaaagagtaccatgtaacattttcctttagttaaccgttaaatataacggttgactggtcaaaatcgaaagttttcttcctcatctccaatatcttttccaatttaacttcgattttgagtaagtatagaaagaagacactgaggaaaataaattagtgataagaaagcaaaattttcgattttgattagtcaaccgtcatatttgacgttcaattgaaggaacacgttaattggtgctctttggaaaaaaaagttttgttaggtattttttgacaaaacttcaattaatagatatttaaaaaaaatattaaatactttttaacactttttcctattatattaaatatatccgatttttgacgtcattaatggtaattaatgaggaaagatatacctatacaaatatgacgtttaggtgcgtatattgtagtttgtggtttgtggtttgtggatcctacattcccatttcctactatacatttctagatgtagtgcacaacgagatgaaaaagagtaacatgttggttcgtgaacattttaaaataaaatgcgaaaaaatattaaaaaatttatgtttttttttattatttagagttcttatgtaaaattttaaatttttttctaattttaaattaatgttcaatttatttttttggtggattacgtattataacatgtcatcaggttaccaagtttactcttgacaaataccccttaaatttgggattattcgtgattaatcaatatgtgtgattaatcacgaataggttgaattattctaggtaaattttttctctattttatggtactatatacttcctctgttttttttaataggagtaattgctatagttatattttgtaagatttttccacatagtaacatccagtttatgccttatgtaactgtcatagcatttttcgttaaatggcgaattaaacgtcaaaatgacatgttaaacatttgagagcataaaaatcatcatcatcatcaactcaatatcccgctcgaaaacagggtatgggtgaaggaatgtgacggacaatccatacccgcactcctttgggagggaatgctagaggaacgtggtcaattttaccccctgaaaagagagagccctacatagagagaaaaaggctaacattgttgcttttttttttttttttgaaaatggctaacattgttgcttaaatgtcaaaaactataatgatttaggtcaaattataaagacaacatcacttaataaggatagaaatgtcaaaatggtgaattaaacgaaaattgacaagaattttaacagaaaatgctacggtagttagataaggcataaaatggatgctagcatatgaaaaatccttacaaaagtactaccactgacatttcatgaatatttgatgctaccatgtgtaatgtccccaaattctaaaaagttaagactattatgaaaatatgtatcaaaacgaatcaaataagatcttactctactatgttttacattatacatgtagaaatatatatcaaataagacaagttgatgagcaatatttgttacaaaaaactgtagtaactattaacatctagaggagtgcccttctcgagccgaggaactctttgatcgcactctcctttatagatatgagttgccgtcgtttttctctccccaaaccatgagcttagtcttctatgagcggaatacacccccatttggtagatggtaataaacgatgttaatgggaatgaaaaatctagtgtaatttcgattgaaaatatcttagctactttaatgtccatgtttttccaacttcagccatctcattttcttcataaaattaattccaatgcattaccttcgggagatgtggatgtggtactaggtggtaatgaaactttgtatacaaaaaaacattttgtgatcaaagtttcattagcgtgagaatgatatgaaactttgataaaaatttacactataatccatttccattaccaacatataataccacctaccaaacgggtcattagtacgatgatcatgaattcatgataaagtttaacaaataattcaaataaaaccaaccattaacaagtggcaaaaaatatcaagacaagatgaaagcataattcctagtctaagactaagcaaagttgtgtggcaattgcacaatgagcgtagtgatttagtgcaaactcacaaaatccatggctatctccttcacgaaatcatgggtttccatcttgaatactcgttcaatttctaaaaccattccatcttttccagtctataaaacccactcatcatcgttttctgtgagagcaaacaaggtaaatcaagggttcgcttaatttctgtcgcaaatcaactcaaaatgtaaatttcaaattacccagatgcttaatttgatactttatgttgctaattttagtaattgatgtcgaattttgatgttctgttgtgtgtttgtgttgttttagatggaagaaagtgaaattaaggagggtggaggagaaggaatgagtacccagaagaagatatttgttgcaggagctactggaaatactggtaaaagaattgttgagcagttattgggaaagggtttctctgttaaggctggagttcgtgatattgacaaggctaaaaccatgttttctgataatccttctcttcaaattgttagtactcttcttaattttggcctgaaattcttttttatatattgtaatgtgaattattcctctcattgaagcgtagttttttgatttggggtagactcgagaatcctatgtgtaagaggagaggaagaagatcattttgatccttcatgtaggcggttagaatcaaacctttgttacagggtgaaaagaaaagccttcagccgctagacttacccatgattctctttaatgaagcaatttaatgggacagggaattgtaatgaaaaatttgtggcttcaagtgaaagcattataggttaagcaattattatgaagcatatgtatggagtaagagtgtgtttggataacattgaggaagtaaaagaaggggaatggagggaaggaaagggtggtgggttttcattctagaattttttattggaattcttaacgacccatctggttagtggtactaaacagtggtaatggaatgatttatagcgtaaaatttttatcattctcattgtgatgaaacttctctttacaaatttccattatcagttaataccatctctctcaatgttaataattgaaatgaattttatgaagaaaataagatgattgaagttggataagcatgccatcaagttagccaagagtttttccagccaaaattacactagttttcattcccattactaccgtttaataccaataccacctaccaaatgggccgtaaagggattagtttcttacaaaatttaatgaatacacccctttaaatcctaccctctccattgttgtgtgacattttagtagcttgagccttctgttaacattctgtcaaaatgaagttagacttttaagctgggatggaagcatagcatttagtggattatctgctaaggttcgaggatcaggcctatttcttagatgctaaaatgtattcgtcgatttttacagattaaagccgatgttactgagaatgcagagaagctagctgaagccataagtgatgattcagaggctctaatttgtgcaacaggctttcaacgctcctgggatcctcttgctccttggaaggttcggaaaaatattctttcatatcttcaactgctatgttctttctttctcaattagctgttttagcaactgtaacgttggaaagccaatcggtgtatgcttctcgatcatactctcgaatcttctcactgggcaccatgttccatctagaatagttgtttcggtatctttcaatctgtcttaaaaccgcgtatctttgatagtgacatatgtgcaacaacgacaattgctgctgctacttattcattgcattcaaacgctaggtcgttttcccaatactccataattcgacaaggcacatttccccctaggccagtcctaagtacaggccgggtagctgaccggctaggaccccctgaaataataggcgccttaaatactaaataatgctattcgagcctagtgatttgtttataaattttttttatatatttgaagtaattttggaatataatgttatacaatacattttatcttgaattattttcgtgaagtggaaaattttttattttttgatacaatgaagggcccattcctctaaaatctttgctccatccatgatttcccctttagtgacctactcaaaatgtaattgcgcacacaggtcgattattatggaacgctaaaccttgttgaagcatgtcgcaagcgcggtgtcaagaggtttattctcatcagttccattctagtcaatggtgcagccatgggacagttgcttaatccagcctacatcattcttaatgtatttggactcgtactaattgccaagctacaggccgagaattacatcagaaaatcgggtataaactacactattattcgccctggtggtctgagaaacgatcctccttctggaaacatcgtcatggagccagaggtgattttttcccctcgtttttccccttcgtgtaatttttcgttgacagttgtttaattgtgcgggtactaaatgtgcatcaaattttctacatcttttcgtaggatacactttccggaggcagtatatcgagagatcaagttgccgaagttgctgttgaggcgttgattcatcccgaggcttcttacaaagtagtagagataattgctagttcggatgctcctaaacgttcattcgaagaattatttggtgcgataaagcaacggtgattcatttacattacttgtatatggtgtgacaaattttattcatttgaacaaaaaatttctatgtgctttccaccaattgctgaaacttgatttcaaatagttcatgtctgaattattaagtttcatttgcatgcctgtgcctctaataattgtaatcaagctttattattataagtaacctgaaaacaaaagcaaagaaaagaaaaaacagagaatttcagaacattgaagggtgaaacgtggaactttacccagtacagaacggtatagaatcgcgattctaaacatttaacataatgtttatcgccccgtacataacggtatagaatcctagccctgcttgttttgtgtttgaaggtaacttctcccacgttatcttggtgttacccatttctcattttatggggctctcactacctgggggtttaatctgattgtacgcatttatccatcccttttcctcgagggagtacaagtatgatttgcatgccacctctccccccggactctgactttgtggggggacactgggcagatgaccatgaccagacctatatggtcatattatgctcttcttttgtgatatagagttttgatttatgattagttttgtggttatatttcctacttatgatcaatgtatttagacaacgtcatggcctatctcaagtttccgaaacacaggattaaattttttttttcgttttgtcatctcctttcttgtatggaatcaaatttcgttttgggtaacattataccagaatcaagagaacaaaatgaagtgaaatgaacatatactgataaagtgataagtcatagaagaatgttgatgttaagaaagatacagagaactgaaactactacaaatcatgggaactaattgggaattgatttaagaacttagaagaggcaagctgctaaagaagcaataacagcaaccaagcccgaaactcgtagagtcgcaccagcgctctgcattgacggagttggagcaatacttgtagcatcttcgacaacatctgctgccccaatgccggaaactaatgagaaaattactatgatcgcgacaacgaaggattttattttgattgttttgctaaaaatagaaagtttctgaaacacaaattggaacagacagacagaataggaaggtttttttggttctacttgtttgggcagtttttatagtgtaagtatagttataaacaaatgtaatttgccagaaaattgtgaattaatgtgtatattgtttggcacaggctggacaagggttataagaagtatgttatgacatttattaggttattcttcttttcggctataatgtccgttatttctatgacgccaaagattaaatttttatcaaatcacatacactttttattatgtgaagttgtacatgacggttgctaccaaaggttagacagtctcatacaagactggatgtaatcagaatcaactttttgttagttttatcaccaataagagtaaagttgcgtgcatccgtcattctcaaaccccatcttaggcggaagccacttaatatgatattgtctgtttaatattaaatgtttgtcttttcttcggaggcaaacattagaaattaagattttacaattttaaattttaaagatcaataaaatgcaaggatattgaaggccattttactagcctgatagttcaaatcaagtttttctactatattatgtacatttgcagaacttcctacaatgaaaatcactaaacatcaacattatcgccattgatataaataatgtccgaaatcatgtaaacgcaagtgcaaaaacagacggtgggtgaaagcaccttgtgttcttcgatcaaaattcgttcacggccaagaaacaaattactttacacgcgattataaatcttcatcgagcaatttcacgtgcagtgaatatcatttgctcttcacgtctcatgatagtgatgcctgtggctaataacgttacctcgtaagtcacactccatacaaattcaatggaagtggaagacaaggaagctcgcaccaacattttcagttatgttgccaaactttaggcaagcttcggaagaaacttaataacatagcaacagtcaagtgagcaggcgccagccaaccagcaaaaatgggaaaattccacggcctgcacaagtcgagttaagtttggtcttgttttgatgcagttgcagcagacttcaacttctctagttgttttcgaatgtaagcctgtctaagcttctctcgacgagcggttgcttgttcttgcctgcgtaacttgagttcggaagccttttctcgggcttgattcacctcttcatgaacttccctaaaagttcaaatcgaaaagatgcgtaaattcataagtttagcataaatttataaaacaatcatgtgctatggccgggtagcatcaaaaccgaacattaatgcagtctatgttcaaattgtaccagcaaatttcccattcgaatcttaaatcaaataacactccaaggtatcaagagcaacaaaagatgttctaaaagtctaaaatcaaacaaggggatccaatcttcatgctctacggattatccatcccaaatgtgaatggatgtattgccccactaagttaacatctatatgctgatcaattctatctctccattcatccgttcttgtaatgtttagcccgttttaaatagccgaaaatgcttggtcgttcttcattataatacttcctccgttccaaagtagttgaacattagaaaaataacactattcattcatcactcttaattcatgattagtttttaatctctaagttaaaatatagtcgagtgagatcttgtttaattcgtctcttgcaaagattattaatatcaaatttttatattttttgttatacataactgcaaaaaaaaaatattttttgttatacataattaaagatattaagaatttaattattagcattggagtgcgtaaaaaagccaacgttgcaagtaaattgaaacggaggaagtaaaatgatacccttttcttcctttactcacatactcaaatttgaactttaaggatcgaaatactcggaatattccacaatggctaataccttatagaaaacctaagtgtattctatctatttcaattcatttcttctgatcctagtgtaaatcataaatagatagataagtaaatttgtcaaatggatgtcacaaaagaaaagtacttctaaaaaaaccctgaaaacataaatataaaactccgaaagatagcgactaacctgacaaagcgtttgtgctcatcgatgtcaacagttccagtagtacgccccaaacctatgggcttggtattgaacggaataaaatcatcatgctcaccattttccgtttcaggtactttaccagaagatgaagcattagcttgctggttacgaactccatcttcatcttgacccttgcggaaaaaatcaacacaatacttctcattatcctcctcatctggaagctcgcccctggaaagtttttcatataactccgcctttttctctaatgctgcatagctagcagaaccatcacttacagccttgagtgcaagcttatccctataacaacgttaaggaaatgatcgtaagccaactgaaataatatataagcatcaacggaaaaactgagaattacataagcaaaaaggtccattagcagcaaaaattgtaggaacccaaattgttataatcttagaacttccttttgaactcatcatatcaacaccagcattgcagcaaggcctataaatttattcttttaggggttgcttggattgagagtaaatatttaagggtaaataaaagtcaaactaataaaacaaagttagttaaatgatttaaggaatttgattgttaaacaggaggaagaattaagtaacgaaagttggagaaataacaattagttcccttattttgggtaccctagggagggtgatgaattctttaccccaagtgagggaaatcaacctcttttttattcatcttttttaatttactctcgtctacttctatcataattatttcaataacctcatttgcatctctaattgcctttgttccattagtttaacgtttttacccccttgaatagtaactctcaatcaagccacccctaagaagaacacatttatagtaggaagtgtaatgctctaaactagttgcagcactaattgcctagcagatcatgaactgaaaaaggcgaattatggtaggttttaggctatttttttatcaattgagtgaatcgcgaatccaagggcgaactgactagcgaattatgtttcactggtactctcaaataggcaactacttggacaatcacaaatgaaatttaactattggaaccccagtagtcaacctaggtaattagcattattccataaccatggcaattggaaaattgaatccaattgtccacattgaagacaatttataggaattcttgccatcttaacatgtatgatgtattatatactagtttttagcctctactaatttgtttggctctataaagtaatgacatgctcttccctaaaaccttataatcttgaaagcttcagcttcaccaatccatccaacaccgaagcatcgatacggaatcgagctacttctaacaattcaaagtgactataatgaacataatctttgttaaaatatccctagaatctagaaaccttcaagttactacactaaaccttcttcccatgaccccaaattttaaactcttacttcccaatccctaattctacaacataaaccctaattagaccaatatatacagatagcaatcattcaatctcaactaaaatcagcattctaaaattttgctgataacatttggatcaatgggtaccaatccttgcattccatttcaaccgttttacaaattcaataaactcccaacaactgttcttctgatatactataaatcaatctaatcaaacctagaattaacatgggtatcttaatagaaaacaaaaatccacaattggtcatcagaacctaacaacccacaaaaattaaatgaccgaaatgcaaaaacgaggatagagaaggagaaattactgatgagcacgagaatcaacgcctgaatttttgcgaagaaaagggtcattcgaagagaccttgttcttggcacggtggtattcaacatcagttccagaaagttctttcgatttcttggcttcttcctgggatttgtagagttcagccttgagttctaagattgaagatgcaccaactccttcaatggctttatgctttttgggcataatagtggattcagtgagccatcctagagattcaactactaccctctttctcttttcttcttcttcccccatttcgcttctctttgtcaatcttcactgcagatcaaaaatggggattatctcttcgtttgggctttaaagaagtttcataaattaatcaacaattagcatgatttttttttatttttccccttaaaacttaatataatgtggtaaaataaattctgaaatccctaatttaccctaaataaattttttattccggactggtagtattattttaaaaaatttaaaagcaaataaaatctttaaatattgtatataattacttctgaaaattcagtacactagtaaatattaccaataaatctcataatttataaaatttcaaggttttcaaattttcatttcatctagtataatgactagctttaaaacatgcttataatgtcttagaaag

SEQ ID NO: 1627 - DNA, 7193 bp, Amaranthus palmeri
gcagaagactacatgttactctattttgtcaaatgaccggcatgtttaacgtttgaccaggtagtcttttgcaaagaaatgcattatgtaaggtggtttttgcaaagaaatgcattacgtaagatggtttttgcaattgcacatgctggtcaaatgttaaatatgccggtcaactgacgaaatagagtaataggtagtcttttgcaaagaaatgcattatgtaaggtggttttttgaaaaaagtttatataaggtagttttttaaaaaagagtgtatagattaggtggttttatataatttttccttaaaaaattgatttttaataattaacttaatttgggccccttcatgagctaggccctgggcaattgcacctcaaaactacccctaaaagccttgcatgaaatccatgcagcatgcgatcaaagagcgaatgtttctttagaaattaaaggattttctttatgtcaaagttaggttgaagctattattgttcttgtcgatatgtaaaagacatgattcactatacgaaactttagttgatgatacacttttatcttatctgacgtgcagcaactgccgctaaagttaaccattttatcctggttacttcccttggaacaaacaaatttggatttcctgcagccatccttaagtaagaaaactagttgatgcgttcacgacaattttcaaatacttcaactttaaaaaatcgatgtacgacatattgatcttggaagtatctttgttccttagtttgttttggggagtcctgtgttggaagaggaaagcggaagaagcattgttagccagtggtctaccctacacagtgagtgcttgcaatattaggcatgctattttatgtcactcgttattagggccctcccttttatttttgggccctaaagcaaaagataaaaaggccctaaaaacttaacacgtaataaataatataatactctactctactgtcttttatttttgatatttgaatgactattaaaaatacattaataactcattacttagcataaaatgtgaattgttttcaattttaattcaaccttgtacatgaaattaaaatttttggatcctaaaagattggggctgtgggcgatagcttgctttgccctttctaatcgacggctatgctcgttatttgctaactgtatgcatattttttctagatagtgagaccgggaggtatggaaaggcctacagatagtttcaaggaaactcataacatgactcttgcacaggaggatactttgtttgggggccaagtctctaatctgcaggtatatcaatcgtataacaacaccccattgccccaattccaagtagctcccgccttggggatgtatattaatcgtagttctcgtaaaagtttcaaacttttagttatatcaatttgaacaaaaatatggtattgcatggataatcaatttttatcagttaagcgtaggtggcagaacttttggcgttcatggcacagaatcagaacctttcttactgcaaaacagtggaagtggttgctgaaactactgcacctttaactcctatggctgagctccttgtgaaaatcccttcaaaacgggagaaaccaaaggtaaaatcccatccactcaacaaacatcaaaaaagaaaattgtgaaaagaataaatctgaaatgaatactcgaaaagttatctgtcaaaactacaaaatcaagcattgatgtccaagaggttttaccagtgtaacatgattcgctttttgaatttgcgattcactcaaatctgcccaagaatagcccaaaactgaccataattcggttttttccgattcacgaggagattagcaaatcatgtgacactggtttttacagtagtatgaatgattaatgagcaacctctttgcctagcgctagttatttgggtgagaaacaaatttatggtgtacgtgtaggattacttcgaacaaaagttttgggcacggtttgaggaaattgtaattgttatccaagggacaaagatgatatttttcttttccttttttttcaatttcctgtcaccccttagcatctgatttttctatagaacttgtgtaacacccgaatttcctcctatccgttgtggtttttgtttcgtataaggggtctaaaaaccaaaaccgcaaaggacataaggaaattcgggtgttacagcttgttttggagggatgagggattagctttctcaactcaaagagatgattggggtaagattttttttttgcaggatcagataccaaaagcccctatgatgtctaaagcctcggttgaaacgagcgcagttattgaaaaaccgtctgaagaaaaattagtggcaagctcttgggtttctgtctctcatctgttattggtagtttttccagtcatcttcatagccatagtttcatttgcaggaacacgatgctccatctaagccgattggcgctgaacaagtcaaaagtttcatttccgaggtaccaactgatataactgcaaaggaatcggttcaagataaaagaactacttctgggactttatctccatacacaatgtaagctaattatatcacatcataaggactagtagttgatatgattgctgaaagcattactgtattgttaagaatcgtacatcagttgaaacaacccaaatcttgatcacatttagtgaaaaatttatttataacaatctgatagtatcttgaggtttacggatcttaggtcgaaataactcgagtaataaacgtcttttgctttgctagaaaatgtattttattaaagatgattaagactcgggctgtttcatcagtactgtgtggaatcctcgggtgtagaaagcaacacatgaggagcacaatcagttttgagaaaacgagaaatgaagggaaactatcctacgagttaataatggttcatttcttgcttagggatttccatggcctctcgcgtatagggaagaagctaagcaccgtataatttacaaagtgcatataaatattcagattaaggctttgaatagagatagagaatccatgtggatgatcattggaactgatatattggttcatgtagccgtcccaatcttttgggattatggctctaacatcgttgtcgttgtatataactattcggattcagtgcatgagagaaacaccaagttatatcattccttcatcatctaacttgctttagaatttgatcttatcgatgatcaacttttcaggtacgaggacttaaagccaccttcctcaccgtgtccaactgcgcctggtgggccagaaaagaaagttgaatccgagagtacatttcccagtacagcagatatttccgctactgtatcagaaacagaagtcgatactactgagacagttacagtaggagtgcagagattgcagcctctttctccttataccgcgtaagatacaactcattgtatctggcttatggattttcacgggctgagactgtataatttataaagtgcatataacttttcgattttagtgtatgaacgaaacaccaaattataccattccttcatcatctaacttgctttagattttgatcctatcgatgatcaacttttcaggtacgaggacttaaagccgccttcctcaccgtgtccaattgcgcctagtgggccggaaaagaaaattgattccgatagtacagttcccagtacagcagatattcctgctattgtttcagaaacagaagtcaatactgctaagacagctacagtagaattgcagaaattgcagcctctttctccttataccgcgtaagttataattcattgtatctggcttatggattttcacggcctctcatatgtatagagaggaaaaataagcatatttcttcccaaattcaaatagaagtaaaaccagttgagactgtttgattcataaagtgcatataacttttcggttttagtgtatgagcgaaacaccaagttatatcattccttcatctatcttgctctagatattgaatctatttatgattttcttttcaggtatgatgacttaaagccaccttcatcaccgtgtccaactgcccctagtgggcccgaaaaggaaatcgaatctgacggtacagttcccattacggcagatacttccgttactgtttcagaaacagaagctgatactgctgagacagctacttttgagttgccgaaatttcagccactttctccttacactgcgtaagttatagctcattgtagtgtcacacgatacactaatctccccacaaactgcaaatcaaaaaagtgaactatggtcggttttgggctattttgggccattatgagtaattcgtgaattttaaagacgaatcatgttacacttcctcattgtatctggcttatgctaacgaaattgcgcttgacgtttttgctttgtgaatagctatgaggatctaaagcctcccagctcaccatgcccatcacctcctggtagttccaataaagaatttccgaagacctcaaatactgataatggtgtaccgaaggtcattgatgaaaccttggaacaagatattcagccacaagaaattcagaagaaatcaataatttaccattcaccattccctgtgtaagtctctacaaccacatgtttatactatttgaggatgacatttgcgattgacatcaaagttttaccaaagttccctttatctagccgtgtaattgtattccttcatttacttcaaatcgagggaaccattttagaaaggcacaattctcaaacaatttgcatggatgttgcgtgtatttccaataatccgtaaatgagaagccataaaatttacttaaaatcgagggaaccattgctcatagccggtttaggagtcttattagctttccttctatcttcttgtttttttaatttcttgtatgggttgtcgttcctcctttgcacatgaagagtgcgtagactcaacccttcctaaaaggtggggtctcctttatactgatgcactgtcaaggggtgttgatttccttccgttggtgtttgtaattgactttgtttggtgcaatggaaattctttttttatcccaaaagaaatttaaaaaggcacaattttctaaactccaaaatagtgtgagtttgtgattatactgtaaacaaaacgagtatttggtaattgagagttttcatacgttttgataccatttcaagaaccaaatttccaaagatgatgaaagccatcaagcacgcatttcttgaattacgcagccacatcccctttctttgtgtaactattttgcaagcataactattgtgtcaaacgaacttagttcccacttttttgtattagttcttaatattaatcggattttcgatcaaatgacccgggccatagcctaattaggcctgggcctagattctccgctcctggcaacgacttctttgatctctgtactcaagcatttgagattccttttttctcttcgttcgtgcttattagcaaataagtcgtccatcttttccttacagatatgaagatttcaagcccccgacttcaccaacaccagcagcacctagttcatcagtcactctcaccacctccaatgctgagtctcagatggttagcatgtcaaacaatggcgcacctgaacctgcggaagcacaggatactgtttatgagcaaatttctatacaaccaaagccgagaccacaatctccatatactatgtaagtctagtagcatccgatcttttttcactttgatctgtaaatgatatctgtttgtcgaagttcatgatcgccattttaatttatgaagcgggaaaatgcatttagataatagcctgaatgtgggatttatgttctccccttcaagaaattgtccctcccaaatttgctttcctatttattacatcataaattgttgtatgtgacggtctcaccaagaaatgtgcctcatatgtgagttgaattgcccatttcatacataccataagaatataggctcgttgtttgaggttgtctgtctcaccgagagacagtctcttcaagagtagttcggattatatctggctaaaggtttggagggaagggaaaggaatgtgtaatgagcttggatttcttccgtttgcttggaagggaaaggggagcaaaaattcacatttccctccatagtccattctcgtccctctaatcaaaccagtttcgcatgattcgctattctcctctcgaatgacaaatcgaaaagcgacttatagtcggttttgagttatttttggcccattttgagaacatcgcgaattcaacaaacaaataatgtatgctgacatatcctcattgttcttgaactaaggtatgaggacatgaagccaccaacgagtcccacgccatcagctgggaatcagtaaatcttcaagtgtggattatgtcttgcttaacgaaggatcgctaacacccgagtgaaattcaatcgtcatttccatcgtgatgaaacgaatttgcttgcgacttcaatttctattggaatttgccattgaatttttggaattgcaatttgtagtttgagcagttcattaggtatctgttcatgagagcatgtcaaattttagtggagcttcttcttattatgaagttttgtattgtgtactcaagcttcaataataaattatctctttttttttagcctttttgcctgatttctatgttgtattagtattttttttttgaattatagggtatgctgagggaaagttagggttagatgagactagatttcaggatattatttagaaatgacagtactaactctaattaagacaaaacccgagtatatgtgtgagatttgtgttttccggttactttattagtattcagtatgtataagtgtaaattacacttcctcaaaatccacttaaagagggaaaggggagcacaagcggaagattggaattgggaagacacaacacttcgacaattgttttctcggtttttattggaatttgagggtagattagagaatctctacaagtaaagggaaagataattaaacattgctataggtgacgagacaactcctatttaagggtgaaagaaaaataccttatggtatgtttgggaatgatgatttcatttacaaatatggatttgacttaaagttagtgtttggcaataacaagaatttaaatttggatttgagccaaatcca

SEQ ID NO: 1628 - DNA, 1622 bp, Amaranthus palmeri
cacgacatctgtaaaacgttagctatcatcttttggactgaaaaccagattaccattagaggattgtgatttgtggcctgtgggtgaggaaaagagatggagttgcattatggtgctttcatggagaaattcacacttcttccatcttcttctgggcagcttcctttatctggtctttcttttgctgtcaaagatatatttgatgttgaagggttggtaactggatttgggaatccggattgggcaagaactcatctaaaagccaaatctactgctcctgttgttttggctcttttgaaggcgggtgctacttgtgttggtaaaactatcatggatgaaatggcttacagcatcaatggagaaaacatacattatggtactcctagaaacccatgcgcagctgatcgaattcctggaggatcttctagtggatctgcagttgctgttggggcgaacattgtagatttttctttgggtacggacaccggaggaagtgtgagggtcccagcagcattttgtaaaatttatggaattcggccttctcatggggttgtctctgtagatggtgttgttcctatggcacagagttttgatacagttggatggtttgctagggatccggcaatcttgaagagaattgggaatgtgctactcccaccaattgatgctaatcttacaaactctaagtcaataactattgctgaggattgctttaaacttctaaacatccccattgatagagtaaaagaggtccttgtcaagtcaatagagaaatcattcggaggtcaagttatcaaatataggaaccttggggaatacattgagacaaatgttcctagcctaaagcattttatgagccagagtggtgatgcaaaagaatacagcgtaccttcattaatggctctctcgagtgctatgcgaattctacaaagatatgagtttaaggttaaccatggggaatgggtttcttccactaaaccggaactgggaccaggattaaaggagagaatttgggaagctgtctcatctaatgatgataaggttgacatttgcaaatctgttatgactgagtttcgagatgcacttacttcgtttctgggggatgctgatatcctagcaatcccaactgttcctggtccaccgccaaaattacagactgcaacatcttcgttggaaacctttcgcgctagagcttttagcttactctccattgccggagtgtctggattttgtcaggtaagtataccactaggtttgtacaatgatcttcctgtgtctgtatcgttgttggccaaacatggctcagatatggttctgctaaatcttgttgaaaccctttctggaactcttgaggagcaaataaatgctgctgaaagatcgagattgtgagtctttaacattatttgaaatttatctatgttctttcgccaatgtgcgtccgaagcatcttcaggtgaactcttcgacgtgtattcttcctgtttaccctatgtagcataaataattccgatgaacagctagttatgtgatagtttttggtgtcaatgtctagcatatcaaaaatacactacagacaacattttattaccatagtgtcatcagtggcttgtaccttggtgagg

SEQ ID NO: 1629 - DNA, 8697 bp, Amaranthus palmeri
gaattagattaccatgtaccccttggtcattaacaattcccatgaattatttccaaggaaatgaaaattcctattgccaaacaaacaatattaaggaattcctaggaaattgacaaaggaagtaaattccaatgaattacaacttcccattggaatttaatttatacgtcaaccaaacgactaacgatccaacattatgtatacaactttcatatgttgcacttcaaataattaaatgtttagttatatttaaaagttgtttttatttgttagtttttcttatcataacttgtaattattaaacattctctctttcctctttaattttaccatactttttttatgaaaatatcctcactccattcattaattttcattattaaaatattttttctgtttaaaatcatgcacataatttaaataactcaaatcgaaaaaaaagcatgcaataagatccaaatcaaacttatttcaaatataagcgtctgatacctcagagcataggttcgggtctgttcgcacagactaagtgcgaacagtaataaactgctaaaaaaaaatcaagtgtctgttcacacttagtaactgcgaacaggtaaaacagggttaaaatactgagtttaagacaagagttgttcccacttactaagtgggaacagactgaaagcaccccgaatctaaggtttgcggcttacacgcttagttttggaataagtttgattttgatcttattgtatgcttttttattttgataaataatctctcacaaatcaaatagattgagtaactaatccaaaatttttttgttcatcatccaattagaatgatttcataacgttttgacccagaattaaactttgaggcttgagacaaagcaaacttagggggaaaatatccaaaaattgcaagtgaaaactgaaacacgacatctgtaaaacgttagctatcatcttttggactgaaaaccagattaccattagaggattgtgatttgtggcctgtgggtgaggaaaagagatggagttgcattatggtgctttcatggagaaattcacacttcttccatcttcttctgggcaacttcctttatctggtctttcttttgctgtcaaagatatgtaagtaacgtcttcattctttaatttaccattcttattgcttcttttcgctttttcaatcttctgccctaaaatttttcatttatttaaaatccattgccattttaaatgggatttgttacataaactttatgaatccaaattgcaatatgcttaattacaattgaaatttgaatttgctttgcatggagttcattaggtggaatctttagttgtatcttcacactcatgtgaggggaaaattggcagaatatagaactccaactagaactgtaagtgtaaaaccaatttaactcgaatcaatcggaaatagcgtacatattagtacacaagaatcttaatcaatcagacccgagatatcatatccctaacccgctctagctccaaccaccatcttaagctgttgtttgagtttgttacaatttcaaacccaatgtgcccttgatttttttttattttttatttttttggtactctgcaactaatttacattttatcttttgcttaaaatttactttgttatgattagaattacaagtagcaggctgaagttaaaatctttgtattttggaggggcagatttgatgttgaagggttggtaactggatttgggaatccggattgggcaagaactcatataaaagccaaatctactgctcctgttgttttggctcttttgaaggcgggtgctacttgtgttggtaaaactatcatggatgaaatggcttacaggttagtttttccagttagcaattgacattccaattatctatttgattaacctaatggatcattgtgctgttttttctgccttgtatggttgtatctgaaagtgaaattatttcaattgcttacactatgtttggatagaaaattaggagagaaaagaaaggaagggaaggggaaggaaaggaagaggagggaaagactacattgtttgtataggaatgaaaggaaggggaaagaaaggaattgcattttccctccaaatctttactcttatagagagatttgaatgttaacaaaataaagggagctaatccttccaaatcccttcccttcaaatcctctccctccatttttgctatttaaacaaggggattttcatccctccaaatcctttctttctttttcctccatttccctccatccaaacaaggtcttaacttttgaagatgcttgcagatattgttttattgtttattagcaagtattttcacatttgtgatatgactttcctgtgaagtctgaacatggtagatgttggccttctggtttgatatgtttttaaagatggaattatatgaagcaattatttactctaacgatccgtttggtcatcggtgtcaaacggtgagaatgtattgaataattagtataatcttggtaggaaaagcttttgacaaatttgatggtcatgttctgcttcttttttttcttcacaaaattcatttcaaattctcaataaatacttagattgttagtattaggtgataatgaaaaattttgcaaacataaaaatatttttatgatcaaagttttattatcattgaaatggcatggcatatttcataaaaatttatgtactataaatcattctcatgacttatatttagtactaacaacaaaacagtcaagggctaaaggttgagcaaggattgtctgtcggtataatggtttacaatgtcttcatcccagcgtcccctaaacaaggtgtttaatcctagtaaagatgatttctggtttatggtaggaacctaactctatataactcacttttcacattttgtattatatagtattcttccatcactattcactacaataggcaataaaaatagaatagtaaagctaagcttatataaggactgaagagttgctaattacaaagtcgataaatgaaccattgggctaatgtttcagtcaattatactgcaattaatctgtttctttagcttagtagcttgctttcttttcttattgattttctaaatgatatatgatgtgattataaaccacttatttaattttgtttcatagcatcaatggagaaaacatacattatggtactcctagaaacccatgcgcagctgatcgaattcctggaggatcttctagtggatctgcagttgctgttggggcgaacattgtagatttttctttgggtacatattttcttgtcttttacgttttctttataactcagcatgactgaaaaacatggcattgtctttcttcaatgtatttaggtacggacaccggaggaagtgtgagggtcccagcagcgttttgtaaaatttatggaattcggccttctcatggggttgtctctatagatggtgttgttcctatggcacagagttttgatacagttggtataaattccctattcgactagtcccccattatgtgtcttgaactgagttatctcaagtacaagatgccctggtgcaaaacagctttttgactacatatgtaaaatcacccttcattcttcaatatgatgtccaatacccttacttaagcttcaatgtgtcaggatggtttgctagggatccggcaatcttgaagagaattgggaatgtgctactcccaccaattgatgctaatcttacaaactctaagtcaataactattgctgaggattgctttaaacttctaaacatccccattgatagagtaaaagaggtccttgtcaagtcaatagagaaatcattcggaggtaatatggttggtgttattgctctaatgctatggcgaatttagctgtgataaaagctttttgcaacttctgttagcttgacgagtgaaacttgacgaattttttatgttaactttactaatcattgttgttcaggtcaagttatcaaatataggaaccttggggaatacattgagacaaatgttcctagcctaaagcattttatgagccagagtggtgatgcaaaagaatacagcgtaccttcattaatggctctctcgagtgctatgcgaattctacaaaggtacagatcaatagtacattagtcaatattaaaacctaacggattattatatgctactgtaatcatttcatatacttatattttctgcagctgacttttttatttatttatttttttatttggaagtgtagatatgagtttaaggttaaccatggggaatgggtttcttccactaaaccagaactgggaccaggattaaaggagagaatttgggaagctgtctcatctaatgatgataaggttgacatttgcaaatctgttatgactgagtttcgagatgcacttacttcgtttctgggggtaagctcttgacttagttaataagtaccaataatttggctaacactatctcaaccctcagaatgtgaacttgtagtcttccacatgatagagtacataatatttggggcttcatctatcagtttaagattttggtttagttgattcattgacataacaaaagggtcacaatttcaaatctcatccatcgttcattttgagtagaatatctagtatcatgtaagagaagggagtgtgttgcaaccacacttctagcctgcatgactcttatgtgagagagcgtgtgcgtgttagtgtacataacatatctcggagcttcaacgatctgtttaagcttttaattgagttggttccttgtcccaggatatgttatactctatcagcacaaagcttgatcaatggcttaaagttaaaccacatcagttcctggatttagatgttcttttaaattttgaataaactcttaaatctgtatctgtttgcaggatgctgatatcctagcaatcccaactgttcctggtccaccgccaaaattacagactgcaacatcttcgttggaaacctttcgcgctagagcttttagcttactctccattgccggagtgtctggattttgtcaggttcttctctctacattagcaaatccaaggcatcaaagtcttcattcatttttttcagtccctttcccattttcatgacgaaaatcttttttatttttgcaggtaagtataccactaggttcgtacgatgatcttcctgtgtctgtatcgttgttggccaaacatggctcagatatggttctgctaaatcttgttgaaaccctttctggaactcttgaggagcaaataaatgctgctgaaagatcgagattgtgagtctttaacattatttgaaatttatctatgttctttcgccaatgtgcgtccgaagcatcttcaggtgaactcttcgacgtgtattcttcctgtttaccctatgtagcataaataattccgatgaacagctagttatgtgatagtttttggtgtcaatgtctagcatatcaaaaatacactacagacaacattttattaccatagtgtcatcagtggcttgtaccttggtgaggtatgtaagagtcagatgcaagcaattttaaccttgttagtggaaagggtaattgaaatcaacagtttgattacatgatactccttctatctctataagaatgtacctaatatttttgtgtgaaatttagtggaaaagtaagtaagttgaaaaataggacaaaaaaactagtggacgacagtaatcagttgtaaaaaagagtgataataagtttgtaattaaaaaaaaaaagcgaattggatcattaagtctcggtttcattctccaccggcttctgggtgcggcttgacattagataagtttgatggaaaaatataacacttataattttgacgacaacgttcttaaaatcatcaatgaaaataatgaattgatgatgatcacaaacaaaagaacaagagtaacttgtgtttgaaagaattcaagttaacaataatagaggtactaatacctgagttagttcattttggtatatgaaagttaatagttaattctttgctatttggcctttgacaatttgttgacaaaattatgactctttcccacaatttatagttattcaaacaagtctagttcatgacatgcacgaacaccaaaaggttgtcttttaattgaataaatgagacaaacgttgtctttttattgaataaatgaaacgttgatcttttatttgcagatggccaaaaaattggctttttagaaacaatttttccttatttttaaataattcaatttttgtatagtttttgctgataacatcccttgctacattttaatctgcaaccgtaagtacctacaaccaaaaatgagtaagggaagaagaagaataaggaggaagaaaaaatgagtgtaacagcttataggtatctacattggccgatttaaatgtggcgtgttgtcagcaaaaacacaaaggttcaattatttagaaataatcagtagtaatgattatttacaacaaatgggtaataggtaaattatgcagaacatttttccaagaaaaaaacggagaacattttttttgaaatttttttatttcaaaacaaatgaaatatattataaaattggaacgtacatagtcatattttcaattaatagtgtaaaaaataattaaaattttattaaaagttaaaaaatctaagtacgttttcaaatcctaaaagagtacgacgttaaagcttcacgaatctaaacccaagttaatatttaagattcgtatatattcaatctaaatctatctcaatcgaagaattttgtcaaacattaaataaattcattaaaagagacataaccgaaaaaaaaaaatctaaatatgattttttttttccaattacaaaatctttcttactcaccccatattatgaaattaaaatttttcttacataggtaaatatattatgaaatcatcataggattttccacaaatttgatatagattttggcttagaaaaaaaaagggaaaataaaacttccacacccacgagaaaagcttgcaaaatgcgaatacgcctcgtgggctttgttcacactctgcgtaggagtatatattttgcacgaaacaacaaattttctttgatctctcgatcaaactgaaaacgatcggagaatacaatgaaggtaagagctagagctcctgggaaaatcatactttccggtgaacacgctgttgttcatggatctactgctgttgctgcctccattaatctttattcttttgcttcccttgatttctcttctggtaatatttcttgtctctttttcattttgattttgagcatttcttttcagtgcatttggtgcagtaatgtggtttatttttctttaatttagtcattatcaattgatcaattgatgttacattgacaattgaatgttacatttgttggagtgctttaatttttcaatttagaagttgcatttccgtctgggaattattcatttgggaatagtttagctgatttcgctttaattatctatgattttacgttttccatgttttgaggatggaaatttgtagtgtttctgggcagtggagttaattcctgaattggatcacatgattcaacagtgaaaattgattgagtgtagcttaaaacagttttttttagattttgtaaccctaaacttgattgagttcatccgatgtaaagactaagtacacagtaatgttataaagtactcatctctgccaatgagtttgctacctaggagatggacacaaatatttagtagtagttttggctaaaaaattaaattgtgtgattatcctaagatatagaagaaatgtatcaatgagaattatgtaatgtggcggggacggtttaaatgtagcaaaattaagtgggacgaataaaagttcaaggctgaggagcaaaggcataattttaaaatcaaggggtgccaaatagccgatatttagaaaataataattattaaaatgattaatacaataacaagcaagttgggatgtaaaatttcaagcttctgaccttaaatttcgtttctactaatttgaacactttacaatagttgattttgtgatacttaatttgctttatattatatgttactccatacatattttttagtagcaccccaaatccattatgacaatgtttatcattcaatgttatgttacatattgtagttccagtcaaagtaatagcgctctctctctctctctcaaagtctatttgtggtgccttgttcttatgaatgatactaccttttatagatgaaggaaagcatctttaatagaaccacacaatgcaccatcaaagcacaattacatcaccaattaagtatgacaataaacatcacaataaacaagcattaaacaaggagttacacaacctttcaatgccattcaagtggccaaactgaccagaaaagaatccaaggtacagtactcgaacgagcacctagttcaaaaccatcctgcacattgtgccttgaacgagcacacccctgcagtccacttatgatttagttttcttgttgccttgttcaagcaaccttcataccatgatgccttgccttgttcaaggcacggttccaccctctagtgaagcctcacttgccccacattaagcacctcatgaaccattccaaacctcaattcacttaaactcgacacatcctcatcgttcttctccgaagtacaagct

SEQ ID NO: 1630 - DNA, 2140 bp, Amaranthus palmeri
ccaacctcaaaaacccattttctctaactccaaccatatccatggcgtcctccaatactaatttatgggttatgctaggtttaggattggcaggcaccattttgcttatgactagaaagctcaaaagagctattatgcccgattttggagcatttattcaaaaacttgagttacttcctcctccacaacctgctcctcccaaagctcctcatcctctgactgatttgactttcgctgtttctgatttatttgacattgaaggatatgtgaccgggtttggcaatccggactgggcaaagactcatgaagcctcttcgaggactgcttccgtggtgttatctctggttgatggtggtgctaaatgtataggcaaaaccacaattgatgagatggcatatagtatcagtggagaaagtaagcactacggtacaccaacgaatcctagtgcacctgatagagtccctgggggatcttgtagtggagctgctgtttctgttgctgctaaccttgttgacttctctttaggtattgatactgtaggtggtgttcgattgccagctgggttttgtggtgttataggatttagggcatctcatggggctatttcacagtcaggaattattcctgtctcggcaagtcttgatgcaataggttgctttgccagggatcctaatgtgcttcggcgtgttgttcatgtcatgatgaaacttcaatttgctacgcaacggagtcctaaacaaataataattgcggatgactgttttgagctactcaaaattcctgttgatcgggcgattcaccctgttattagatccacggagaagctatttggaaggcaagctttaaagcatgaaaatcttggaccgtacttgagctcaaaggtcccaagtttaatggacttgtccgcctcaaaaataaatgctcaagggaagacttctacattgactctgcttgctaatgtgatgcaatcccttctaaggtatgaatttatggaaaatcatggagtatggattaattcggtgaaacccgatgtagatgcttctattggagcattatcccgtgaaggcaatgtgattcatgaaagtgagattcaaaagatgaatcaaattagaactgaaatgcgacttgcattaaattcacttttgaaggatgatggagtgcttgttattcctacatttcctcaatcccctccaaaagttggtggaaaagatatgtcatcagaaacttatttgagccctttgtttagtctactatcaattgctagcctatcaggatgttgtcaggttacagtacctctgggatatcataacaaaagccctatttcagtgtcctttattgcgaggcaaggaggcgatcgttttttgcttgacacaatacaaaccatgtattcagctcttcaggagcaagtagatgcttctaaatcaaattctacacccagcacatatagtatggaacggtctgcagaggctgctaaagaaaagggaaatctagcattcaaagataggcaatgggcaaaagctgttaatcattataccgaagcaattaaactttgtggaagtaatgcgacatactacagtaatagggctgcagcttatctagagctttccaactatcgtcaggcagtggaagattgtaccagagctataaatctagataaaaagaatgtgaaggcatatttacgtagagggacagcacgggaaatgcttggctactatgaaggggcaattgaagattttaaatatgctcttgttctcgaacccactaacaaaagagcagctgctactgtggagaggctaaagaatttagtctagtaggtttgttcggaagcatcttcatgcgttgaacgatcgtacaagcatttcaaatctgtattttggtaaatctcctggttttcacgccgttattttgatggattattgtctccgtaatcgtggctgaggtaacttggacagtattttgtcacaagtaattttcgtccgagatgagatgagtagtacatacggcatttttgtcgaacagtttattttcatcatctgtttgccagcctaggttattatatttagtgagcaattttgtattgggggggttttgtgggtttgctcttcacttgaaattaggattcaactatgaagtgcaatat

SEQ ID NO: 1631 - DNA, 19804 bp, Amaranthus palmeri
aggggaacaaatggagtattcgaagagctatcagccaatatgagcacaatttcgggaattctctgcacggggatatatatattttccacatacgatattccacaaaccatattccacaaccgatacatgagtttctttgtatatgattacatagcccatctagctttaaatacttgtgactgcatttcagggaaggtccgacggttctgcatcagaggttttcaacaatgcctctttgtgcgcctcatcgagcttaataggaaggtgtataggcttgctacgatagagcacataatgttgcaacatgaacaagagatcaaacaagaccgatacctgtgtgatcgtttaacaattacattacaatatgcaacaaagttaatgaatacagaagttaagagatgaaggattccatacaagcgacagcaatgtcttcccgatatttccataaaagttcacccaagaacctgcagacaaatatattttcttagcagtgtagcataatgcaccagtattttgtgattcactcaaaatgaccccaaaatagcccaacactgaccataatttgcattttgaattcgcgatttgcaaggagattagtgaatcacgtgacagtaattttgagtaatatatcccaaaacgtttgtagagtcatgttttggaatagaaaataaaaataccttgatcgatagattgcgtagccatttgcgcatagttagttactccaccaagaaaatcaagcaaaatgttgcctatgctaaatccttctgtgctttttctgtagaaattcatgaatgcctgcattcaagattcatgcttgattagtagctttttcaaaaaaactagcaatcaaagaaatacatgagaaacaatgatatatactactacatatagtttcacacacgcccttaaaaagtaaaaatattatacccgctccaatttaaaaacaaatcaaacactaacgtacgatttatcctatattcaattgacccttaatagcaaacatcatctgcaacttcacataagtgaaaatgtatttaatttactatagcacactagaatccataaccaaagaactatacagatttggctctatcaaggatggacaataaaaaaaaataaatattgcattctaaaccgtgactcgcctatttgaaccgtaaagaggtcgaactaggttctcgttgtatcaaatatatgtgagagtcgcatcaacaagagatgaaggtaataggcattaaataaggagataccaacctggggaatatatttgatgactgtcatggtgacttgaataatgctgcaacattaaacaaaagaagctctatattattatgaaatatatcatccgagacagaaaatgctttttttgatcaccagtccatggtaatgtttcatgaatttgcttcacagcaagacgggaataagcatagtgcaaaatatcagccacattgtaaaggtttttgaagttatcggctgcggccgtatacaggtcgcagtaatcgtgaaaccatcaaaaatgactgaaagtatgacttcgcggttgtcaccacaaccatggtcgcatttgagattttgcactatggtgaatatgtcttacaagcctcttttataaaatttactaatcacacaaccaaattttatgtttcaacaaccaattacaatgtcgatcgaatgatctcatctaactaagaaaatgaatcaatatcaatgatcatttacatattctcttcctccatgaattcttatccattttcatattctcctcaaattttaaattttcatatcgttcttcactatgcaaaatcattttcgtcctcactctttctctcttcaaacctcctcaaagtttcattcttcgacttcaactgcttttttcaacctttgcaaataatcgaaccaacgtaaatgactttctctcatttcatcctcaatatctataactcatcgacttcaacattatttcgtatgtcttcatttcaaattttatatactataaactcatagatttaacatacatcttaacatatgcatctcagctagacagctactataaagtcttaacttttacgctcaaagtaatggtggtctaatggcaaaccaataactcaactacctcaaatcaaatgaatccttttaactagtgaaacataattcacctttttgaattcacgatttactcaagctagctcaaaatcgatcgtgattcgcgtttttcaaatcgcaattagtaaggagattaactatctctcggtcacaagagttatttttcttatccaaacattcttttgtcgacaaagcatgcttcagatcatttaacattaccatgatcctagtaaattctcaacattataactaaaatatattctaatgcacaagatagtagagaaacaagattcttacttgaagacagaaatgagccaaagccaagaatgggtgggcaaggcaataaatacacagactgcagcagcagaccaagcaagagaaacaattatgagggaaatctttgagaacttctggtttccacgctgtaaaatcagatttgataatataagaaatcaaagctaaatatacatagagaagagaggtgaagacggtttcaccctaagacaaacccatataagttaatttatctatatgatcatttaaaattgtaaaatgatcattttaaccagtcacgtagaacatggaacgtagctacgttccgcgatccaagaacatctgtccccaatcaccacaaaacgcgacccaaatcactcaaggtgactgacgccccagtgtataagacctttttttagaaggtactttggcctttatttacactggggcgttttcttgttttatcttgttttagaaggtaaaacaaaatcgctcaaggaagataaaacaagattaaacctaaaaatctaaaagaaaattccaagataatcattttaatttaattttgttgtcaaatatatattttatagataatgtatctcatacccaatcgttctcgagtcaatctaggttgcgttttgtgttcctgttccccgtttcccattccaaaccgaatgtcattccatgaaacaatgattttaatacaataaatatacatgcatctagccaatagagatggtctcaccatgagaccgtcttatttaataaaaattgtgggtgaagatactagttaagagtagtacttacttcataaataataatttggaacaatgtaaatgcagtcaatacaacagcatgtacggagaaggccacatcatttgctgcaacaggaatcatctgcataatcattatcagtccaagccacattaaactttactactttgttttgattacaatacagaattgaaaggaaaggaagagaaggggaaggtggggaagggaaaggaaggtaataaggaaagcttcgtttgtttgtttcggaggggaaggaagggagaggaagagatctattttctaagacattttctcaagaaaacaaacatcataatcaccctaattgacctcatattttgaaatccagtcaaaatacatacttaatttaaccaaaaattaaacattttgtctatcacatggaaatgttggaagttaaaggtcaccccgcaaattcaaaaaatatttatagaaaaccataaacccaaattaattgatgtacctctaaagtattaagatcatattggaatatctcatatattacatatgtagtaggacaatatagctcaaagcaataagtgaaagtgtttaagatacaaagcaaaagtacaaaacaatgaaactagtatccaataggcccaatacaagcatgctcgttcgagcactagactgctcattttgacttttagcatacttttcgtttaagaaaaaacatggaaaaaatcaatacctaatttagtgttagctacatatcctacaaaatcaaaatcaaacaagctaactatataaacttcttttgcattccgttgttcattcgagtttgcaccatataaacataggaagttgtaagcatgttcaacatgctcaaccgcattaaggccccgaaaaaatggaagcctcaatattgagttacgatgtatatgttacgtgtttaatgctataaacttattagaaaacttgcacaaagccttcaaaaatttatcgatttttgctccgccctgcttaaaaactcccatctttttaagtcatatggttcctgtggtcctttgtcatgggaaagagggagtactagctaataatgaataaccaaccaaagcataaattgttaaaatcctatatttccaaatatagaaagggagagaaattacttgatcaagtccatatttttgacgatactgattctgaacaacagagctaaaataaagtgtagcattgtaaatgagataagctgtatgtttagtcaaattcaacaccacaaagctaaaattcaaccccaccacactgcaacaaacaacataaacacaaaaatcaagatcaaaattaagatttaggtcaaattcacaaattgggtaaacctacgattacgaatcgataaaacaatcaacacccaaaaccaacctcttacggcgaaaattgaggataacttgtgggtaaaagctgattgaccaagaaaagaaagcaatccacccgaaaaactcgtaaatgatctctaattgagatgaattccatgaagacatggtggtagtgattcaaatttttcttcaaattggttgtgttttgttcatttaaaggaatctaaaatggaggaagaatcaaatgagataagagttgaaattaatgaacatgatttgatgtagaatcaagaatgcagagatgagattcggatactgacttttgtagagttattgcgttacgcaaatggcggctgcggttgtataaggacgggaacccaatttcattctcttgcctgtctatatgtgtcgtacaaagacggttatccggcctcattcatttttttttacaataattccttatcaataactttaagaagcacctcccttctttttttttcttttctttccgtttagaatattttattttggagagaaaaatttgattaagtttttgaagatatgaaatctccttagattcgtcttaatgcatactattttatcatatattttttttataatttttcataatgcctgttaagagatatttaagctcgaaagttgctttgaaaactgtgcaaaaactaaatggaaagaaaaaaaaacggagggagtatgtaaataacgactaaggatcgaaaaacaaaaaaaaacacaactaaggatgggcataggttttggatcctatgggtctagacccgaccagaccctaattttaaggtctgggtccacctatttatggatcctatggatctgggtccatgaccttagggtctggatacggagctggatctgggtctacatgtttgagacccaaatccacccatgaacccatttacatcttttttaaaaaattatatattagttatcatgtatatttaattatttgattcgaaaatttgttttatttctaaatattacatgattttgaactttctcatataatataatttaaaatgtgatcattgtatcaatacttgaaaaaagtaaagacttgataaatatttcgttataaaaacttgaatgttggaaaactttataaatttattcgccgaataagtattaagtattagaagatccttattagtcgaaaatgtttaaataataagtttacgcgaatgatcgaaattgtactttagaatatattttttaaaaaagtttcaggaaaaaaataaaattgttttggacccaaatctagaccctagaccagccagaccctaagggtctaggtctgggtccaaactttttagaccctgcgaatctggatcagggtttgggtccaataaaaaagttagggtctggatctaggtctagttggacccgacctagatccgactcatgtccatccctaataacaacagaaagatagaggacacttttagtatcccgtaaaagcagggtatgggtgggggttaagatgcttgcagttagaaaactccctaattgatatatgcttccagtatgggtcgaacatcagaccttctactccacatgcagatgtgttattcattgagccacaaacgctttttgtaaataacaacagaaagacaaaaaaaataataataaaataaataaaatcaaaaaattaaattaaaatcattaaactctcaccctatcaaatcataccacataaaggtgatttgttaatttcataaataactgttatgtactgagacattctctttttttaatgaaaaattttcagaataatcaagtctattgattatttttaaataatttaatttttgaatatttttgctaatagaattatgacacatattaaccggctactatactttgtactttgtggttttctatgatacgcatgatttatgtacattttatcccctaattttcactcatagttataccatccttatgttttattcttttgatttagtccatttatgcttattttcaatgatattactcttttaatacaatgtttgttgttttgtcaatttttgtaggttttccttcgtgatcgagccgtcacaagcactaattatatttatcgtcttactctcggaggcttattaaccttaggaactaaattgtgataaaagggaagtcaaattaataaaaagaagctcaactaaagaaaagctacatttttctatcatcaaatacaaaagggtccacttataatgatcatacccttcaccatacttggaatttgatagatatttttattagaaattaaacttgggtccgttagcttcgaaacgactggtcacatgcccaattccgattaaaacgatcaagttatggcatttcaaaagatgtagtgcgcaacaggtacaaaccagtcgactggtcaataaggaccagtcgacccgactcttttaaatctatagatcactatttgctttttgacccatgatttcttacctcatgattcctccaatctttccccttgcgtgcttcagacctcctactcctatgcatctggttccaatgatggaggaggttgcttgttggactatctctacaattatcatgaagggaagtggatgatcacttggatttgcctataaatattaaataccccaaggttctcaagggaagacacacccatcagctcacaagctgagcttagtttcatcctttcttcttcatttgcatattcatccttaattgtattctaagtagttcctaagtccagaaacttgtttagtcttcatacaaacacttcctttagcattttcattccttgtttcaagctttaagttgtaatttagctcttaaacactagtgattagaagtgattttcattttctaatcaatcaaagtactaagatattccagaatcgtgtgggtttaagtgtgcaacttgatgtgaagtatttgtatcatttgaatattaaagtttttgttgtcattaatgtgattctcagcccctccatagttgagggtagtgagttattctaagctcttcttttagtttattgcaaaaattatgtatggtatgataaattatgtgtgtgtttcattaaacatgtgtgagtagtccactttctagagtttgaaaatgtagttaacattttgatttgcttgtgggaaaaatgggttgagtaaaaatatgtacataaatgaatatgtgagttccaatgtaaggaatcaaaagtctatttcgatctccatccatggacaatttatattgcttgaatgtattgaacacttgtgaactgtgaagtttgatttcatgctagtaatgagtagcccataagctaacttcattaggattcttttgagacctagtcagtccttagaatgatgaaccatgcctatcttgtatgattgcttcttgttcataaacataaattggaagttatgagcatgcataagaaagttaatagtatggtcgagttctacgcccagaagccgaatctcttaaaccatattaacaactatatagtttctacgcccagaagttgtggagctaaaatagaaagaattttctcatcataaaatttgattaaaaacatatattcaacccatccctttagtaaatcaagaagttaattccccaaattctagtctttatcttcattgtttgaatcgtaaatcgtttttatataactcatcaaatcaaaccaaaaaatcaaaaacttcttttgtcataaaactcgtttttgtcatgcaagcatttccctgtggaccccttacttactactaatgctagtcattagagttaattaaggtgtataaatttattgcatagagcagacttaactaatgtaagagctattatggaaataggttggaagatagacattaatgttaatatcgaatatgattaggtaaatataatttttgcaaaatttaatcaaattcgcggaagtaagctttagacccatgttgtacatggatctaaatctaagtctgaatctgtaagatctgtgaatacggatttgtatagtaaagatttagacccgaaaatttgaatccaaatttgagcttgacctcagaaaatgtatctaaatccaaatttgaacatctttatcccattttaaatctgacctatgaccatatcgaattcaaaaattattcaatttgtatgttcaaaataacagctagtacttcatacccctatgggctatgaatgactagtttgagtccgcatctagtctgagaaaaaatattcgactccgattatatagtctgagtcctattcagagacagagcggagctaaacctcgtaaaatatccgatatttcatactctgaatcgacttcaaatggagatggaatgaaaaaaaattaaattttatctggaccaaaattagagatcagagtagataatccgtaccgatgccgatccattattagggatggccatgaggtgggtctggagagggtctaaccagtccaactagacttgagtctggaacctttttatttttaattgatccagactcgaatccgaaccctaagggttaaaaaattttcagaccaaaacccaaatccttcgaatctaataggtctagggtcctccgggtctaacggaagagtctagggtatagggtttgggtttgggtctaggtcggacttgggtttgggtttgggtctggtcgagagcaggtctagatccgtcaagcattttttggattcaaatccgactgggattcgatgggtcttaaaaacacaaattcttgtgagagacgatctctttaagagaccatccctaatatagtgagcgcattatcatcttttagtttaattaacaattaataggttgtgcctgaaatacatcttttagagggacggtctctcaattgatcaacaatttaaaaaaaagacccacacccttaagaaaaaaagccagtccaaaacaagtctaacagagttaagactcatgaccagccctatcattaccatcctatactatatactttaatagaaggtctcctgaaaaaccatttatggcatagacgactctctcaatagcccaactcaatgcctaacatgactattcagttacacaaattcttatgagagatggtctctttgagagaccaactctaattgggccggtccataaagaaaaatatagaataagtgtaagaattaaactctattggactgatcctgagaggcgtctctcaaaaagaccgtctctcaggagacttgctgagttacacaaattcttatttaacaaataaacagacctatatttactcgactatactagcaaaaatttgtataccctaattaacaaaccgaacctctttgcagtttttgcgaacaagaggtttaaaacgaatatatacatgataaaccattacgtcgtctggtttcgagtaatttcagcactccaaggttcttttcttcatctacttaaacaggcgtcgccaatttccaacctcaaaatacccattttctctaactccaaccatatccatggcgtcctccaatactaatttatgggttatgctaggtttaggattggcaggcaccattttgcttatgactagaaagctcaaaagagctattatgcccgattttggagcatttattcaaaaacttgagttacttcctcctccacaacctgctcctcccaaagctcctcatcctcttactgatttgactttcgctgtttctgatttgtatgttttttttattcttcttccgatttctatcacttatttatgtttctgattactttgtggagtattggataattttatcaggaaaccgagtttttattggggaatatttcttgaaattcatagtttgattgtcggaaattatgaatattgaaaattggatttgaggatatagttttggtttatttttccgtaatatttatggttaattaagcaagtacaaattattagcaataattcactcttaattgacataccttttgcactataatccttcactctttggttgtattttattcataatttttaagttaaattgtatttgattcgtctcaatctatactcttagtcatctttaatatgcacatacattgaagattgaattagtgcaatggcaagacgcagtacttatcttaagattcatattctgaaacttcatcgcatttttacataatgttggtttcctaagaaacttttgtcaatattgtttatcaattaattttagttagcttcaatctcattctagaatcagagtttgtattttgtgctgacgaaaagtgttctctatgaagataagaaaggtatacggtttctgagctgtctgttcaattatgccttttgcatttaagttaaaggggagtatcaaaaaattgtagttgttatggttgtccccttacaaggtgtaatggaaatgtaacaagttttcttctgtttgtcatgaacaacacgtaggtttatttgctagactcgccaagcaggacatggcatgctttcataggcaagtctttataaaatacctcgtagaatttagaaattagaagaggaaaaaaggagtttgtgtagtttccttcacctcaatacccattagttgctatgcttgtaagaattttagtgatgtgaaacttgtcaaaacaagttgcgggtgccacctttgagaagttgtgttatgtcactattggcgtgttaattggttggagtatttattagtcgttggaattggtgaggaaaactcaacttgattccatgcggttgacatgtaattttatgtattctaaaagtgcgtatgcttgtttctccttatgtttgattattacttatttcacaatctcatttgctgtgtgcagatttgacattgaaggatatgtgaccgggtttggcaatccggactgggcaaagactcatgaagcctcttcgaggactgcttccgtggtgttatctctggttgatggtggtgctaaatgtataggcaaaaccacaattgatgagatggcatataggtaaaggcatacaattgtgttgtttctttatgtcttttttactcccttttcagatgacatgtcatggtcaggaagacaaactgcaaagtttgtcctaaagtgtctgcaaaaaaaatttacaattaaaaagggtatttgaatttgtaaggttatcgattttctatgctagtgtaactaatcttcaaaaacaatacaagattgatgggttaactgcatgctctactccatctatttaagccagactacctctcagtctactactgtcacttcattgatctatgagttctatgcataaaatgttgatacatgtttctattgtcaatgtttcttggaaactgcgcatttgcaagatcctatgctgtctcatggtttgcatcacaatgcattcataatttactttggtttacactcatcactttttcagtatcagtggagaaagtaagcactacggtacaccaacgaatcctggtgcacctgatagagtccctgggggatcttgtagtggagctgctgtttctgttgctgctaaccttgttgacttctctttaggtgaggaacataagatttttctgatctgatatggaactgtaacatctttgcatctaactatgtattggatgtatgtcctttttatatatttggtctggtgtgtgaagctttgtgatgatcttagaaatttcttgccttccgtgcaaagcaaaatggatcaaatggctgtgccttctttttaaaagtgctttccagttaattttcctcttttaaacctctaattgagaggctggaaagcaatttaaacaatttttattggtaggcaacttaatttaaaaccaattattcttttaaaaacatactttaagtgaagtaaaatttttatttggaaaaattaccaggaataatatcaactttaggttatttccctacaataataccaacttttgatactgtgaataatacgatcttatgggggtgtttcccaagaattttgctaatatgttaaaaatcaaactaaaggtgattatatgacaaaaaaatttagtaaattagtttataaactaaagttggtattattctaggaaaagacccccaaagttggtattattcatggttaatcaaaagttcgtattactgtagggaaattagcaaaaggttgtattattctgtaacataatggtactgttacttaaagaatttcactcaagattatacaaaaacataaaatagtgatcaaacaaacaaatgtgaggtagtattcatcactaccaagctcctccaagaatctcttcttttatttatttatttgacgaaaaacaaatgattacaacatgggtctttatatagaagtccttatgaggtagtattcaccacttactaagacacctcatcatatttattacacctcatcatattattctaattattctaaaatatattctaattaattgccaaccgtcccattctttttattcttcctttgataagtaatacggaccggtttagccggtttctcgtgtgttacgtattcatggtaatttttcctttttattattgaaaaaagattttgcgacgccgggcgtgccaggctagattagaggtctgccattgttgggaagtgtcatgcattgcttatataatggcaacatttatgtaaagagctcaaagtattatctagctggttttttatttatcctttaagctaagctttgaggtcttttcttcctgtccttgtgttctttaatgcccaacttaatccatattccattggcttcgaccaagtccaaaaccccattttcgaagttccttttcaaaaaatgaagaaaccttatttaagtgtgttgatttagtatcatttctatacaggaaagacttactatatgtggaacatttttgaaagaagggtgaaagagggttttagtgtcttttcgtatccttatgttaaaatgctagatgagtctactttaccttgacttagaattcgtctaaccctaaatttgtttaattttacggttggaatgagttcgaaatataattgtaacttcgaaaaccacttaactccaaatatccatttaaaattttggctattgaagtgtcatagtggtacctaaattttaaacatcttctatgaacaccgagggttgagcatgcaggaaatctcagattagatatgcttactatagcgtgtaactaagagttgcaactgccaactaacggggaattgatggaatttgtgttagaacttagaagtaggcatgttagagaagctaggaagttggttaaaaaggactgtttgcttactatgataggggagcgtgagaagagaatgaattatcagagaaatatgatgtgctactttttagttgtctttggcgcttgactttcattacttctatatttaatttccgtagacattttacattagttttatgtcgcttctgttaatgtctcggtagctaatttattgaaatatccttgtagtttcatgcttttttctttttaagtgaaaggtcttttaatattgatgcccattgattatgtttgtctttctgtaggttgtctattgattatcgtctgcaaatgttgtaggtattgatactgtaggtggtgttcgattgccagctgggttttgtggtgttataggatttagggcatctcatggggctatttcacagtcaggaattattcctgtctcggcaagtcttgatgcaataggtatgttagtggttggctggttgcatcttgtgtaatctacttggctcttaatgatgcttgaaataatgaaaaattttattattatgacacttttggaacctgatcttgatgtttgaatgttttgaatgaatcttagttcaaatatttctcttctcttttcaaatttctttatcttttatataccaaatttaattttcaactaaaacaaaatcattttcatgaggacttgactagaataagaaataaattgttcttgggtgtgtgtttgtgaaaatccacgaatatcaacataatgaattcgtgttgtgcatttctcatttggtttacctgtctgaggaacaatttatagaaagataaggatatattgatttggcacttagctagaccttcacatagcttaagtctcaacaaactgaaatagctgagtagtaacttgcatcgcacttctgatcctactaaaatagaaatttgaactacttgctagcccatatttggcccaatcactttataacaataatagttaatattaaactagtataatgaagtacataaggtactcattttggaccttccgaataagtagcagagatccaagatttgcaatgaaagctactcatacttaatagtttttccgctatttagtaaagatcgttgaatcattttagcttgcaaaacaaactgaattttggtaggattgagtaccttacattggtctcttgcgtttgttgtgtgatcaatgatgtattggtgccttttaggaaattagttaggttagttttgtcttttgtttatcaggcatcagtctagattgtgggatttgattgtcaatactagcctcactaaatcggctattgcatcattatcaccctagtttgttcttttggtgtcattatatgtgtacacccttccatccccttgtgtttgcctcaaattcaacattcgaaaagtccctttgagtttgcccctcttttaaagtccatgttttttttgccaacatgtctttattcacaacttctccctactgctacataccctttttaaaaagaagttttatctatggggcaaactcaagggacaaacggaacaatatctaccacattgtctttctaagaatttgaaaaggaacagtgcatattgctcttaataagtaatttgttttaatcagttttaataagttacaatcaattacaataaatcaattttaatcagtgtaatttggttacggtcattataaattagtttttggtgaagtaaactgggcctaaatgttctagttaaatttctaatcgtctgaacattttctaggttgctttgccagggatcctaatgtgcttcggcgtgttgttcatgtcatgatgaaacttcaatttgctacgcaacggagtcctaaacaaataataattgcggatgactgttttgagctactcaaaattcctgttgatcgggcgattcaccctgttattagatccacggagaagctatttggaagtatgttcttatgttttgtttgaagttgcatgtggtatcctaatttatttatatgaaaagtgggcaatacctttgttaattgtttttaggctcccaagcagcggacattgtccctcctttcccttcaataaatctgcttgggcgctttttagggatgtttgaagggccttcttccagctttcttgaacgctaaatttatttcctctttgcgtctctgtgcattattttccttgcttgtcacttggcttgaattcacctctagggtattgtctcataataaaggctaattgggtcattgggggcttcattcttgtgaaaatgacatgatgtgaaactacaaactttttgacatacaaccacggagtagaaacaatatttatcattagtataccttggaagagttaacatttgcagtggtgtgtgccacaaaattggagttgaatgtgagtccaaagtgaacttacttcttctcataagggcccctctttaacgaggatcatgattgagcgaccacttgaggattgtaaagtaatgtgatatagaacttttggtcagacaaatcaccaggactcaagttgatagttttacactttatgcatttatttgtttttcttgagggggcctggggaagtagatgctggataagtgtaaagcaagaaatcaatcaagaagttaacttgctttgtattatggaagttacttgtttatgtggctttgataaagtcgatcgataatcaattagcaatgccgttttgtagagtcttctacagtgtgattgacatacaaactacgtatgccgtttggtagtctttacaaattgtttggatgtcccccatagtttcaaatgccttttattcatggtgatattcttggtggacatcttaaagctatttttagtcaatgcatgtggattgatagaaaatatatgtctaagtcttcaaactccctttgtagcaaatatcacttgaggagttgcattgattttttgttgcatataaactggttaatagaggaaatgtatcatgtatgaagcttttgactgataatcaatctggccacataatgtcaaacatttcaaaggaaaaggggaataaattttacgaaacaaaggaagaatggtgtgttattttttccaaaatctagcttgttttgttacaacttttgagactctagtttctagaaatttcaaaacaaattattttgaaacttgaagtagttctaagtttacagttgtattttgtcgggctagttacaaatgaccaaatctaagtctattaaacaaattatatattacaattctggacatttgcaatcaaaaattcaaaatagtaagtgatactgacaagttttgtgttccccgtcgctgttgcagccccccttttaccttatgcattgtgtaggtatcaatgaattaacatcagtatttcagggcaagctttaaagcatgaaaatcttggaccgtacttgagctcaaaggtcccaagtttaatggacttgtccgcctcaaaaataaatgctcaagggaagacttctacattgactctgcttgctaatgtgatgcaatcccttctaaggtatatatctaatctgataactgtaattttgtatgttttttggatgttctctctaatgaatgcatctaccatgacaaggcttagaagttgagtatttaatgatggtttcttaatattatgggtgttagatatgggataggaatcccatcgctggcctcatcaagttctaattctgtggacgtaaaagactcaattaagaggcctaaaatttaaatttggactcgataataggctacacaaatatttatttcagttgcactacatgtttatattatatctttgtgatgggtgtagaatctgtaatagtgaaatagatggacatttttccagtgttgaaaaagtggtggttttgggtgattgtaaacataacacatacttagaagtgatggcaaaattatattaatagaaaatagaaaataggaaaatagtgatgtaatacataaatcgacaaagtactcaaaaatgagttatttaagtgagctcaacactcccataacttttgtcaatacaagcatgtttccttcatttggtccttctttccccttatctagattaccacacactcccttcctctctctacatctatatcctcttcctctctctttccctctttgcatcctctttttcgctttcctcttttatcccctttctatttcttctcctcttggcaccccttttttctctcctctcgctatccatatttgctttccttctcagtgtttcatcttctatctctctctccttccttccacaccccctttatctcgaaaagtactaacccataccccttgcccttggtttagtgtcaaatctcgagatctagggttatattcaatttattgaagagttcataatctttgtgccgagtctgattcttatccctgtggcaactcatgttgcgaacatcttaatttgaattgtcaactccaaaaaatagccattgtatcataaaattctaggtttgagattgtttatttaaaattaagctcataatagacattttggaacctagtacatattaaataaaatgcaatggctaatatgttacaataataagtaacaacttataatgctatttctctatgatattatatcatgagtgtaatagggttttgtagaatgatatgctttgaatctgttataaagagggcattatttaacataatgatgtcattttttatttcatgcatgtttgggtagtaagttaggtatgtagttgctataaatgcatataatttgaagttgtatgctttttaataaagtcattttgtcatcacgaaatattcctattttgactaggctagtaaacaatgttttttttttcttgatgagtctagccaaggattagacatggtttggctgtatacatttttgtatagggttctagccctatttagcttctttcaggacctaaagatcctaatgttgccaaattagcattgtgcttctcaaaagatgaaaccattatgaatttctatggtcttggtcaaatagaaaaaaatggtggatgccatcacgattgcggtaatagttgcaatatcattaacacggcaccttgtggtgttacaacttattttgcaaacatcgtaatgtgatttgttaacttgaaaattatactttttattatagtgattcaagttttctaaaacataaattttaattaaagattatagatctttataaacctatagatattaaaaaagattataatgggttatatgtttgaataacaacttataatgccttttaaaccatggtttcgccaaacggtaagctttaattttgttacaaaacacgccgttatgtaaacctcatttttgcatgggcatcatacattagctcgtccttaagattagaacttgttatattatttgtccctttttatctttcctttttttgtatttctcgttttattcttttcaaaaattctgttcatttgccccatctttttatattatactgcaaattgacactcctattaccttcacaaaaatatattgtaaggatatggataattaaattataaaggaagttgttcaaggtcgaagaataagaggaagaaatgacggttgatatttttagagatagaaaaagtggtttataaagtataattgttgaggaagtaattagaatatgttaagtaaagtcgagtgcgtgaatatttgatggatattaaatagtttgtattagattgcaagttaaacgagaaagtttggacatatgcaactatgagagtattggtaaaaaagatcgaaagtttgaaaatttgtggatttaattaaagtgtgaaaaagactgatgacctagagggtaggagtcaaaaaggatataaaggatttagatttaccgaaaatggtgattcatgtggaagttttatgtagcttattgaatagtttgggatttagatgttgacattgttagtagttggtagggaggagggaaaagggtatgtgtgtgtatgcacgtgcaaatggacacacacatatacactttaacctctttttgcttgtttttttttttttttttttttttttttttttttttttttttttt

SEQ ID NO: 1632 - DNA, 8784 bp, Amaranthus palmeri
ttttcaccggaccggaattttagtacggttttccggtccggtctggtctggaaatttaaaaaccaagaccagaccggaaaccgtaatttttttaaaaaataaaccagaccagaccattcagaccgtataccagaccaaatacttaaattacggtttggtccggtttggtttacggtttagaccaaactatgttcagccctagacacagtcacacaactctttcaataaactgatgactagccattgtagattacagtcatttatggaggtcacataagtagtgtgatgttcccttccaagttccaatttagaaagagattctttttagcatcaatgttcatcttgatgttggtcactacttgctggcttgactccttggatcattattttgcaccaattgagacttgagctgaattgagaagctcatcagtgctctaaggcttatattactgtgcttcaaagagggttttaaacaggctaagtgtgttcaatagtggcttagaataaagatgaaatttgttgtagacttgtaacagaatgttggtttttatagatatatggtttcagaactataggccaatagttgacaaatagttaagctaatatcacttagcatatgtaggttgtaactagatgatggtctcttattgttagctaggctttttattgttgtcatatatataattaggtgattgaatatgaccttatttgccttttgcgtgaggtttcagccttgatgtggtgttgatactttctactgctaaggaacttatgacctgaaaattacatttctggtaatccacccttattggccgcctctatgatattcaatcatgtcaaattgttggtggttctacacatcttgcataagaatttgaatttatagcaatttctttttgaagttggttggctagatggccgtcacaattatcagatggatggttgacctgcaatgcatctgcaatagatcagatttgtggctttctttggcatattgctctgttatttgagtcagatgatttttgacctttattgtctaaatactagatattctaaattggtaatagtgattgagttgactttgtggaattgtgctatactgctattattgaatatgacaatcttttatgtgttgcagccgtgtcttgttacgtatgacacttgcttgtcttaaggagaaataaattaagtgtaggcactgtttatcatctaaactttccatatacctgccttcctgaccacatgacagcatgactttgccatgaaactaaggtcacaaactcacaagtggctgtcttttttattttctgaagtgtgtttatttcggcgcacatacttgcaagatttaatttgttatgatgttttttttttctgcagcgctataaatgccaattggtttgtctattactgatgaattgtttggacaggatgatggagtgcttgttattcctacatttcctcaatcccctccaaaagttggtggaaaagatatgtcatcagaaacttatttgagccctttgtttagtctactatcaattgctagcctatcaggatgttgtcaggtcagcaattgactataaacccttctctcgttttggtagtataataccttttggacatccgtaagatgaattgtaatcagtcttctagtaatcaattgatacatatttcttgtttattaccacatgcaggttacagtacctctgggatatcataacaaaagccctatttcagtgtcctttattgcgaggcaaggaggcgatcgttttttgcttgacacaatacaaaccatgtattcagctcttcaggagcaagtagatgcttctaaatcaaattctacacccagcacatatagtatggaacggtctgcagaggctgctaaagaaaaggtcaaatggcttacttgcttacttatttccatgcttattatctgattaactagccatgtatattgtatactctaagctagtgtgattgagtaatgaacttcattatgattgtcagtaaagcatgatgttgtgctccattaaagcattttcccccttttccttttttttgttggggtggggtgccttgcatcctcaaggcaagttctgttccgaagaaaagctgaatagaactaagcaatttgctaaccattatgttattcatgcatcaacttttcttctgctagccatccctagaaaaaaaaagaaagcttttaatctctttttaattttaacttttgagcaatgaatttactttaagaaaagtcattgtgacaaataagtatgcatagcacatatgatttgcattggtgatttagggactccttgtattttgaagcgtgttgcttctttaaggaaacatgattttctctcatttttgatgtttccttgtaaacttaataataatgagcttataactaatctccttccccatcacttggggtacctatataatgattcaactcattgcgctttgagtttccctggaccttctttttagtagataaacaaatgaggatttttcgtgtctttgttaaatttgatcataaggttctatcatgaaatgcgacagaatggttcattttatcatttcttgaatgacgtttacatctgtatttgaccaagatttctgaaatcgagtaattggttctaattggaccctatatatggttgttacataaccttacttgctaaacataagttggagtgtagagggaggaaaaatgattctttaaggttgctttgcttatatccttgttattgatttctttgtcctacgccatctctttttgcctcagggaaatctagcattcaaagataggcaatgggcaaaagctgttaatcattataccgaagcaattaaactttgtggaagtaatgcgacatactacagtaatagggctgcagcttatctagagctttccaagtatgtattaaaagtatcatggaaactatatgtagctttttcacaatctttgtatgaaatgatttgtgtagaggtgttcaatatagacccgatgacttgaaatatacccgacctcgttatccaaacctgattttgacccgacttcaaaatggaaccccgcctgaaaacatctaactcgaaatcgatccaatgacgtgaatgtacacctcttgttatttgctgtttcaattgagcctaaacattaatcatctccttttttgttatagtttaccattcaaaatgttcgtggttttattttatgtaagttgggtgatctcttcttagttggggaacatgttgtttacaacttattccctccttaccctagcgtttgtagattcatgctggcaaggttgatgctaaaagtagattattcttattttaatctgaagtagttttaatcttttaactatcccaaaggaatacagactatgtacgtgagacttggtttactactccacattgttgtacaaaactgcaaatagttatgttacatctataaatcatgatcaagatcttaggattctaggattttatgagataaaataaacaaccaatttaggtcattggctggttgttaagtttgtgggattttgtgatcttaattgaaaaaataatcgattggtaggatcataacccgatgttataatccaacaatttgatgcgatcctgctgtagtaattttgtgggataattggttgaaccttaaatttgtaggattttatgatcttaaattcttaactgaaaaaaattgagtggcaggatcatgacacgatattataatccaacaatttgattacgatcctgttatagtaattttatgatcttacacatgttcacattattgttactgtgattagaaaattgaaataattcatgcatatattgattcatggtttgaaaataattattttgtgtattctctactcccttcttgaaaactataactacttattatttccttcatattttggcacaaatttaagatcttaggacccaatgatctaattaggaaacaataagccatctttctgggttgcattttttatgccaattatctttttttctgttggggttcagacttcagacctttggttgttcgacgaagattgttaagatgtacgctctcagattgtcaaatcttatcttcttgtgcctgacctatttcttaacgcactgatcccgggatatgatggatgtaatatcacccttgggagatgagtcggagtcttagttgttactagtttggtgtcttgataattaggaaattctatagacaatcttgagttagtatatcatatgcaaacatttatgattgcttcttgtttacatttgtaatttaaaatttttaacttgctatgaaaggaaatggtaggtaaaagatcctatttcttgaaatacccagtaattttcttttcttttttttttcttttttcttttttttttaatcacaatgtagatattcattatctttataaaagcttacttcccattcaaagacaatacattggacacccctcagtaaaatttttaattttatgatgagtacgtcaatctagctagttggaccttcttttgtataaggggagggctcattcgtgctaatgtcgatgagcaatcttttgggatttaggctataacgttgttatatgctatgtttcatgatcatgggatgtgactaggttctattgagctagttcataaagtcgaccccaagtttttgagatcaacgctttggcattgttgttgatgagtgtgacatactgattgctcttgatattgttttatttaggttttagaagatgcaaacctagataatatgtaaacaactcgatggtaactgctgtccaaaaatctgatattgaacaaatgaattggacatattttagtctgtgtccgattgttttaaccaatcatcttcccccgagttgaaatgaatacctgcgaaagagatgaataaagctacctggtttaattataaagatatactgtgttaagtgatttatatggctactgggttgaattggtgtattcttgtcatcattcctattaaatgctaatttcttggtgccagctatcgccaggcagtggaagattgtaccagagctataaatctagataaaaaggtatgcctatcagtcttcatctcatcaaaacatcttgtgaaccactgtttttttgttgtgtcaattgtttcattgttttttttgagagaagtttcattgttgtttaattcccatatggtgctcttgttttttatggctcaactctaatttttcacgttgaatacaaatatcatgaattatgagtttagtacattctattacgaaagggaaggtgcttagaagacaggaggagttgtagaactaagtagataaaacagagtttaaacaagaacaataaaaaagattgaaactatgatgaatgaagctcacacaacacataaatggtatcttggatacccaccactcaaatagtttttatttcattaactattcagcaatacattaatgaaataaacctcaccattgcttaagaacacactcgtaagtataaaacttccactttaaacggttcttactcatcttatataatgagatccttttaggttacccaaccccttgtttcttttgtataatccttctcttatgtttaaacttgatttagggaccttatatagtccctaaaatatcagaataagccttagtcctaaagctcaaacgtgcccaccaaggtactcgaacgagcacatctaatttcaactcactcattccatgcatcccatgcctctttcaaagcatcccttgtgcatctccttgctttgtatcttgccttgttcaaggcactcttcgtgcactctcatcttgttttgtgtttcttcatctccatggcacatcaaagaatctctttcattgcttccttgaagccccatcatttatgcacttaaccaccttgaaccccatcattgctcacaatgtggtgtgtcttggattgagtcatatggtgatcaacatcacctcaattaaatattgatttggctcttgcactaacatattatcccaatgccattaagtgttgtcagggtttgggggtctaccgtaccgttgtaagggataacaaaaaagcatgtgatccagtgagctatttttaaataaatctattatctattataattcaaaatcaaaaaactataaatctttgatcccattaagaatgaacatttatagagaaacatcttttcacttcttatttgcaaaaagttctacttttttccgtttacaaaaaactaccttttaacattatttttttcggaagcttcttgtatcctttgatttaacttgtgttggaaacttttttaaactaacatgaacggaggtcaatttttggaagaaaccccgttttttgttttagttttataggctaccttttaaatggtagctgatcacatataatgattttgtaaggtagtttcttacaaaaaaaaaatttagttaatagttttctattctgaaaatacaagtaaacttatcatagtataccaataaccaagtggtagtacgttgctaaaaagctttcataactctgtttgagtcttacacttctactacttccttttcctttattcttaattgaaatcttgcatttttattttagtttgggatccacaccacacccacttaataatcgacttaataatctaatacaatttgtcatttatctctccccctttaacccacataaatataatccatttaaaaccaattccaccttctctttcataatatcacaaatggctcaatttatcatgtgtaattcgtgtttatttaaagttgcgaataatcaagggtcaacacatatcattactaggtaatattgcgtacatccaacctctaaaacactacctagtcgaagcctagtgggagccacttagcggctactatttgatatgtaaaacacttgtgaaagtaattaaaaatttaataatagaaaggaaataagtgttatgacaagctgtacatggttaacacttagctgtaataactaataagttcatacatcatatttagagtgaactatcatgttaataccttggtgcatatcctcaacttttactattggaccttttgcagaatgtgaaggcatatttacgtagagggacagcacgggaaatgcttggctactatgaaggggcaattgaaggtgcgttgctatcctttttcccttccattgttactattgctttagactggagcacgacttgcaaatataagtgttgatcttcgttgatgaaactttatgcgtgtaccgaactgaaataaaatgcaatcagtatgagtattccgatgctaatgttttgtaccaaactaaaataaaatgcaaaatgacttgcaattggtatcagtatactgatgctaatgttgtgttactagagtaattgccaaaatctcattacatatgataccttaaattgtagtcatatgacgtatatctagctgcatactttgtctacacaatacattgctttgcaaatgcaattggctacttatttcccctatagtagacagtcatcaataataagagatgctctgtcgtttgttcttattgatccgaccttgtattgctgactttttgtaatagttggatcgttcccactcatatttatctgctaagaaccaccattttggaaaacatggcagacttatttgcgcattgtaaattagtcgtagactcgtagtaattgaaaatgctgttagtaaagtccagggaccagtagtggtcgattcatgaactcgaaaaagttgatgcttctcagctgtcaggttagtatttgctgtttagaaaataacaaacgatatgatcttctatgtttcagattttaaatatgctcttgttctcgaacccactaacaaaagagcagctgctactgtggagaggctaaaggatttagtctagtaggtttgttcggaagcatcttcatgcgttgaaggatcgtacaaccatttcaaatctgtattttggtaaatctcctggttttcacgccgttattttgatggattattgtctccgtaatcgtggctgaggtaacttggacagtattttgtcacaagtaattttcgtccgagatgagatgagtagtacataacggcatttttgtcgaacagtttattttcatcatctgtttgccagcctaggttattatatttagtgagcaattttgtattgggggggttttgtgagtttgctcttcacttgaaattaggattgaaaatagttgattatgttttttttatatgcaaaatagttaattatgctaagttgctaacgtatcttgtttattatgctggtcgatcgattgggtgaatcgagtttgtcgagttgagttattttaagccaaacatagctcccagatgattcaaggattcttacaaaaataagcttttatattaaaaaaaaaattcccataatacttatctttttatatacaacacttatattttaaaaaattttatgattcaatatcctagaactggctaaaatttttttactttattctatttattttgcattattttaaatgatgattaagaattaaggattgaagagtactttgatatgatagctaatctagatggataccaattaagattattgtgagtgtaaccctatatgaactatgaagtccaatatgtttcattttactctattttttttaactttgttactttatactccctccgtttcttcttaattgtccactttccttatttggtaaagtcactttacttgtccactttctatttttggtaaaactttttacctaaataccccaaa

SEQ ID NO: 1633 - DNA, 1646 bp, Amaranthus palmeri
cacgacatctgtaaaacgttagctatcatcttttggactgaaaaccagattaccattagaggattgtgatttgtggcctgtgggtgaggaaaagagatggagttgcattatggtgctttcatggagaaattcacacttcttccatcttcttctgggcagcttcctttatctggtctttcttttgctgtcaaagatatatttgatgttgaagggttggtaactggatttgggaatccggattgggcaagaactcatctaaaagccaaatctactgctcctgttgttttggctcttttgaaggcgggtgctacttgtgttggtaaaactatcatggatgaaatggcttacagcatcaatggagaaaacatacattatggtactcctagaaacccatgcgcagctgatcgaattcctggaggatcttctagtggatctgcagttgctgttggggcgaacattgtagatttttctttgggtacggacaccggaggaagtgtgagggtcccagcagcattttgtaaaatttatggaattcggccttctcatggggttgtctctgtagatggtgttgttcctatggcacagagttttgatacagttggatggtttgctagggatccggcaatcttgaagagaattgggaatgtgctactcccaccaattgatgctaatcttacaaactctaagtcaataactattgctgaggattgctttaaacttctaaacatccccattgatagagtaaaagaggtccttgtcaagtcaatagagaaatcattcggaggtcaagttatcaaatataggaaccttggggaatacattgagacaaatgttcctagcctaaagcattttatgagccagagtggtgatgcaaaagaatacagcgtaccttcattaatggctctctcgagtgctatgcgaattctacaaagatatgagtttaaggttaaccatggggaatgggtttcttccactaaaccggaactgggaccaggattaaaggagagaatttgggaagctgtctcatctaatgatgataaggttgacatttgcaaatctgttatgactgagtttcgagatgcacttacttcgtttctgggggatgctgatatcctagcaatcccaactgttcctggtccaccgccaaaattacagactgcaacatcttcgttggaaacctttcgcgctagagcttttagcttactctccattgccggagtgtctggattttgtcaggtaagtataccactaggtttgtacaatgatcttcctgtgtctgtatcgttgttggcccaacatggctcagatatggttctgctaaatcttgttgaaaccctttctggaactcttgaggagcaaataaatgctgctgaaagatcgagattgtgagtctttaacatgatttgaaatttatctatgttctttcgccaatgtgcgtccgaagcgtcttcaggtgaactctttgacgtgtattcatcctgtttaccctatgtagagtaaataattccaatgaacagctagttatgtgatagtttttggtgtcaatttctagcatatcaaaaatacactatagacaacattttattaccagtgtcattagtgacttgtaccttggtgaggtatgtgagagtcagatgtaagcaatc

SEQ ID NO: 1634 - DNA, 1354 bp, Amaranthus palmeri
gagtactttcatgactaacgataatattgtggatgcctcctctgagaaagatttgggaaatgaatactttaagcaaaagaagttcaatgaagcaattgattgctattccagaagcattgctttgttgccaacagctgtggcttacgccaatagggcaatggcttatctcaaaattaagcgatatcaagaggctgaggatgactgcacagaggctctaaacttagatgatcgctatataaaagcatactcacgtcgagctacagccagaaaggagctcaagaaactgagagactccttagaagatgttgagtttgcgttgaggctagagccacaaaatgcagatctcaagaaacagcgtgcagaagtgaaatccttgcttgagaaggcaattcttgcaaaagcagcaggaaaagttacaagagctgtgcctggggtgaaagaaattgagaaacaggtagatgacaatggatatgaaaaacctactctgtgtgcgtctgaacgaagtaagaaagctggagttgatgttcttccagataacatcccactatctttgaacaaaactcctgattctggagagagagatgtcaaaatcaaaacatctggtgatagacacaggcaaaaattaaatggcttgcatggcattgcatcaagcaattctcctttgaaaaacaagagtgggaaaaaagagttggggacatcagttcaagagcttgcatctcgggctgcatctcgagccatagcagatgctgctacaaatatcagtaccccaaaatcagcttatcagtttgaaattacttggaaaggactttgtggtgaccgttctttacaagctcgtatgctgaaggccactcaaccagatacgttgccacagatttttaagaatgctttaactgcccccttactcatcgatattttcaagtgtgttgcatccttttttgttgacgagacggagcttgcagtcagctatcttcaaaatttgacgaaggtcccaagatttgacatgatcattttgtgtcttcctccagtagacatggacgagctttgcaggatctgggatgaggtatttcttagcaatgctactactattgagcttgcagaattgcttagcgacctccatccgaagtattgccctcgacgatttcgatgatctagatttaccatccttcaacattcaggacacactcattttttatattgctgccaaattttgtacattgttaatatattttaatttttacattagtttttttaggttctcttgaagtatagcttgaatattttttatgattagtttagtatgaggtttgatgggatttattttttccattttctggttacataccaattaaggctg

SEQ ID NO: 1635 - DNA, 566 bp, Amaranthus palmeri
ggaacaggcatgcttcttgcaagccgagaaggattgcacaaaagctatatcacttgataaaaagaatgtgaaggcatatttacgaagaggaactgctagagagtcgcttatgcgatataaagaagcttctgcagatttcaagcacgctcttgttcttgagccacataacaaggttgcgagtaatggagaaaagcggttgaggaagtttatgagttgatcatctttcgcttacaagaaaaacatggtgtttatagaaatacatttagagtgtgtttgaataacattttacgaaggaaagaaaggggagtggagggaagatcaatgtatgatccttccaaatcgggatttttctcccctctaattcccttcccaattctccccttttggtacctaaatcaaggaaatggtatcgttcatgttgttccattctttttatccaaacatagcattggattcgagatatattttgctttcttttgaatccgtgtatatttcggagattataaagaactgtacacaaattttcagctgattcataaaatggtacattaatattgtcatatgac

SEQ ID NO: 1636 - DNA, 4219 bp, Amaranthus palmeri
agtttggacaaacataacaaatgcaatgatcaaactcgccaacttttaaagaccatctccattcttccatttcaaaatcacaaaaagtcaaaatttttaaccaaattcaatcaatattttcttctgatcatgtcagattccttaaaaactaccctagcaaataacccaaaagtttggattttgattggtgcaggagttgcagggcttgcggttgttgtttataaagagagaaagaggtggaatgagaagaagtttctagaaagagaggattttggagcctttgttgaacgttttgaacttctccctttttctcaaccgccacctcctgctgctcctttgcctctcaatgggctctcatttgcaatcaaagacatgtttgtcatttcccaatttcaaagtttttcttttttttgatgaattttagatgggttttgatcgggaatttgtgttttttatgtttttgttgcagatttgagattaagggtcgggtaaccggttttgggtgcccggattggaagaagactcatgaagagggagagaagacagcagaggttatcattaatttgctgaagaaaggggctacttgtgtcgggtcgactgttctggatgagctttcatttgggtaacccatttcattttgttcaaaatttcatgtattttgtttatttagtactcctattagtttgtttgaatatggaaattttgcattcaatgttgtaatatgctgtgttgtggttgatggtttctcaattttgaccattttcttatgcatttgccctaatttggttgtagagactaggtcggaatttttcttgggatcatgttctatttccagagtagtgatcaaacatgccaagttgtgattttaaactatagtgtggttgatattttttttggagtttgtggctcattaaatcatatccattttattcacgtgaagttgtagtctttgctatcaaggatcagtcaaaaacaacctcttaattcgggtaacattatgcatatccgacttctaaattccctggtgggagccatttaatggattgaggttttggaatggaatgggtaacattcttgcgctgggttttaggacgcagttcaacaacaacaacacaacatttaattaccccaatgccattaagtggttcctatctagggtgaggtttggaagggtcgtatgtacgcaacattatccttctgaatgataaaactaacaaaggttatttttgattgtcacatggtagcaaacgtcatgtgcaatttaccagttcaagtgatgaaattaatattgaattcgtttagcttaatatcaatgtttgcattctgcttgcttgatgttttttgtgaagttactagttactctaccttgctgcctttttcttctatgactgaaaaggtttgctgacatgaagtagtgttgcttgttcaggataaccggtgaaaatttgcattatggtactcctactaatccgtcgacaccacatcatattcctggggggtcttctagtggctcggctgtagctgttgctgctcagcttgttgattttgcacttggtatgagtttctttcttagtgtctataatgtatcagtaagttatctttttactaatggaaagatggatattattaggtacccgaaattcgttacataatagctacttaaatgcattacataaagagaattatgttgttcataactatacttgcttattttttcattccgtctgcttcatcatttcttatattttgtctatattttgtgtttgtttaatctcttagtcttagcatgttgtatgtatttcacatttttacggatatttcactatgtctaaatgctttttcatttggctgttcaattcacagtaacattaatgtgaagtgttgagtgtcaataagctttctgagcgtgcaatctgaattttgcttagcataagttggcttcgacttgaaacaactatttagccattcaggttttctttttgatgtgataacttgaatttcttctggttagattttctgacaaaaaatataatcttccaggcgctgatacaattggatgcgtaagaattccagcatcgttttgtggtatttttggatttcgaccttctcatggggctgtttctatggatggagtcctgccaaattctcagagtctagatactattggtaacaaaccattctgttaaaatgatttccgtatttctgttgatcttattgatgagtatcaggttcaaaggtcttgctatttagtgatatatccttgtctttctctctcaaaatgctttccgtagtatgaactgtaaatatttaccaatgattatggctttgctcaattttattattcaggatggtttgctcgggatctcaaagttttacattgtgttgggcatgtgttgctgcagttgaaggctgagccaaggaggtcaaggcgctttgtagttgcagatgatctttttgaaatttcaaatgcttcaatacctaaaacaacacattttttgaaaaagacgacagaaaatttatctgggtgtaagtgggatgattcatttatatttgtgaagttttcttttttgctgtaattgattaagtttgaatgcttagaatattatgtatagtgacaagaatcttatgatttgatatagaggtgttgctacgttgtagggtgttttttgtttgtaataggcggtttctaattcattcattttgcagaccaaagcccccagcatgtaaatatcggccagtacattgcttctaatgtgcctagtttgaaagcatttcgtgaagagtcttcaaatgtgaaaactggagtaggagctcttcgtgctctttcatctgttatggttttacttaataggtatcttctcataaaactgtgttaaattttgttgtttgaagttgttacttttgatcattgacctgtcatcaaattatcgacaatccctacattaattagaaagaattttggttgctctaaatgctaatgggttcgaattgtagccgctcatggctatttttgtgcgtacatcgtttctctctattggaacaaccaattacaaattgaaactttttaaggatgaagtaagaattacaatctatgctaaaagcgaccatggagtttatttttggcggaaagggaataggtaatagcatgaggtgttggatgctagagaaatttgacttagcacccacgaaagcagtgtcattgaggcagaatactaaactatatatgacattcaaaataatatggtcaagattgcatgtataatggtgggggatagccttcattgttgagaaggaaacaacctagatttagctgacaccccggaatgactacttaatgataaagggtgtacagagtgcaagagatagctaggaggtttgcctatgtgcagccacccttgaaagggagcatagcagctcacacaccgagcactcttgcacctaagattaataggggtaaccggtaagttatgccgaagacgtgagatataaataacatctgtatgatgcgttctatgttaaaggagagcatctacgcagaccatgccaagattaaacgaaagtgcaatttcgaacttaaggatgcaaacatcagtcggaactgaaaatccaatgccttgaaaacgtaaaatgcctcgagccaacgttcaagtaacaaaaatcattattaatattggagcggattatcacaactgatctgctatcgttgtttttgtggcagacaaatacccttgttacccaattgagacccccagataccatatgccaacttatgggaagcccgcggttgtataatgtggatatcattggatactggaaaaacaagatttatcaaccatggaactgttttactattattggtctacatgcgcaatgcacgtttatgaatttctaaaaatctattttacattgagcattggtagtcttattgggctgtagaattaaactcattcttcatcatgttctgttctgttgctttttctcatcagtgattttttgttttttaaggtccatttttactttgtctaggtgctatttttgatgctttatttgtgctgatcagcttttgaaatgcatatcagatatgagttcaaaacaaatcatgaagaatggatcacatcaaccagaccgaaaatgggtgctgatgtatctggacgtatccgtacagcaattaattcaatacctgatgatgtgaagattctgtataaagtgagggctgaat

SEQ ID NO: 1637 - DNA, 3794 bp, Amaranthus palmeri
ataaaggtatatccaaaatttgttgcttgtacagcttcttcctcccttcccccccaacacacacacacacacacgtatgcctttactccctcctttctcttccgtttgaaatctacacttaaaactataattatgagctttgtgatatttgagctcatttggttgcttgattgctgtatacatgggtttctataaggttgaaatgtcatgaatggctgtgaggggtaaaataggaattaaataacttggctcacacttatttctgttttatcttattctttgagttgttccttttaattttcttttcgtgcgccttttcatatttgaacaaattcctgataatttgattctattgactcggccctctcccgctttatattttatcttataatatgtatttgtttttttagggagacgggctactggttcttcccacagtagctgatcatccaattaaacgcaactcaaggaaagctttgtctgcagagttttatgataaatcactagtcttatccagcatagcaagcatgtccggttgctgtcaggtatcgaacaataagcttcatttctttttgttggttgtgggagtagggattcgggtacaaaattggttgaaatatttttttttacttactaaaaaagtttgcttatatttgtagaaaattacattttttttgttgtttttccagatcacggttccattgggagagcaggatggctttccaacttctatttcatttatggcttttcatggagcggacaaatttctgcttgatactatgttggattgctactcaacactactagagcaagcgaaacttgcatcggagtatgtgccattgcccgatgctaacggtcatttggatgcttctgaactgctgaaagagaaggttagttttttataatgttcatattgcaaggtttgtgtaaggtaaattagatttatgataatcttctctttacgctcaatcaacatgccagttgaaaattcatcgcattcataatgaaggaaattgataattcatctcttttcttgtacttctcaacataccatgctataaatactatgtctatagatgtgggtatgttctgcataccttagtcctttcgataaattaaaatcaatttgagtgtagacttttttccatcaagagactcgtgttaaaagtgggtattggacgttgattgtgatgagatcatattacttctcttttgcactaacgttataattaacttatggaggccgaagatcatgatctatgaactcccgagctattagaaaccatcattgcccacctttgcagcaccatattaataaaggatcgatttaagtagccataataggagacaaatagtcgcctgatccaaatcgggaaatggctttcaaataactctgaatggtttgtcaatgccccattgtctggttagcttctagtttttcaatacgttaaatatcagactgaattgaagtgttagaagcagctaaaaaacgtaggaattgcttggttttgttgatgtaagatcgagtgatttaaactattctgacgttgcatgagaggccaaatctgttcaattaattatgttggtgtttctattataataatttctgtctgtttgtattatgcttacagtctttttgcctaatctgctggcagggaaatgctgcttacaagggaaaacaatggaaaaaggctgtcagctactacactgaagctatcgaactgaacgggaataattcaacttactattgcaaccgggcagctgcatacttggaacaggcatggtaagtaaaattcttttcaattttggtttctcacgtgttgacttccatatcaacaagagctagattagattacaaacgaaacatgcttaatgcattaccgtagtgtattttgcctaataaatatgtggtcggatgttcataattttatcctttgtgataaaaagggttgtttccaattgattttaatagcaaacatcatctgcaatttcacatatttaagagatacacatgatttaattagtcaatttactatccattataaatccataaccaaactactaaagtttcttttaaacaacaccaaactagttacattttcgttcaaaccactaccaatgattaggatttctcccgttaaccactccatctctatcaccacttcattgaccaccacaccatccatgtttttctcttcttcgatgcttccaagaagggagataaaagaaagaaaaagaacgatgatgtggtgattaataaatggctatgttctttaactcgatcgtattctcatgttgaacacatgtgtaaaagtgtaattacgacttgactatattatgaaaaaattccaagattttgaaccaaattggagtgtccaagtgtcttactcatctttaagcgcctcggatttgacaagggtacttgagacaaagtgacgagtctgagcatacctggtgtatggagctcctttcaatggtcaactgtttatttcggttattgttgtaggagggctatgtccattttgtcttgtttttttattgaatgttatatttcctgtatcatcaataacagaaaaacttaacttttagatttcatggttaaaagcattgatggccattactttctgtaccttcccgaatgctacttgtgaaatgagtttctgaattactcctattttttgtgctcgttgatgtagcttcttgcaagccgagaaggattgcacaaaagctatatcacttgataaaaaggtaagaacatttttttcccttttcatacaacaataaatgcttttcttatgtttacaatattacctgcaactgctctgattgttgatttggtagttcaaaacttcaaattaactcaattggtataatattagtgcaacaacattccactaccctaacgccattaagtgacttccaccaaggaagggttgagggaaggggtttgattagaggtgctcaatggatcgggtcgggtccaaaattaaatgggctgggtcggggcgggtcaagccgtttaaatccgacccactgtgacccgttatttaaaagttcataaatagttttttattatactttcgttgtcaacccaactatgtatataaaatatcatataaaaatattaaaaaaagtggtaaaatattttacacaactttcctataagtatccggcctggtccggtccgaccctttacactaagacccattaatgacccgacccttcacctgttgggtcgacccgccccgttgaacacctctaggtgtgatgcacgcaacctaacaaagaggttgtttccgattgacccttgatagaaacattctgagaagtgatgattcaaagactcatttcaatatagttcattgtaatccgaaactaaatatagtgttggtatttatcatatgtggatattttcttttcttaaaaggaaagctatcgcactaatttgtgaaatagcgacattgttcagtttattttccatttatgtggacaccatttttgattagtaatgtctaatgtgtattgcagaatgtgaaggcatatttacgaagaggaactgctagagagtcgcttatgcgatataaagaagcttctgcaggttctacttcgactcgatgcttttagatctatcaatattgctaatgcttatttgtatgagtttttaatcattcgacgccggtatttgaggtaaaatgaagagtttgtgctacttagcttaaattaaattttttattatttgcagatttcaagcacgctcttgttcttgagccacataacaaggttgcgagtaatgg

SEQ ID NO: 1638 - DNA, 11695 bp, Amaranthus palmeri
caagtaaaaaataaggtagaaaacacagaaaagcaatggaataaagaacacaactatttataattcaacaattaactttatctctcttgagaacttaaagagataaaagatttcacaaacaatggtgatcaccctcaaagctttcttggtattcacctgagcctatctttatatgtcttgctcttttgtgtttgtgtgttgtgtatgatcatgaactaacaaaccctttatatagaaaacatacgccattctagaattacatttaacttaggatactcagcaatacttgtagattaaattccttcattacagctatcaagaggaacaaaaccaaaaaaataatggatggattttaaattgaccgctcgaacgtgccaccatatgctcaaacaagcactgtgatcagaaggctactaaagtgggctgctgttcatgcacttgctgttttattgttgcctcgatcgagcaatcttcatcccatgccttgtctcattcaaggcatggtccaacacccttagcaaagcctctttttgccttgatcaaagcctcctttacacacggtgcatcctatttgcttcatatagatcactttatgtagtgatccttattttgtcatcacaaatctacacatccacatcctcctttaccaacgtgcaagacatgacatgtttgattatgtgatcaaaatcatcttcatgattaggatttattaatacttttgcttcaacacaacatttttttgtttttaatgttatttgtgcacaattttgcctcttgatatctttaaattgacgcaattaaaatacatacatgatgaatcaaataaaacttttaacttgactatatttggaggtgaattgggctaataggttgagtttatagtatacgcgaggcaatcaacaactcatttgactctattttggatatatattctacttttatagaatagattttatgaaatgccaaaattataagctatatatatgtttttaacaaaaacaaacagagatatagtggaaatggagggaaaggaagggtagtagaggaggggaatagagggattgtatttttttttttggatatcaacatggaaagtaagaggaattaagagaactgaattgaaaggagaaaactttttcatatttaaattaaacaaatgctaacattaaaaagaggaagaaaaacacacccatctttgctatccttccctttccttcaattccttttaaatgtgttatctaatcatagttacaattctgttttcttactctacttattgattgtatgttaacaacaatgactcttagttacatagaggtgtgaccaacatttcaaaagatcatgttgtaattaatgggatcccttcctgaagtatagtcttgtgtaaatgttgtcatgtacgaaatagattggagctagctaagataattttgttccagttacttgggttgcatacatactaatattacgtcttctccatagcagggcaagtgatcaaaggatgggatgaaggtattaaaacaatgaagaaaggagagaaagcactctttactataccccctgatatggcctatggagaatctggttctccacccactatccctccaaatgcaaccttgcagtttgaggttgaattgctttcctggactagtgaaaaagatatatgcaaagatggaggaatactgaagaagatacttgttaaaggtgatgggtggcagaatccgaaagatcttgacgaagctttaggtaagctcaagtttatcaatcttcttgtttgttgattcattggttatattattgcagagaaattaattttacttcttatacttgcagtcaaatatgaagctcgacttgaggatggaacattggtgtctaagtctgatggagtggaattcactgtaaaagatggttggctccaaaccataataaaatttgctacttgcaatttacatatgatcaatctttaggcaaaatcctcaagctatatttcctttgtgcaggtgttttctgtcctgcattggcaaaagcagtgaaaaccatgaaaaagggcgaaaaggttactttgacagttaaaccacaatgtaagttcatctcaagacagaaaattattgctaatttgtaggaaatttagagtatctggatatttggaacagttttgttctgtcaatatcatcggcttaagtttttggtttacgtacctatgtgatagaagggcataagttaaaatatgatttaaagtcattacttgaattggagtatttagtgctatgtataagtattcatgttctaccacgttataagcatagaagcctcttgtgttgagagggcttaatagtaaatagagcatatgacaatgttatgtgtctagaattattgacttatactgttggtgagttggtagcttaacagttttgtttgtgaaactgcagacgcttttggggacaatggtagaccagcttgtggtgatgaagcagctattccaccaggggccacacttcagattactctggagctggtttcatggaagacagtttcagaagtgaccgatgacaagaaggttctcaagaagattatcaaagaaggtgaaggttatgagcgccccaatgatggtgctgttgttcagggtaagtccaaatcagtgtaacataactcttctcaaaatggctcaaatatagcctaaatacaaacataatttcttattcatgaagagactaacaaattgtattccaacttcaaatgccaaaatgtgaaatttgccttgttatcaattcagaatataaatgactaatgaacacccctgtttatttcttccatcagtgaaactaattggtaagctacaagatggcactatttttgtgaagaaagggcatgatgatgagaatttatttgagtttaaagtcgatgaaggtacgtaatttcattatctaatctcctgaaattatgctcaattggtaattatcccttgatgaggccttttctaacttgcgattttatttcactggcagaacaagttattgatggcttggataggtcagtaaagaccatgaagaaaggtgagattgcactattaacaattcaacctgagtatgcatttggtgcatcagaatcccagcaagagctggcaactgttcctgccaatgcaactgtgttttatgaagttgaactgacctcatttaccaaggtgagtgttattggtctgtggccttttagaatcaagaatagaacgcaaatatactcctagtatacttggacatggatatatcatacatccatcataactaccccatttcgttattctagtgctattgtgagagtatgagatattctggggctacaactatcaacttaagcttttggttgatttgtatttttatatctatcaagtctggtagatggattttcgcataagttttacatctttttgcaaccttggggcttagaaccaaccctgctttcgttctaatctagctttatagttgaataaattattcaaacaattaaaaagatggttgaactatgtccaggagaaagagtcatgggatatgaatacacctgagaagatagaagctgcatctaaaaagaaagaagaggggaacactttattcaaagcaggaaaatatgaaagagcatcgaagcgatacgaaaaggtatattttagagtcatacatacatctcctgatctccattgagcttcacttgaacttatgatctactctacttcacttccttgacacattctactatgacaggctgtgaaattcatcgagtatgattcgacatttagtgatgaggagaagaaacaagctaagtcattgaaggtctcatgtaaccttaataatgctgcttgcaagctgaaactaaaggattacaagcaggctgaaaagctttgcaccaaagtgctggaacttgatagtaacaatgtaaaggcactctatagaagggcacaggcatatatacaattggttgacttagatttggcagagattgatatcaaaaaagcacttgaaattgacccacataacaggtatttatttgtctctttcttcatatcagctttaagttcgcccaagatttatgtggtgtgctagtagtatgcttctttgtacataactaaatctatgaaaaatggttacttccttcgttttactgatttttctcgttgtgttagttttgatacgttctataggtatactttttttaacgtgactttactagtttacttgtattatcttttgtacataggcttttttagatcgtcctttatatataggtatatcagtgcgatatgttatttttattttgtgatgtttatgcgagactttgaccatatagaacactattgcactcatagtctcatactataatttttgtaaagtctaatataaatttagaagtgcatctttatttattatacatcatcaataacctctttcattgtacgcttcaatttgctcttcacttgtctacatgttcgaattcatactttctagtttcaagtctgtgtatattattttagtgtgcactaagtttatataagaccagtaaattgtattaatactcatcatttctattgcacattgtagagatgtgaagatggagtacaggatcctaaaggagaaagtaagagaatataacaaaagagatgcacaattctatggaaacatatttgcaaagatgaataaactagagcaaattaagtcaaatgtaagtctagctacatgcctttggtaaaccaaatctcaaaagtaaatttcttcctaataatttatattctaactaattttttttttttttggtgttttaaacagaaaatgtcatcaactcaggacccaatgccaatggctgttgatagcaaggcataagttatagatgttctattgttcgttcctaattgatgtttgtgtcacattattacctaattgtttgtgtcacttgacattgaaattctggcatattgttatattggcttcaaatcaaggcatatggtttgagtcgtgaattgtaagccttgtatgtagaggtgtttgtgtaacgtatgtgatgtgtcaagagttagtatttgcgttaatattttgggtctcctttcttcttctttaaagttgtatacttgtattatttataactttaaataagaatatggtttgaggcaacaaattatgttatttagcaagtttcttttatatatttttggttgctaattgagaaaaataaatataaaatgaagatgcttttacatatatggtaagtgttcaataagattctaagaacaataatgtaattatggtcaaactagccctagtttgatctaaaaagccattactgatttcaaaaaaggaaatttataaataaaatcaaaaaactaatatacatgaagagagggataaaatctataagaaggttatataaaatactaaggataaaaaatatattatacattactgatttcaatgataattaaaatttaaggttaatttatggctagaaatatttaaattattaaagtaactatgatataaaagttttgaaaattatttttaatttataacttaatattctttttgtgaaacaaaaaggatgttggtatcctttaatataagtagtttactagttttctaatttgtttttatatctatattttcatattctctaaaatactttatcatatgttgtattttttttatttttttttttgcaattaaattgaaaatttattagcaatgtaaaagcatgaaagcacaaaaggaagtccttcaaaagatgccaaaacacattaaggcgccaacaaaaacaacaaagaaagctccaaaagctacaaaagaaccaaaggaatcaactatacaagcatctaattaaaatcaaagttgatcatatccattgcttcatagggttgttacttttgagagcacctatactgattatagtttttatgagcgcaatacatcggatatgatgacgatgataatttggaaattggaatggtatttgaaagtttgcaggaggcaatttcttaaaagtaaaaaaatttgatacaaacaatagagaattgagttttgcctttgtgacagcaagtattgattcttcatacaaaacctgaattcgattcccgttcatctctcattttcttatctatccttaaccaaaaagttgatacaatatgctttgataaaaaaaacttcaaaacataaaaaaaccccaacatataagacatcgtcaaaacaaaagaatattgttttggcggtgattttggtaataaacgcaaaatagtttttgtgttcaatatagtgatttttgcaaatgttttaaattttatttctatcatactaaattgaaaagcatttttaattttattgaaacatgatatatgatataatgtgaaattgcaaatgatacatgatgaataagttgatcacatgttttgtctagtgggtgtttttaattctcattcttacttagagcaaccaaccaattaggtatgccaaactccaacactctcaaaactcttcatcattccaaataattatatgctcgttttattttagttgcaactaatagtaacatgttgtgtagtagtgaaatgtcattatcactgacatagtatattattaactaccaatactaatattaatatattaaactaatataaatgaataatattagagttatatactaaatactactactaatatactaatactactaataataagtattattgccattgatatattctattattaattacaattggtaaaattatatacaagctagtaaatagtaatgttacctcataaaatgactttttcaaaaaattcttcttcattcgttgacctagacggatacgaaactaacccatttcttgaatgacccgaatcaaaattactcaactcaaacacgattttttgacaatgaaggggttaaataattaaatacttttatcttatttgttacatgcattttgaccgcaattccgagagatttttgttcaaagtaatcaagctaaaaaaatagttaaaaattaaatttcatctcccataaaacaattaataattaaattgattttttaaaatgttagacccaagtcaaacttctagaaagctacaagactggtatgatatttcttcatatagctcaaaattcacgcaacttccagataggtagtagaaattccacaattttcacaagtttttagaattctataattaaagacaaacatctttatctttgttgaccctttttggcaattgccaaatcaaaaccttgcagcacatgtcccgtcattctagactaacgtaccaatttcataatttaggtgtttaaaacagacccgaatccgatgatctgatagaccctcgattttataatcgaatctgatttgaccagacttaaaaatggatctacaattatgtaaaaacaaatgtgaacacaaaactcgattttaaaccgacctgaaacaccttaccagaaatcaacccgatgacccgaatgaacacctctacctcaatccaaccaacacaatagatcggataataatttaaaaaattatttttaattttactcaattttagagtttttattttaacgattagaatggttatatatttcgaattaattagattagatagagatttattcgtaattgtaaagtttgagttttagttttaaagatcaaatgggtcaaaaagttgacaatccttgttctacccttactcaaaaatgacctagactcgctctcaaatcaaattcatggtaattttagacccatttttgcacctaaattccatcaataataatctgaatcaagttctaattaaatctttaaaaatgtaaaaaaatgataaaaatagtaatatcaaaatagtctataagaaccccaaactcattacttttgactgtttggatttgtatttaaaattataaatcatataaattcaaatttgtatcttgatctaattaaaataattaaaaaataattaagataaaacaaaaattttattggacttacctacaattatcccttttaacaacaaccctatgactacaaaatttcttaaaaaaaaaaaacaaccctatgactacaaaatcaactaattaagggtgtgtgtagtaaatattttttttaatatattagtgttttcattgtagaaactacggttttaatattgattttatttgtgttccaaaaaaaaatattggttttatttgacatatactacctcttattcatagagaatgagacgtttattttttgacgctatttacttattactcttaatttgtattttattcttaatttatagattagaacatagtcaagtgagatcttgtttgattcgtctcaatgcaaaaattattaatatccactttttataatatttcgttataagtattgataagtgcattgacttgtgtgaaaaaacaaaatgtcttgtaatctatgaataggggggagtatctctctatgtttaatgtaaaggatagtcaaaaactatattgtttaattcattttaatgcatattctcaaaatattaattattttcaatatttttatcatataaaaaaataaaaatattattcctaagaattaaaattgtgaaaacaaagatgaagtaactattaaaaaccatatgaagtaagtattatagcctacgagttattttttttattgacttttagcttaataatttagttttttctaataaataaccaacaaataaaaaattatttttaaaaataatttccataacaacttatttaaacattttaatttaaacaattgaattaattaataacatcaatctatctatttctttcaaaaaaataaaaaaataaaaaatagaagtactaatttagcatgtacgtggatacgatagtatagtataagtactcctatttggctatttgttaggtgagtatccagtatttaaaggtctcaatctctaccacgaaaactcattctaaaaaaaaaagataaaatgggatatattttggcaacattataatctcatttttttgtttgattaattctcacgacaaaaggaggattatttccatcttttcatcacagttgttaggtttcttcttctctctgttaagatgtgtgagattttccgcgtaaattaatcaaaatctgccattgttatgtctcacttctctctctctctccactttcatcactttatattatatacagaataatctagaaaaagtgttcgcttcagagaggaattggagaatcatccaagcctgaagtttgtttcggagaaaatcggaaaattttaagtcgatcacgatgttagcgttgcagaacgatcagctgcagtatcaacagcagaatttacaacaatcgcagcagaatttgcagcaacaacaaccgcaagatttgcagcagtttcagcggcagttgcaggtttctagggtttcattttcgctcgatcggaatgattcctttctttttaattcagagcatcagcatcgttcgcagcaacagttacagttaccattgtcgtcagcttcaattgtcaagaattcgcaaagttcagatcctcgtcaccgtatgtgttttttgttttgtaaatggttgctctttgtcaattttatgatatgtttataaaattttaattttgatgtaattgtgttaattttttgttatattacttagaacgcgattgttttacattatatttgtcaaatttgcgattttgtgcggctagggtttgtgaagtgattctacggagaacttttagactttatctgttcattgaacttcatgaaagtttgaaaactagatgctaaatttatccatacaaatgatgaaatctgtaaaaatccttatgatttgtttggaatcacattaaactataaattttgaagtgtatggagtagtttcaagtttgtattcagaggtttaagttcatatatttacacatttgtggcatttctcagttgatacttatagctgaaattgtaactaaccatataagtgaaaatgggtggttgaatattcttacacttcaagtttatgtatctcgttggaagtactgtattattgcttaactgattgacgttgaaattaaatgaagtgaatgtttgatatgtaattcttgtttgatttttcaaaaacatgttaggggtacttgtataatttcctgtttttatgatcatttacacatctttataggttcatcggcaaggtggtgaatctataggtttaaactaatggaacttttcttgtttaattggtttgaattttttatcttgaaatgatggatagctttgcgtataattatatgtttttgttatttttcccacctacaagctattgaagtgatgcttttctgtagttgatgacaatttgttgctgactcttgcccaccaaaagtacaagtctgggaactacaagcaagcgcttgacctcagcaatattttatatgagagaaatccacgacgaacagataatcttttgctattgggtgcaatttattatcaggtcatatgctgatttttatttgttaaataggatagatacattatgattggaaattgttgtttggctgcttaggccttagaagcactaactcaggtttgctagtgtacatgtaacagttgaataactatgatgcttgcatttccaaaaatgaagaagctcttcatattgatcctcattttgctgagtgttatggcaatatggcaaatgcatggaaggtacttcgaagccactatttctttataaacaaattttttattaacttgagatatcttaagatatgaagtgctttaaaactttaacttctataagtgtacttgttgtattggaactttctgtattggcttttaaaagctcttcttcgtcttacctgcaggagaagggaaacattgatctagctatccgctattacttggttgcaattgaggtaatgtttccaagaatattgattgtgtttgggtgatggtgatgtaaacttcatggcctgtttgtgttatcaattgtgattttatgcaattttagttatagattattctcttgctcttacatcgatgatggtttcttaagacaaattatctgtgagacacatttttgttctgttatgtttatgtatatttttttttgttgcagcttcgacccaattttgctgatgcatggtccaatttggccaatgcttacatgcggaaagggagggtcagtgatgcagaacaatgttgccaacaggctcttgcattgaatcctaatttggtaaatgtcaggatgcttctgtcagttttatgaaatttgattcctggtaggttgttattgatactcatctgcttttgtaggtggatgctcgttgtacactgggtaatttgttgaaagctcaaggccgagttcaggaggtgagaaaaaaaattaaattttaagtttaggttttttttttcaacaaaacaaaaatattaaaaagtatcacattttttccgaaaagtaacacattcttatgttaaaagtaacaccttttaatgagtttttttcaaatttttttttcttaaagtaacatttttttgcctaatagtatcataaaaaatagtaacacctttttgtctaaaagtaacacatttttagtaaaaagtagtagcactttttgtaagggagattggttctcatggttataaggatggttctcactggaactttttcatatatatatatatatatatatatatatat

We claim:

1. A method of plant control comprising: topically applying to a surface of a herbicide resistant plant a herbicidal composition comprising a polynucleotide, an organosilicone surfactant, and a nonpolynucleotide herbicide that is an inhibitor of a protein imported into a chloroplast, wherein said polynucleotide is identical or complementary to at least 21 contiguous nucleotides of a sequence of a gene encoding for a component of a chloroplast protein import system selected from the group consisting of a translocon at the outer envelope membrane of a chloroplast (TOC), a translocon at the inner envelope membrane of a chloroplast (TIC), a stroma processing peptidase (SPP), and a chaperone like protein associated with the chloroplast protein import system, and wherein said herbicide resistant plant is more sensitive to said nonpolynucleotide herbicide, relative to an untreated herbicide resistant plant.

2. The method of claim 1, wherein said gene is a TOC selected from the group consisting of TOC159, TOC33, TOC34, TOC75, OEP80, TOC132 and TOC64.

3. The method of claim 2, wherein said TOC159 gene comprises a polynucleotide sequence selected from the group consisting of SEQ ID NOs: 1-117.

4. The method of claim 2, wherein said TOC33 gene comprises a polynucleotide sequence selected from the group consisting of SEQ ID NOs: 118-155.

5. The method of claim 2, wherein said TOC34 gene comprises a polynucleotide sequence selected from the group consisting of SEQ ID NOs: 156-247.

6. The method of claim 2, wherein said TOC75 gene comprises a polynucleotide sequence selected from the group consisting of SEQ ID NOs: 248-348.

7. The method of claim 2, wherein said OEP80 gene comprises a polynucleotide sequence selected from the group consisting of SEQ ID NOs: 349-485.

8. The method of claim 2, wherein said TOC132 gene comprises a polynucleotide sequence selected from the group consisting of SEQ ID NOs: 486-569.

9. The method of claim 2, wherein said TOC64 gene comprises a polynucleotide sequence selected from the group consisting of SEQ ID NOs: 1628-1638.

10. The method of claim 1, wherein said gene is a TIC selected from the group consisting of TIC110, TIC20, TIC21, TIC40, TIC100, TIC56, TIC22, TIC55, and TIC62.

11. The method of claim 10, wherein said TIC110 gene comprises a polynucleotide sequence selected from the group consisting of SEQ ID NOs: 570-722.

12. The method of claim 10, wherein said TIC20 gene comprises a polynucleotide sequence selected from the group consisting of SEQ ID NOs: 723-771.

13. The method of claim 10, wherein said TIC21 gene comprises a polynucleotide sequence selected from the group consisting of SEQ ID NOs: 772-840.

14. The method of claim 10, wherein said TIC40 gene comprises a polynucleotide sequence selected from the group consisting of SEQ ID NOs: 841-912.

15. The method of claim 10, wherein said TIC100 gene comprises a polynucleotide sequence selected from the group consisting of SEQ ID NOs: 1131-1207.

16. The method of claim 10, wherein said TIC56 gene comprises a polynucleotide sequence selected from the group consisting of SEQ ID NOs: 1208-1263.

17. The method of claim 10, wherein said TIC22 gene comprises a polynucleotide sequence selected from the group consisting of SEQ ID NOs: 1609-1615.

18. The method of claim 10, wherein said TIC55 gene comprises a polynucleotide sequence selected from the group consisting of SEQ ID NOs: 1616-1623.

19. The method of claim 10, wherein said TIC62 gene comprises a polynucleotide sequence selected from the group consisting of SEQ ID NOs: 1624-1627.

20. The method of claim 1, wherein said gene is an SPP comprising a polynucleotide sequence selected from the group consisting of SEQ ID NOs: 913-1130.

21. The method of claim 20, wherein said polynucleotide sequence is selected from the group consisting of SEQ ID NOs: 1574-1582.

22. The method of claim 1, wherein said herbicidal composition comprises any combination of two or more of said polynucleotides.

23. The method of claim 1, wherein said herbicidal composition further comprises a second polynucleotide, wherein said second polynucleotide is identical or complementary to a segment of a gene sequence encoding for a protein selected from the group consisting of 5-enolpyruvylshikimate-3-phosphate synthase (EPSPS), an acetohydroxyacid synthase or an acetolactate synthase (ALS), an acetyl-coenzyme A carboxylase (ACCase), a phytoene desaturase (PDS), a protoporphyrin IX oxygenase (PPO), a hydroxyphenylpyruvate dioxygenase (HPPD), a para-aminobenzoate synthase, a glutamine synthase (GS), a glufosinate-tolerant glutamine synthase, a 1-deoxy-D-xylulose 5-phosphate (DOXP) synthase, a dihydropteroate (DHP) synthase, a phenylalanine ammonia lyase (PAL), a glutathione S-transferase (GST), a D1 protein of photosystem II, a mono-oxygenase, a cytochrome P450, a cellulose synthase, a beta-tubulin, and a serine hydroxymethyltransferase.

24. The method of claim 1, wherein said herbicidal composition further comprises a second nonpolynucleotide herbicide selected from the group consisting of: 5-diarylpyrazole herbicides, 2-thiopyrimidine herbicides, 3-CF3-benzene herbicides, acetamide herbicides, amide herbicides, aminoacrylate herbicides, aminotriazine herbicides, aromatic acid herbicides, arsenical herbicides, arylaminopropionic acid herbicides, arylcarboxamide herbicides, arylcyclodione herbicides, aryloxyphenoxy-propionate herbicides, azolecarboxamide herbicides, azoloazinone herbicides, azolotriazine herbicides, benzamide herbicides, benzenesulfonamide herbicides, benzhydryl herbicides, benzimidazole herbicides, benzofuran herbicides, benzofuranyl alkylsulfonate herbicides, benzohydrazide herbicides, benzoic acid herbicides, benzophenylmethanone herbicides, benzothiadiazinone herbicides, benzothiazole herbicides, benzothiazoleacetate herbicides, benzoxazole herbicides, benzoyl cyclohexanedione herbicides, benzyloxymethylisoxazole herbicides, benzylpyrazole herbicides, benzylpyridine herbicides, benzylpyrimidone herbicides, bipyridylium herbicides, carbamate herbicides, chloroacetamide herbicides, chloroacetamide herbicides, chlorocarbonic acid herbicides, cyclohexanedione herbicides, cyclohexene oxime herbicides, cyclopropylisoxazole herbicides, diarylether herbicides, dicarboximide herbicides, dihydropyrancarboxamide herbicides, diketo-epoxide herbicides, diketopiperazine herbicides, dinitroaniline herbicides, dinitrophenol herbicides, diphenylether herbicides, diphenylfuranone herbicides, dithiocarbamate herbicides, fluoroalkene herbicides, glyphosate herbicides, halogenated aliphatic herbicides, hydantocidin herbicides, hydroxypyrazole herbicides, imidazolinone herbicides, indazole herbicides, indenedione herbicides, inorganic herbicides, isoxazole herbicides, isoxazolesulfone herbicides, isoxazolidinone herbicides, nicotinohydrazide herbicides, nitrile herbicides, nitrile-amide herbicides, nitropyrazole herbicides, N-phenylphthalimide herbicides, organoarsenical herbicides, organophosphates herbicides, organophosphorus herbicides, oxabicycloheptane herbicides, oxadiazole herbicides, oxadiazolebenzamide herbicides, oxadiazolone herbicides, oxazole herbicides, oxazolidinedione herbicides, oxyacetamide herbicides, phenoxy herbicides, phenoxyalkyne herbicides, phenoxycarboxylic acid herbicides, phenoxypyridazinol herbicides, phenylalkanoate herbicides, phenylcarbamate herbicides, phenylenediamine herbicides, phenylethylurea herbicides, phenylimidazole herbicides, phenylisoxazole herbicides, phenylpyrazole herbicides, phenylpyrazoline herbicides, phenylpyridazine herbicides, phenylpyridine herbicides, phenylpyrrolidone herbicides, phosphinic acid herbicides, phosphonate herbicides, phosphoroamidate herbicides, phosphorodithioate herbicides, phthalamate herbicides, propionamide herbicides, pyrazole herbicides, pyrazole-arylether herbicides, pyrazolium herbicides, pyridazine herbicides, pyridazinone herbicides, pyridine herbicides, pyridinecarboxamide herbicides, pyridinecarboxylic acid herbicides, pyridinone herbicides, pyridyl-benzylamide herbicides, pyridyl-ether-carboxamide herbicides, pyrimidinecarboxylic acid herbicides, pyrimidinediamine herbicides, pyrimidinedione herbicides, pyrimidinetrione herbicides, pyrimidinone herbicides, pyrimidinyl(thio)benzoate herbicides, pyrimidinyloxybenzylamine herbicides, pyrimidylmethanol herbicides, pyrrolidone herbicides, quaternary ammonium herbicides, quinoline-carboxylic acid herbicides, quinoxaline herbicides, semicarbazone herbicides, sulfonamide herbicides, sulfonylamino-carbonyl-triazolinone herbicides, sulfonylurea herbicides, sulfonylurea herbicides, tetrazolinone herbicides, thiadiazole herbicides, thiatriazine herbicides, thienopyrimidine herbicides, thiocarbamate herbicides, thiocarbonate herbicides, thiourea herbicides, tolyltriazole herbicides, triazine herbicides, triazinedione herbicides, triazine-sulfonanilide herbicides, triazinone herbicides, triazole herbicides, triazolecarboxamide herbicides, triazoleimine herbicides, triazolinone herbicides, triazolone herbicides, triazolopyrimidine herbicides, triketone herbicides, uracil herbicides, and urea herbicides.

25. The method of claim 24, wherein said composition further comprises more than one of said second nonpolynucleotide herbicide from different chemical families.

26. The method of claim 1, wherein said organosilicone surfactant is at a concentration between about 0.1 percent and about 2 percent.

27. The method of claim 26, wherein said organosilicone surfactant is at a concentration between about 0.5 percent and about 1 percent.

28. The method of claim 1, wherein said herbicide resistant plant is a weedy plant selected from the group consisting of *Abutilon theophrasti, Alopecurus myosuroides, Amaranthus albus, Amaranthus chlorostachys, Amaranthus graecizans, Amaranthus hybridus, Amaranthus lividus, Amaranthus palmeri, Amaranthus rudis, Amaranthus spinosus, Amaranthus thunbergii, Amaranthus viridis, Ambrosia artemisifolia, Ambrosia trifida, Avena fatua, Chenopodium album, Commelina diffusa, Convolvulus arvensis, Conyza canadensis, Cyperus esculentus, Digitaria sanguinalis, Echinochloa colona, Echinochloa crus-galli, Euphorbia heterophylla, Festuca arundinacea, Ipomoea hederacea, Kochia scoparia, Lolium arundinaceum, Lolium multiflorum, Lolium rigidum, Portulaca oleracea, Senna obtusifolia, Setaria viridis, Sorghum halepense, Spirodela polyrrhiza, Taraxacum officinale, Trifolium repens*, and *Xanthium strumarium*.

29. A herbicidal composition comprising an admixture of a polynucleotide and a nonpolynucleotide herbicide that is an inhibitor of a protein imported into a chloroplast, wherein said polynucleotide is identical or complementary to at least 21 contiguous nucleotides of a sequence of a gene encoding for a component of a chloroplast protein import system selected from the group consisting of a translocon at the outer envelope membrane of a chloroplast (TOC), a translocon at the inner envelope membrane of a chloroplast (TIC), a stroma processing peptidase (SPP), and a chaperone like protein associated with the chloroplast protein import system, and upon a topical application of said herbicidal composition to a surface of a herbicide resistant plant, said herbicide resistant plant is more sensitive to said nonpolynucleotide herbicide, relative to an untreated herbicide resistant plant.

30. The herbicidal composition of claim 29, wherein said sequence of said gene is selected from the group consisting of SEQ ID NOs: 1-1534 and 1584-1638.

31. The herbicidal composition of claim 29, wherein said polynucleotide is selected from the group consisting of polynucleotide positions 369-701, 1016-1168, 1364-1622, and 1683-1792 of SEQ ID NO: 365.

32. The herbicidal composition of claim 29, further comprising a pesticide, wherein said pesticide is selected from the group consisting of insecticides, fungicides, nematicides, bactericides, acaricides, growth regulators, chemosterilants, semiochemicals, repellents, attractants, pheromones, feeding stimulants, and biopesticides.

33. The method of claim 1, wherein said nonpolynucleotide herbicide is glyphosate.

34. The method of claim 1, wherein said nonpolynucleotide herbicide is an HPPD inhibitor herbicide.

35. The herbicidal composition of claim 29, wherein said nonpolynucleotide herbicide is glyphosate.

36. The herbicidal composition of claim 29, wherein said nonpolynucleotide herbicide is an HPPD inhibitor herbicide.

* * * * *